United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 88

SEQ ID NO: 171988 - DNA, 3741 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcatgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171989 - DNA, 3741 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcctgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171990 - DNA, 3741 bp, Artificial Sequence; identical to SEQ ID NO: 171989
  Description of Artificial Sequence: Synthetic coding sequence

SEQ ID NO: 171991 - DNA, 3741 bp, Artificial Sequence; identical to SEQ ID NO: 171989
  Description of Artificial Sequence: Synthetic coding sequence

SEQ ID NO: 171992 - DNA, 3741 bp, Artificial Sequence; identical to SEQ ID NO: 171989
  Description of Artificial Sequence: Synthetic coding sequence

SEQ ID NO: 171993 - DNA, 3267 bp, Artificial Sequence
  Description of Artificial Sequence: Synthetic coding sequence
atggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcatgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171994 - DNA, 3741 bp, Artificial Sequence; identical to SEQ ID NO: 171988
  Description of Artificial Sequence: Synthetic coding sequence

SEQ ID NO: 171995 - DNA, 3162 bp, Artificial Sequence
  Description of Artificial Sequence: Synthetic coding sequence
atggactttgcccccaaggactgccccaccccagcccctggcctgctgagcctgagctgcatgctggagcccctggacctgggcggcggagatgaagatgaaaatgaagctgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgacagcgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagacctttggagccaagcagcccacccaccagggcggccctgcccaggacagaggagtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcctggagaatatgtgcagatggccggccgggccggcagaagaggcctggaccccactggaacagtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaggccggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggggccgcccggctggtgggggagcctgtgctgggcgccaagatggagacagctgccaccctgctgcggcgggacatcgtgtttgctgccagcctgtacacccagtag

SEQ ID NO: 171996 - DNA, 3162 bp, Artificial Sequence; identical to SEQ ID NO: 171995
  Description of Artificial Sequence: Synthetic coding sequence

SEQ ID NO: 171997 - DNA, 693 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagaacaccaacctgagcgccaccaccagcctgagcctgcggcggcccccaggccctgccagccagagcctgtggggcaaccccacccagtaccccttctggccaggcggcatggatgagcccaccatcacagacctgaacacccgggaggaggccgaggaggagattgactttgagaaggacctgctgaccatccccccaggcttcaagaagggcatggactttgcccccaagggctctgtgcacagctgcatccacccccggggcccccgggccagcatcagcggggctgtgggccacccctgtggccgccacctgccctgctggtag

SEQ ID NO: 171998 - DNA, 3267 bp, Artificial Sequence
  Description of Artificial Sequence: Synthetic coding sequence
atggatgagcccaccatcacagacctgaacacccgggaggaggccgaggaggagattgactttgagaaggacctgctgaccatccccccaggcttcaagaagggcatggactttgcccccaaggactgccccaccccagcccctggcctgctgagcctgagctgcctgctggagcccctggacctgggcggcggagatgaagatgaaaatgaggccgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgattctgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 171999 - DNA, 3162 bp, Artificial Sequence
  Description of Artificial Sequence: Synthetic coding sequence
atggactttgcccccaaggactgccccaccccagcccctggcctgctgagcctgagctgcctgctggagcccctggacctgggcggcggagatgaagatgaaaatgaagctgtgggccagcccggcggccccaggggggacacagtgtctgccagcccctgcagcgcccccctggcccgggccagcagcctggaggacctggtgctgaaggaggccagcacagctgtgtccaccccagaggcccctgagccccccagccaggagcagtgggccatccctgtggatgccaccagccctgtgggggacttctaccgcctcatcccccagcctgccttccagtgggcctttgagccagatgtgttccagaagcaggccatcctgcacctggagagacatgacagcgtgtttgtggccgcccacaccagcgctgggaagacagtggtggccgagtatgccatcgccctggcccagaagcacatgaccaggaccatctacaccagccccatcaaggccctgagcaaccagaagttccgggacttcaggaacacctttggagatgtgggcctgctgactggagatgtgcagctgcaccctgaggccagctgcctgatcatgaccacagagatcctgcgctccatgctgtacagcggcagtgatgtgatccgggacctggagtgggtgatctttgatgaggtgcactacatcaatgatgtggagcggggcgtggtgtgggaggaggtgctgatcatgctgcctgaccacgtgtccatcatcctgctgagcgccaccgtgcccaatgccctggagtttgctgactggattggccgcctgaagaggcggcagatctacgtgatcagcacagtgaccaggcctgtgcccctggagcactacctgttcaccggcaacagcagcaagacccagggcgagctgttcctgctgctggacagcagaggagccttccacaccaagggctactatgctgctgtggaggccaagaaggagaggatgagcaagcacgcccagacctttggagccaagcagcccacccaccagggcggccctgcccaggacagaggagtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcctggagaatatgtgcagatggccggccgggccggcagaagaggcctggaccccactggaacagtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaggccggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggggccgcccggctggtgggggagcctgtgctgggcgccaagatggagacagctgccaccctgctgcggcgggacatcgtgtttgctgccagcctgtacacccagtag

SEQ ID NO: 172000 - DNA, 2643 bp, Artificial Sequence
  Description of Artificial Sequence: Synthetic coding sequence
atgatggagacagagcggctggtgctgcccccaccagaccccctggacctgcccctgcgggctgtggagctgggctgcaccggccactgggagctgctgaacctgcccggggcccctgagagcagcctgccccacggcctgcccccctgtgccccagacctgcagcaggaggccgagcagctgttcctgagcagccctgcctggctgcccctgcacggcgtggagcacagcgccaggaagtggcagaggaagacagacccctggagcctgctggccgtgctgggcgcccctgtgcccagcgacctgcaggcccagaggcaccccaccaccggccagatcctgggctacaaggaggtgctgctggagcactacctgttcaccggcaacagcagcaagacccagggcgagctgttcctgctgctggacagcagaggagccttccacaccaagggctactatgctgctgtggaggccaagaaggagaggatgagcaagcacgcccagaccttcggggccaagcagcccacccaccagggcggccctgcccaggaccggggcgtgtacctgagcctgctggccagcctgcggacccgggcccagctgcctgtggtggtgttcaccttcagccggggccgctgtgatgagcaggccagcggcctgaccagcctggacctgaccaccagcagcgagaagtctgagatccacctgttcctgcagcgctgcctggcccggctgcggggcagtgaccggcagctgccccaggtgctgcacatgtctgagctgctgaacagaggcctgggcgtgcaccacagcggcatcctgcccatcctgaaggagatcgtggagatgctgttcagccggggcctggtgaaggtgctgtttgccacagagacctttgccatgggcgtgaacatgcctgccaggacagtggtgtttgacagcatgaggaagcatgatggcagcaccttccgggacctgctgcccggggagtatgtgcagatggccggccgggccggccggcggggcctggaccccaccggcaccgtcatcctgctgtgcaagggccgggtgcctgagatggctgacctgcacaggatgatgatgggcaagcccagccagctgcagagccagttccggctgacctacaccatgatcctgaacctgctgcgggtggatgccctgcgggtggaggacatgatgaagaggagcttcagcgagttccccagcaggaaggacagcaaggcccacgagcaggccctggccgagctgaccaagaggctgggcgccctggaggagccagacatgacaggccagctggtggacctgcctgagtactacagctggggcgaggagctgacagagacccagcacatgatccagaggcgcatcatggagagcgtgaatggcctgaagagcctgtctgctggccgggtggtggtggtgaagaaccaggagcaccacaatgccctgggcgtcatcctgcaggtgagcagcaacagcaccagcagggtcttcaccaccctggtgctgtgtgacaagcccctgagccaggacccccaggaccggggccctgccacagctgaggtgccctacccagatgacctggtgggcttcaagctgttcctgcctgagggcccctgtgaccacacagtggtgaagctgcagcccggggacatggccgccatcaccaccaaggtgctgcgggtgaatggagagaagatcctggaggacttcagcaagaggcagcagcccaagttcaagaaggacccccccctggccgctgtgaccacagctgtgcaggagctgctgcggctggcccaggcccaccctgctggcccccccaccctggaccctgtgaatgacctgcagctgaaggacatgtctgtggtggagggcggcctgcgggccaggaagctggaggagctgatccagggcgcccagtgtgtgcacagcccccgcttccctgcccagtacctgaagctgcgggagaggatgcagatccagaaggagatggagcggctgcgcttcctgctgagtgaccagagcctgctgctgctgcctgagtaccaccagagggtggaggtgctgcggaccctgggctacgtggatgaagctggcaccgtgaagctggccggccgggtggcctgtgccatgagcagccatgagctgctgctgacagagctgatgtttgacaatgccctgagcaccctgcggcctgaggagattgctgccctgctgagcggcctggtgtgccagagccctggagatgctggggaccagctgcccaacaccctgaagcagggcatcgagcgggtgcgggctgtggccaagagaattggagaggtgcaggtggcctgtggcctgaaccagacagtggaggagtttgtgggggagctgaactttggcctggtggaggtggtgtatgagtgggcccggggcatgcccttcagcgagctggccggcctgagcggcaccccagagggcctggtggtgcgctgcatccagaggctggccgagatgtgccgcagcctgcggggagctgcccggctggtgggggagcctgtgctgggcgccaagatggagacagctgccaccctgctgcggcgggacatcgtgtttgctgccagcctgtacacccagtag

SEQ ID NO: 172001 - DNA, 3267 bp, Artificial Sequence; identical to SEQ ID NO: 171998
  Description of Artificial Sequence: Synthetic coding sequence

SEQ ID NO: 172002 - DNA, 2643 bp, Artificial Sequence; identical to SEQ ID NO: 172000
  Description of Artificial Sequence: Synthetic coding sequence

SEQ ID NO: 172003 - DNA, 2643 bp, Artificial Sequence; identical to SEQ ID NO: 172000
  Description of Artificial Sequence: Synthetic coding sequence

SEQ ID NO: 172004 - DNA, 693 bp, Artificial Sequence; identical to SEQ ID NO: 171997
  Description of Artificial Sequence: Synthetic coding sequence

SEQ ID NO: 172005 - DNA, 2643 bp, Artificial Sequence; identical to SEQ ID NO: 172000
  Description of Artificial Sequence: Synthetic coding sequence

SEQ ID NO: 172006 - DNA, 3267 bp, Artificial Sequence; identical to SEQ ID NO: 171998
  Description of Artificial Sequence: Synthetic coding sequence

SEQ ID NO: 172007 - DNA, 3267 bp, Artificial Sequence; identical to SEQ ID NO: 171998
  Description of Artificial Sequence: Synthetic coding sequence

SEQ ID NO: 172008 - DNA, 693 bp, Artificial Sequence; identical to SEQ ID NO: 171997
  Description of Artificial Sequence: Synthetic coding sequence

SEQ ID NO: 172009 - DNA, 3267 bp, Artificial Sequence; identical to SEQ ID NO: 171993
  Description of Artificial Sequence: Synthetic coding sequence

SEQ ID NO: 172010 - DNA, 693 bp, Artificial Sequence; identical to SEQ ID NO: 171997
  Description of Artificial Sequence: Synthetic coding sequence

SEQ ID NO: 172011 - DNA, 2643 bp, Artificial Sequence; identical to SEQ ID NO: 172000
  Description of Artificial Sequence: Synthetic coding sequence

SEQ ID NO: 172012 - DNA, 693 bp, Artificial Sequence; identical to SEQ ID NO: 171997
  Description of Artificial Sequence: Synthetic coding sequence

SEQ ID NO: 172013 - DNA, 3162 bp, Artificial Sequence; identical to SEQ ID NO: 171999
  Description of Artificial Sequence: Synthetic coding sequence

SEQ ID NO: 172014 - DNA, 3162 bp, Artificial Sequence; identical to SEQ ID NO: 171999
  Description of Artificial Sequence: Synthetic coding sequence

SEQ ID NO: 172015 - DNA, 3162 bp, Artificial Sequence; identical to SEQ ID NO: 171999
  Description of Artificial Sequence: Synthetic coding sequence

SEQ ID NO: 172016 - DNA, 465 bp, Artificial Sequence
  Description of Artificial Sequence: Synthetic coding sequence
atggccaccaaggctgtgtgtgtgctgaagggagatggccctgtgcagggcatcatcaactttgagcagaaggagagcaatggacctgtgaaggtgtggggcagcatcaagggcctgacagagggcctgcacggcttccacgtgcatgaatttggagacaacacagctggctgcaccagcgctggcccccacttcaaccccctgagcaggaagcacggcggccccaaggatgaggagagacatgtgggggacctgggcaatgtgacagctgacaaggatggagtggctgatgtgtccattgaagattctgtcatcagcctgagcggggaccactgcatcatcggccgcaccctggtggtgcatgagaaggcagatgacctgggcaaaggaggaaatgaggagagcaccaagacaggaaatgccggcagccggctggcctgtggggtcatcggcatcgcccagtag

SEQ ID NO: 172017 - DNA, 108 bp, Artificial Sequence
  Description of Artificial Sequence: Synthetic coding sequence
atggccaccaaggctgtgtgtgtgctgaagggagatggccctgtgcagggcatcatcaactttgagcagaaggagagcaatggacctgagggcgtgggcaagcactag

SEQ ID NO: 172018 - DNA, 1074 bp, Artificial Sequence
  Description of Artificial Sequence: Synthetic coding sequence
atggattctgtggagaagaccaccaacagaagtgagcagaagagcaggaagttcctgaagagcctcatcaggaagcagccccaggagctgctgctggtgattggcaccggggtgtctgctgctgtggcccctggcatcccagccctgtgctcctggaggagctgcatcgaggccgtcatcgaggccgctgagcagctggaggtgctgcaccctggagatgtggccgagttccggaggaaggtgaccaaggaccgggacctgctggtggtggcccatgacctgatcaggaagatgagccccaggactggagatgccaagcccagcttcttccaggactgcctgatggaggtgtttgatgacctggagcagcacatccgcagccctgtggtgctgcagagcatcctgagcctgatggacagaggagccatggtgctgaccaccaactatgacaacctgctggaggccttcggccggcggcagaacaagcccatggagagcctggacctgaaggacaagaccaaggtgctggagtgggcccggggccacatgaagtatggagtgctgcacatccacggcctgtacacagacccctgtggggtggtgctggaccccagcggctacaaggatgtgacccaggatgctgaggtgatggaggtgctgcagaacctgtaccgcaccaagagcttcctgtttgtgggctgtggggagaccctgcgggaccagatcttccaggccctcttcctgtacagcgtgcccaacaaggtggacctggagcactacatgctggtgctgaaggaaaatgaagaccacttcttcaagcaccaggccgacatgctgctgcacggcatcaaggtggtgtcctatggagactgctttgaccacttccctggctacgtgcaggacctggccacccagatctgcaagcagcagagcccagatgctgacagagtggacagcaccaccctgctgggcaatgcctgccaggactgtgccaagaggaagctggaggagaatggcatcgaggtgtccaagaagaggacccagagcgacacagatgatgctgggggcagctag

SEQ ID NO: 172019 - DNA, 636 bp, Artificial Sequence
  Description of Artificial Sequence: Synthetic coding sequence
atggaccccaggaaggtgaatgagctgcgggcctttgtgaagatgtgcaagcaggaccccagcgtgctgcacacagaggagatgaggttcctgcgggagtgggtggagagcatgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtgattgaaccagacacagatgccccccaggagatgggagatgaaaatgctgagatcacagaggagatgatggaccaggccaatgacaagaaggtggccgccatcgaggccctgaatgatggagagctgcagaaggccatcgacctcttcacagatgccatcaagctgaacccccggctggccatcctgtatgccaagagggcctctgtgtttgtgaagctgcagaagcccaatgctgccatccgggactgtgaccgggccatcgagatcaacccagattctgcccagccctacaagtggaggggcaaggcccaccggctgctgggccactgggaggaggccgcccatgacctggccctggcctggacccagtag

SEQ ID NO: 172020 - DNA, 489 bp, Artificial Sequence
  Description of Artificial Sequence: Synthetic coding sequence
atgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtcatcgagccagacacagatgccccccaggagatgggagatgaaaatgctgagatcacagaggagatgatggaccaggccaatgacaagaaggtggccgccatcgaggccctgaatgatggagagctgcagaaggccatcgacctcttcacagatgccatcaagctgaacccccggctggccatcctgtatgccaagagggcctctgtgtttgtgaagctgcagaagcccaatgctgccatccgggactgtgaccgggccatcgagatcaacccagacagcgcccagccctacaagtggaggggcaaggcccaccggctgctgggccactgggagtag

SEQ ID NO: 172021 - DNA, 366 bp, Artificial Sequence
  Description of Artificial Sequence: Synthetic coding sequence
atggaccccaggaaggtgaatgagctgcgggcctttgtgaagatgtgcaagcaggaccccagcgtgctgcacacagaggagatgaggttcctgcgggagtgggtggagagcatgggcggcaaggtgcccccagccacccagaaggccaagtctgaggagaacaccaaggaggagaagccagacagcaagaaggtggaggaggacctgaaggcagatgagcccagcagcgaggagagtgacctggagattgacaaggagggcgtgattgaaccagacacagatgccccccaggagatgggagatgaaaatgctgagatcacagaggagatgatggaccaggccaatgacaagagcggctgctactag

SEQ ID NO: 172022 - DNA, 2568 bp, Artificial Sequence
  Description of Artificial Sequence: Synthetic coding sequence
atgggcagtgaccgggccaggaagggcggcggcggccccaaggactttggagctggcctgaagtacaacagcagacatgagaaggtgaatggcctggaggagggcgtggagttcctgcctgtgaacaacgtgaagaaggtggagaagcacggccctggccgctgggtggtgctggccgctgtgctgattggcctgctgctggtgctgctgggcatcggcttcctggtgtggcacctgcagtacagagatgtgcgggtgcagaaggtgttcaacggctacatgaggatcaccaatgaaaattttgtggatgcctatgagaacagcaacagcacagaatttgtgtccctggccagcaaggtgaaggatgccctgaagctgctgtacagcggcgtgcccttcctgggcccctaccacaaggagagcgctgtgacagccttcagcgagggcagcgtcatcgcctactactggagcgagttcagcatcccccagcacctggtggaggaggccgagcgggtgatggccgaggagcgggtggtgatgctgcccccccgggcccggagcctgaagagctttgtggtgacctctgtggtggccttccccacagacagcaagacagtgcagaggacccaggacaacagctgcagctttggcctgcacgcccggggcgtggagctgatgaggttcaccaccccaggcttcccagacagcccctacccagcccacgcccgctgccagtgggccctgcggggagatgctgacagcgtgctgagcctgaccttccgcagctttgacctggccagctgtgatgagcggggcagtgacctggtgacagtgtacaacaccctgagccccatggagccccacgccctggtgcagctgtgtggcacctacccacccagctacaacctgaccttccacagcagccagaatgtgctgctgatcaccctcatcaccaacacagagcggcggcaccctggctttgaggccaccttcttccagctgcccaggatgagcagctgtggcggccgcctgaggaaggcccagggcaccttcaacagcccctactacccaggccactacccacccaacatcgactgcacctggaacatcgaggtgcccaacaaccagcacgtgaaggtgcgcttcaagttcttctacctgctggagcccggggtgcctgctggcacctgccccaaggactatgtggagatcaatggagagaagtactgtggggagaggagccagtttgtggtgaccagcaacagcaacaagatcaccgtgcgcttccacagcgaccagagctacacagacaccggcttcctggccgagtacctgtcctatgacagcagtgacccctgccccggccagttcacctgcaggacaggccgctgcatcaggaaggagctgcgctgtgatggctgggccgactgcacagaccacagtgatgagctgaactgcagctgtgatgctggccaccagttcacctgcaagaacaagttctgcaagcccctcttctgggtgtgtgacagcgtgaatgactgtggggacaacagtgatgagcagggctgcagctgcccagcccagaccttccgctgcagcaatggcaagtgcctgagcaagagccagcagtgcaatggcaaggatgactgtggagatggcagtgatgaggccagctgccccaaggtgaatgtggtgacctgcaccaagcacacctaccgctgcctgaatggcctgtgcctgagcaagggcaacccagaatgtgatggcaaggaggactgcagtgatggcagtgatgagaaggactgtgactgtggcctgcggagcttcacccggcaggcccgggtggtgggcggcacagatgctgatgaaggagagtggccctggcaggtgtccctgcacgccctgggccagggccacatctgtggggccagcctcatcagccccaactggctggtgtctgctgcccactgctacattgatgaccggggcttccgctacagcgaccccacccagtggacagccttcctgggcctgcatgaccagagccagaggtctgcccctggggtgcaggagcggcggctgaagaggatcatcagccaccccttcttcaatgacttcacctttgattatgacatcgccctgctggagctggagaagccagctgagtacagctccatggtgcggcccatctgcctgcctgatgccagccacgtgtttcctgctgggaaggccatctgggtgacaggctggggccacacccagtatggaggcaccggggccctgatcctgcagaagggggagatccgggtcatcaaccagaccacctgtgagaacctgctgccccagcagatcacccccaggatgatgtgtgtgggcttcctgtctggaggagtggacagctgccagggcgacagcggcggccccctgagctctgtggaggctgatggccgcatcttccaggccggcgtggtgtcctggggagatggctgtgcccagaggaacaagccaggagtgtacacccggctgcccctcttccgggactggatcaaggaaaatactggagtgtag

SEQ ID NO: 172023 - DNA, 3414 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgctgctggcccccggggcgtgctgctgaccaggacaggcacccgggcccacagcctgggcatccgggagaagatcagcgcctgggagggccggcgggaggccagccccaggatgtccatgtgtggggagaagcgggagggcagcggcagcgagtgggccgccagcgagggctgccccagcctgggctgccccagcgtggtgcccagcccctgcagcagcgagaagacctttgacttcaagggcctgcggaggatgagcaggaccttcagcgagtgcagctacccagagacagaggaggagggggaggccctgcctgtgcgggacagcttctaccgcctggagaagaggctgggccgctctgagcccagcgccttcctgcggggccacggcagcaggaaggagagcagcgctgtgctgagccgcatccagaagattgagcaggtgctgaaggagcagcccggccggggcctgccccagctgcccagcagctgctacagcgtggaccggggcaagaggaagacaggcaccctgggcagcctggaggagcctgctggaggagcctctgtgtctgctggcagcagagctgtgggcgtggccggcgtggccggggaggccggccccccacctgagcgggagggcagcggcagcaccaagccaggcaccccaggcaacagccccagcagccagaggctgcccagcaagagcagcctggaccctgctgtgaaccctgtgcccaagcccaagaggacctttgaatatgaggccgacaagaaccccaagagcaagcccagcaatggcctgccccccagccccaccccagctgcccccccacccctgcccagcaccccagcccctcctgtgacccggcggcccaagaaggacatgaggggccacaggaagagccagagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172024 - DNA, 3414 bp, Artificial Sequence; identical to SEQ ID NO: 172023
  Description of Artificial Sequence: Synthetic coding sequence

SEQ ID NO: 172025 - DNA, 1263 bp, Artificial Sequence
  Description of Artificial Sequence: Synthetic coding sequence
atgaccagcaggaagaatggaggaggagcccacagctggcaggagaccccctgggagcagaggcgggccctgggcctgcagagagctgagatgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgctgagcaccctgtggtggtgccccagccgccgcagccaccgggagacccccaccagccccaagagccccaccagcttccccagaaatgtgctgagccctgccctgcacgtggccgccggcagcttctccttcctgcggctgtgcagcagcaggaccagcttcagaagatctgtgcagaccccagcctggagccccagccctgcccagctggccctgctggaccggcccaccaagcagatgagggaggccgaggagcggctgaaggccatcccccagttctgcttcccagatgccaaggactggctgcctgtgtctgagtacatgaggcccttcctgagctgctag

SEQ ID NO: 172026 - DNA, 174 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctactag

SEQ ID NO: 172027 - DNA, 123 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccatag

SEQ ID NO: 172028 - DNA, 144 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccactag

SEQ ID NO: 172029 - DNA, 219 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgtag

SEQ ID NO: 172030 - DNA, 375 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggactag

SEQ ID NO: 172031 - DNA, 429 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggatag

SEQ ID NO: 172032 - DNA, 2154 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172033 - DNA, 159 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagacctag

SEQ ID NO: 172034 - DNA, 336 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagaggtag

SEQ ID NO: 172035 - DNA, 162 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagctag

SEQ ID NO: 172036 - DNA, 252 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggacccctag

SEQ ID NO: 172037 - DNA, 288 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagtag

SEQ ID NO: 172038 - DNA, 465 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgctgctggcccccggggcgtgctgctgaccaggtag

SEQ ID NO: 172039 - DNA, 540 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagtag

SEQ ID NO: 172040 - DNA, 2154 bp, Artificial Sequence; identical to SEQ ID NO: 172032
  Description of Artificial Sequence: Synthetic coding sequence

SEQ ID NO: 172041 - DNA, 411 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaaggagaacccctatgaagatgtggacctgaagagcagaagagctggcaggaagagccagcagctgtctgagaacagcctggacagcctgcacaggatgtggagcccccaggacaggaagtacaacagcccccccacccagctgagcctgaagcccaacagccagagcctgcggtctggatag

SEQ ID NO: 172042 - DNA, 225 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcctag

SEQ ID NO: 172043 - DNA, 420 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcaccccctag

SEQ ID NO: 172044 - DNA, 1830 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtggactttgaatgtctcttcacctgcctgtctgtgcggcagctgatccgcatctttgccagcctgctgctggagaggagggtcatctttgtggccgacaagctgagcaccctgagcagctgcagccatgctgtggtggccctgctgtaccccttctcctggcagcacaccttcatccctgtgctgcctgcctccatgattgacatcgtgtgctgccccacccccttcctggtgggcctgctgagcagcagcctgcccaagctgaaggagctgcctgtggaggaggccctgatggtgaacctgggcagtgaccgcttcatccggcagatggatgatgaggacaccctgctgcccaggaagctgcaggccgccctggagcaggccctggagaggaagaatgagctgatcagccaggacagcgacagcgacagtgatgatgagtgcaacaccctgaatggcctggtgtctgaggtgttcatccgcttctttgtggagaccgtgggccactacagcctcttcctgacccagagcgagaagggggagcgggccttccagcgggaggccttcaggaagtctgtggccagcaagagcatccgccgcttcctggaggtgttcatggagagccagatgtttgctggcttcatccaggaccgggagctgaggaaatgtcgggccaagggcctgtttgagcagagggtggagcagtacctggaggagctgcctgacacagagcagagcggcatgaacaagttcctgcggggcctgggcaacaagatgaagttcctgcacaagaagaactag

SEQ ID NO: 172045 - DNA, 234 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgcccaagtag

SEQ ID NO: 172046 - DNA, 81 bp, Artificial Sequence
  Description of Artificial Sequence: Synthetic coding sequence
atgaccatgacagccaacaagaacagcagcatcacccatggagctgggggcaccaaggccccccggggcaccctgtcctag

SEQ ID NO: 172047 - DNA, 1035 bp, Artificial Sequence
  Description of Artificial Sequence: Synthetic coding sequence
atgtggagcccccaggacaggaagtacaacagcccccccacccagctgagcctgaagcccaacagccagagcctgcggagcggcaactggagcgagaggaagagccaccggctgccccggctgcccaagaggcacagccatgatgacatgctgctgctggcccagctgagcctgcccagcagccccagcagcctgaatgaagacagcctgagcaccaccagcgagctgctgagcagccggcgggcccggcgcatccccaagctggtgcagaggatcaacagcatctacaatgccaagaggggcaagaagaggctgaagaagctgtccatgagcagcattgaaacagccagcctgagagatgaaaattctgagagcgagagtgacagtgatgaccgcttcaaggcccacacccagaggctggtgcacatccagagcatgctgaagagggcccccagctaccgcaccctggagctggagctgctggagtggcaggagcgggagctgtttgagtactttgtggtggtgtccctgaagaagaagcccagcaggaacacctacctgcctgaggtgtcctaccagttccccaagctggaccggcccaccaagcagatgagggaggccgaggagcggctgaaggccatcccccagttctgcttcccagatgccaaggactggctgcctgtgtctgagtacagcagcgagaccttctccttcatgctgactggagaagatggcagcagaagatttggctactgccggcggctgctgcccagcggcaagggcccccggctgcctgaggtgtactgtgtgatcagccggctgggctgcttcggcctcttcagcaaggtgctggatgaggtggagcggcggcggggcatctctgctgccctggtgtaccccttcatgaggagcctgatggagagccccttccctgcccctgggaagaccatcaaggtgaagaccttcctgcccggggctggaaatgaggtgctggagctgcggcggcccatggacagccggctggagcacgtgtag

SEQ ID NO: 172048 - DNA, 231 bp, Artificial Sequence
  Description of Artificial Sequence: Synthetic coding sequence
atgaccatgacagccaacaagaacagcagcatcacccatggagctgggggcaccaaggccccccggggcaccctgagcaggaagagctttgaatttgaagatgccagcagcctgcagagcctgtaccccagcagccccacagaaaatggaacagagaaccagcccaagtttggcagcaagagcaccctggaggagaatgcctatgaagatattgtgggggacctgccctag

SEQ ID NO: 172049 - DNA, 225 bp, Artificial Sequence; identical to SEQ ID NO: 172042
  Description of Artificial Sequence: Synthetic coding sequence

SEQ ID NO: 172050 - DNA, 435 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcccaggatgtggccggcgtggccgcctgcctgcccctggcccagagcacccccttccctggccctgcctag

SEQ ID NO: 172051 - DNA, 3414 bp, Artificial Sequence; identical to SEQ ID NO: 172023
  Description of Artificial Sequence: Synthetic coding sequence

SEQ ID NO: 172052 - DNA, 369 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagcgtgtccccacctcctgtgctgagccccccaagaagccccatctaccccctgagtgacagcgagaccagcgcctgccgctaccccagccacagcagcagccgggtgctgctgaaggacagacaccccccagcccccagcccccagaacccccaggaccccagcccagacaccagcccccccacctgccccttcaagacagccagctttggctacctggacaggagccccagcgcctgcaagagagatgcccagaaggagagcgtgcagggcgccgcctag

SEQ ID NO: 172053 - DNA, 93 bp, Artificial Sequence
  Description of Artificial Sequence: Synthetic coding sequence
atgaccatgacagccaacaagaacagcagcatcacccatggagctgggggcaccaaggccccccggggcaccctgagccgcagccagagctag

SEQ ID NO: 172054 - DNA, 1758 bp, Artificial Sequence
  Description of Artificial Sequence: Synthetic coding sequence
atggccgaggccgccaccggcttcctggagcagctgaagagctgcatcgtgtggagctggacctacctgtggacagtgtggttcttcatcgtgctcttcctggtgtacatcctgcgggtgcccctgaagatcaatgacaacctgagcacagtgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgagatccgcagccgggtggaggtgcccctcatcgccagcagcaccatctgggagatcaagctgctgcccaagtgtgccacagcctacatcctgctggccgaggaggaggccaccaccatcgccgaggccgagaagctgttcaagcaggccctgaaggctggagatggctgctaccgccgcagccagcagctgcagcaccacggcagccagtatgaggcccagcacagaagagacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagccggcggggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccatgattgacatcttctgcagcgctgagttccgggactggaactgcaagagcatcttcatgagggtggaggatgagctggagatccccccagccccccagagccagcacttccagaactag

SEQ ID NO: 172055 - DNA, 1500 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcacagcttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172056 - DNA, 1536 bp, Artificial Sequence
  Description of Artificial Sequence: Synthetic coding sequence
atgtttggaacagagagcagcctgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctaccgccgcagccagcagctgcagcaccacggcagccagtatgaggcccagcacagaagagacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagccggcggggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172057 - DNA, 1605 bp, Artificial Sequence
  Description of Artificial Sequence: Synthetic coding sequence
atgtttggaacagagagcagcctgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgagatccgcagccgggtggaggtgcccctgattgccagcagcaccatctgggagatcaagctgctgcccaagtgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172058 - DNA, 1665 bp, Artificial Sequence
  Description of Artificial Sequence: Synthetic coding sequence
atggccgaggccgccaccggcttcctggagcagctgaagagctgcatcgtgtggagctggacctacctgtggacagtgtggttcttcatcgtgctcttcctggtgtacatcctgcgggtgcccctgaagatcaatgacaacctgagcacagtgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggaaccccctgaacctcttcagaggagctgagtacaaccgctacacctgggtgacaggccgggagcccctgacctactatgacatgaacctgagcgcccaggaccaccagaccttcttcacctgtgacagcgaccacctgcggccagcagatgccatcatgcagaaggcctggagggagaggaacccccaggcccgcatctctgctgcccacgaggccctggagatcaatgaatgtgccacagcctacatcctgctggccgaggaggaggccaccaccatcgccgaggccgagaagctgttcaagcaggccctgaaggctggagatggctgctacagaagaagccagcagctgcagcaccacggcagccagtatgaggcccagcaccggcgggacaccaacgtgctggtgtacatcaagaggcggctggccatgtgtgcccggcggctgggccgcacccgggaggccgtgaagatgatgagggacctgatgaaggagttccccctgctgtccatgttcaacatccacgagaacctgctggaggccctgctggagctgcaggcctatgcagatgtgcaggccgtgctggccaagtatgatgacatcagcctgcccaagagcgccaccatctgctacacagctgccctgctgaaggcccgggctgtgtctgacaagttcagccctgaggccgccagcagaagaggcctgagcacagctgagatgaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctggcccactggaagagggtggagggcgccctgaacctgctgcactgcacctgggagggcaccttcaggatgatcccctaccccctggagaagggccacctgttctacccctaccccatctgcacagaaacagctgaccgggagctgctgcccagcttccacgaggtgtctgtgtaccccaagaaggagctgcccttcttcatcctcttcaccgctggcctgtgcagcttcaccgccatgctggccctgctgacccaccagtttcctgagctgatgggcgtgtttgccaaggccttcctgagcaccctgtttgcccccctgaactttgtgatggagaaggtggagagcatcctgcccagcagcctgtggcaccagctgacccgcatctag

SEQ ID NO: 172059 - DNA, 189 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagctag

SEQ ID NO: 172060 - DNA, 264 bp, Artificial Sequence
  Description of Artificial Sequence: Synthetic coding sequence
atgtccatgttcctgaacaccctgacccccaagttctacgtggccctgaccggcaccagcagcctcatcagcggcctcatcctgatctttgagtggtggtacttcagaaaatatggcaccagcttcatcgagcaggtgtctgtgagccacctgcggcccctgctgggcggcgtggacaacaacagcagcaacaacagcaacagcagcaatggagacagcgacagcaaccggcagagcgtgtctgagtgcaaggtgtggaggtag

SEQ ID NO: 172061 - DNA, 1323 bp, Artificial Sequence
  Description of Artificial Sequence: Synthetic coding sequence
atggctgaaaataatgaaaacatcagcaagaatgtggatgtgcggcccaagaccagccgcagccgctctgctgacaggaaggatggctacgtgtggagcggcaagaagctgtcctggagcaagaagtctgagagctacagtgatgctgagaccgtgaatggaattgagaagacagaggtgtccctgaggaaccaggagaggaagcacagctgcagcagcattgagctggacctggaccacagctgtggccaccgcttcctgggccgcagcctgaagcagaagctgcaggatgctgtgggccagtgcttccccatcaagaactgcagcagccgccacagcagcggcctgcccagcaagaggaagatccacatcagcgagctgatgctggacaagtgccccttccccccaagaagtgacctggccttccgctggcacttcatcaagaggcacacagcccccatcaacagcaagagtgatgagtgggtgtccacagacctgagccagacagagctgagagatggccagctgaagagaagaaacatggaggagaacatcaactgcttcagccacaccaacgtgcagccctgcgtcatcaccacagacaatgccctgtgccgggagggccccatgactggatctgtgatgaacctggtgagcaacaacagcattgaggacagcgacatggacagtgatgatgagatcctgaccctgtgcaccagcagcaggaagaggaacaagcccaagtgggacctggatgatgagatcctgcagctggagaccccacccaagtaccacacccagattgattatgtgcactgcctggtgcctgacctgctgcagatcaacaacaacccctgctactggggcgtgatggacaagtatgctgctgaggccctgctggagggcaagccagagggcaccttcctgctgcgggacagcgcccaggaggactacctgttctctgtgtccttccgccgctacagccgcagcctgcacgccagaattgagcagtggaaccacaacttctcctttgatgcccatgacccctgtgtgttccacagcccagacatcaccggcctgctggagcactacaaggaccccagcgcctgcatgttctttgagcccctgctgagcacccccctcatccgcaccttccccttcagcctgcagcacatctgcaggacagtcatctgcaactgcaccacctatgatggcattgatgccctgcccatccccagctccatgaagctgtacctgaaggagtaccactacaagagcaaggtgcgggtgctgagaattgatgcccctgagcagcagtgctag

SEQ ID NO: 172062 - DNA, 1323 bp, Artificial Sequence; identical to SEQ ID NO: 172061
  Description of Artificial Sequence: Synthetic coding sequence

SEQ ID NO: 172063 - DNA, 1323 bp, Artificial Sequence; identical to SEQ ID NO: 172061
  Description of Artificial Sequence: Synthetic coding sequence

SEQ ID NO: 172064 - DNA, 1611 bp, Artificial Sequence
  Description of Artificial Sequence: Synthetic coding sequence
atggacaaggtgggcaagatgtggaacaacttcaagtaccgctgccagaacctgtttggacatgaaggaggcagccgctcagaaaatgtggacatgaacagcaaccgctgcctgtctgtgaaggagaagaacatcagcattggagacagcaccccccagcagcagagcagccccctgagagaaaatattgccctgcagctgggcctgagccccagcaagaacagcagcagaagaaaccagaactgtgccacagagatcccccagatcgtggagatcagcattgagaaggacaatgacagctgtgtgaccccaggcacccggctggcccggcgggacagctacagcagacatgccccctggggcggcaagaagaagcacagctgcagcaccaagacccagagcagcctggatgctgacaagaagtttggccgcaccaggagcggcctgcagaggcgggagcggcgctatggagtgtcctctgtgcatgacatggacagcgtgagcagcaggacagtgggcagccgcagcctgcggcagaggctgcaggacacagtgggcctgtgcttccccatgaggacctacagcaagcagagcaagcccctcttcagcaacaagaggaagatccacctgtctgagctgatgctggagaagtgccccttccctgctggcagtgacctggcccagaagtggcacctgatcaagcagcacacagcccctgtgagcccccacagcaccttctttgacacctttgaccccagcctggtgtccacagaagatgaagaagatcggctgcgggagcggcggcggctgagcattgaggagggcgtggaccccccaccaaatgcccagatccacacctttgaggccacagcccaggtgaaccccctgtacaagctgggccccaagctggcccctggcatgacagagatcagcggggacagcagcgccatcccccaggccaactgtgacagcgaggaggacaccaccaccctgtgcctgcagagccggcggcagaagcagaggcagatcagcggggacagccacacccacgtgtcccggcagggcgcctggaaggtgcacacccagattgactacatccactgcctggtgcctgacctgctgcagatcactggaaacccctgctactggggcgtgatggacagatatgaagctgaggccctgctggagggcaagccagagggcaccttcctgctgcgggacagcgcccaggaggactacctgttctctgtgtccttccgccgctacaacagaagcctgcacgcccgcatcgagcagtggaaccacaacttctcctttgatgcccatgacccctgtgtgttccacagcagcacagtgacaggcctgctggagcactacaaggaccccagcagctgcatgttctttgagcccctgctgaccatcagcctgaacagaaccttccccttcagcctgcagtacatctgccgggccgtcatctgccgctgcaccacctatgatggcattgatggcctgcccctgcccagcatgctgcaggacttcctgaaggagtaccactacaagcagaaggtgcgggtgcgctggctggagcgggagcctgtgaaggccaagtag

SEQ ID NO: 172065 - DNA, 1611 bp, Artificial Sequence; identical to SEQ ID NO: 172064
  Description of Artificial Sequence: Synthetic coding sequence

SEQ ID NO: 172066 - DNA, 3264 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggaggagccagaagatgaggaggaggaggaggaggaggaggagtatgatgaggaggaggaggaggaggatgatgaccggccccccaagaagcccaggcatggaggcttcatcctggatgaagcagatgtggatgatgaatatgaagatgaggaccagtgggaggatggagctgaggacatcctggagaaggaggagattgaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172067 - DNA, 3198 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggatgatgaccggccccccaagaagcccaggcatggaggcttcatcctggatgaagcagatgtggatgatgaatatgaagatgaggaccagtgggaggatggagctgaggacatcctggagaaggaggagattgaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172068 - DNA, 3252 bp, Artificial Sequence
  Description of Artificial Sequence: Synthetic coding sequence
atgtctgacagcgaggacagcaacttcagcgaggaggaggacagcgagaggagcagtgatggagaggaggccgaggtggatgaggagcggcgctctgctgctggcagcgagaaggaggaggagccagaagatgaggaggaggaggaggaggaggaggagtatgatgaggaggaggaggaggaggatgatgaccggccccccaagaagcccaggcatggaggcttcatcctggatgaagcagatgtggatgatgaatatgaagatgaggaccagtgggaggatggagctgaggacatcctggagaaggccagcaacatcgacaacgtggtgctggatgaagatagaagtggggcccggcggctgcagaacctgtggagggaccagcgggaggaggagctgggggagtactacatgaagaagtatgccaagagctctgtgggggagaccgtgtatggaggcagtgatgagctgagtgatgacatcacccagcagcagctgctgcccggggtgaaggaccccaacctgtggacagtgaagtgcaagatcggggaggagcgggccacagccatcagcctgatgaggaagttcatcgcctaccagttcacagacacccccctgcagatcaagtctgtggtggcccctgagcacgtgaagggctacatctacgtggaggcctacaagcagacccacgtgaagcaggccattgaaggagtgggcaacctgcggctgggctactggaaccagcagatggtgcccatcaaggagatgacagatgtgctgaaggtggtgaaggaggtggccaacctgaagcccaagtcctgggtgcggctgaagaggggcatctacaaggatgacatcgcccaggtggactatgtggagcccagccagaacaccatcagcctgaagatgatccccagaattgattatgaccgcatcaaggccaggatgagcctgaaggactggtttgccaagaggaagaagttcaagaggcctccccagaggctgtttgatgctgagaagatccgcagcctgggcggagatgtggccagtgatggagacttcctgatctttgagggcaaccgctacagcaggaagggcttcctgttcaagagctttgccatgtctgctgtgatcacagaaggagtgaagcccaccctgtctgagctggagaagtttgaggaccagcctgagggcatcgacctggaggtggtgacagagagcacaggcaaggagcgggagcacaacttccagcccggggacaacgtggaggtgtgtgagggggagctgatcaacctgcagggcaagatcctgtctgtggatggcaacaagatcaccatcatgcccaagcatgaggacctgaaggacatgctggagttccctgcccaggagctgaggaagtacttcaagatgggagaccacgtgaaggtgattgctggccgctttgaaggagacaccggcctcatcgtgcgggtggaggagaactttgtgatcctcttcagtgacctgaccatgcatgagctgaaggtgctgccccgggacctgcagctgtgcagcgagacagccagcggcgtggatgtgggcggccagcacgagtggggcgagctggtgcagctggacccccagacagtgggcgtcatcgtgcggctggagcgggagaccttccaggtgctgaacatgtatggcaaggtggtgacagtgcgccaccaggccgtgaccaggaagaaggacaacagatttgctgtggccctggacagcgagcagaacaacatccacgtgaaggacatcgtgaaggtgattgatggcccccacagcggccgggagggggagatccgccacctgttccgcagctttgccttcctgcactgcaagaagctggtggagaatggaggcatgtttgtgtgcaagaccaggcacctggtgctggccggcggcagcaagcccagagatgtgaccaacttcaccgtgggcggctttgcccccatgagcccccgcatcagcagccccatgcaccccagcgctgggggccagaggggcggcttcggcagccctgggggcggcagcggcggcatgagccggggccggggccggcgggacaatgaactcatcggccagacagtgcgcatcagccagggcccctacaagggctacatcggcgtggtgaaggatgccacagagagcacagcccgggtggagctgcacagcacctgccagaccatctctgtggaccggcagaggctgaccaccgtgggcagccggcggcctgggggcatgaccagcacctacggccgcacccccatgtatggcagccagacccccatgtatggcagcggcagcaggacccccatgtatggcagccagacccccctgcaggacggcagcaggaccccccactacggcagccagacccccctgcatgatggcagcaggaccccagcccagagcggggcctgggaccccaacaaccccaacacccccagcagagctgaggaggagtatgaatatgcctttgatgatgagcccacccccagcccccaggcctatggaggcacccccaacccccagaccccaggctacccagaccccagcagcccccaggtgaacccccagtacaacccccagaccccaggcaccccagccatgtacaacacagaccagttcagcccctatgctgcccccagcccccagggcagctaccagcccagccccagcccccagagctaccaccaggtggcccccagccctgctggctaccagaacacccacagccctgccagctaccaccccacccccagccccatggcctaccaggccagccccagccccagccctgtgggctacagccccatgacccctggggcccccagccctgggggctacaacccccacaccccaggcagcggcatcgagcagaacagcagtgactgggtgaccacagacatccaggtgaaggtgcgggacacctacctggacacccaggtggtgggccagacaggagtcatccgctctgtgactggaggcatgtgcagcgtgtacctgaaggacagcgagaaggtggtgtccatcagcagcgagcacctggagcccatcacccccaccaagaacaacaaggtgaaggtgatcctgggagaagatcgggaggccaccggggtgctgctgagcattgatggagaagatggcatcgtgaggatggacctggatgagcagctgaagatcctgaacctgcgcttcctgggcaagctgctggaggcctag

SEQ ID NO: 172069 - DNA, 3264 bp, Artificial Sequence; identical to SEQ ID NO: 172066
  Description of Artificial Sequence: Synthetic coding sequence

SEQ ID NO: 172070 - DNA, 3264 bp, Artificial Sequence; identical to SEQ ID NO: 172066
  Description of Artificial Sequence: Synthetic coding sequence

SEQ ID NO: 172071 - DNA, 3264 bp, Artificial Sequence; identical to SEQ ID NO: 172066
  Description of Artificial Sequence: Synthetic coding sequence

SEQ ID NO: 172072 - DNA, 5181 bp, Artificial Sequence
  Description of Artificial Sequence: Synthetic coding sequence
atgtctgactttgtggagagcgaggccgaggagagcgaggaggagtacaatgatgaaggagaggtggtgccccgggtgaccaagaagtttgtggaggaggaggatgatgatgaggaggaggaggaggagaacctggatgaccaggatgagcagggcaacctgaagggcttcatcaatgatgatgatgatgaagatgaaggagaagaagatgagggcagtgacagcggggacagtgaagatgatgtgggccacaagaagaggaagaggaccagctttgatgaccggctggaggatgatgactttgacctgattgaggagaacctgggcgtgaaggtgaagaggggccagaagtacagaagagtgaagaagatgtctgatgatgaagatgatgatgaggaggagtatggcaaggaggagcacgagaaggaggccatcgccgaggagatcttccaggatggagagggggaggagggccaggaggccatggaggcccccatggcccctcctgaggaggaggaggaggatgatgaggagagtgacattgatgacttcatcgtggatgatgatggccagcccctgaagaagcccaagtggaggaagaagctgcccggctacacagatgctgccctgcaggaggcccaggagatctttggagtggactttgattatgatgaatttgagaagtacaatgaatatgatgaggagctggaggaggagtatgaatatgaagatgatgaagctgagggggagatccgggtgcggcccaagaagaccaccaagaagagggtgtccagaagaagcatctttgagatgtatgagcccagcgagctggagagcagccacctgacagaccaggacaatgagatccgggccacagacctgcctgagcgcttccagctgcggagcatccctgtgaagggagcagaagatgatgagctggaggaggaggccgactggatctacagaaatgcctttgccacccccaccatcagcctgcaggagagctgtgactacctggaccggggccagcctgccagcagcttcagcaggaagggccccagcaccatccagaagatcaaggaggccctgggcttcatgaggaaccagcactttgaggtgcccttcatcgccttctacaggaaggagtatgtggagcctgagctgcacatcaatgacctgtggagggtgtggcagtgggatgagaagtggacccagctgcgcatcagaaaagaaaacctgacccggctgtttgagaagatgcaggcctaccagtatgagcagatctctgctgaccctgacaagcccctggctgatggcatccgggccctggacaccacagacatggagcggctgaaggatgtgcagagcatggatgagctgaaggatgtgtacaaccacttcctgctgtactacggccgggacatccccaagatgcagaatgctgccaaggccagcaggaagaagctgaagagggtgcgggaggagggagatgaggagggggagggagatgaagcagaagatgaggagcagaggggccctgagctgaagcaggccagccggcgggacatgtacaccatctgccagagcgctggcctggatggcctggccaagaagtttggcctgaccccagagcagtttggagagaacctgcgggacagctaccagagacatgaaacagagcagtttcctgctgagcccctggagctggccaaggactatgtgtgcagccagttccccaccccagaggccgtgctggagggcgcccgctacatggtggccctgcagatcgcccgggagcccctggtgcggcaggtgctgcggcagaccttccaggagcgggccaagctgaacatcacccccaccaagaagggcaggaaggatgtggatgaggcccactacgcctacagcttcaagtacctgaagaacaagcctgtgaaggagctgagagatgaccagttcctgaagatctgcctggccgaggatgagggcctgctgaccacagacatcagcattgacctgaagggcgtggagggctatggaaatgaccagacctactttgaggagatcaagcagttctactacagagatgagttcagccaccaggtgcaggagtggaaccggcagaggaccatggccatcgagcgggccctgcagcagttcctgtatgtgcagatggccaaggagctgaagaacaagctgctggccgaggccaaggagtatgtgatcaaggcctgcagcaggaagctgtacaactggctgcgggtggccccctacagaccagaccagcaggtggaggaggatgatgacttcatggatgagaaccagggcaagggcatccgggtgctgggcatcgccttcagcagcgcccgggaccaccctgtgttctgtgccctggtgaatggagagggggaggtgacagacttcctgcggctgccccacttcaccaagagaagaacagcctggagggaggaggagcgggagaagaaggcccaggacatcgagaccctgaagaagttcctgctgaacaagaagccccacgtggtgacagtggccggagaaaatagagatgcccagatgctgattgaagatgtgaagagaattgtgcatgagctggaccagggccagcagctgagcagcattggagtggagctggtggacaatgagctggccatcctgtacatgaacagcaagaagtctgaggccgagttccgggactacccacctgtgctgcggcaggccgtgtccctggcccggcgcatccaggaccccctgattgaatttgcccaggtgtgcagcagtgatgaggacatcctgtgcctgaagttccaccccctgcaggagcacgtggtgaaggaggagctgctgaatgccctgtactgtgagttcatcaacagagtgaatgaggtgggcgtggatgtgaacagagccatcgcccacccctacagccaggccctgatccagtatgtgtgtggcctgggccccaggaagggcacccacctgctgaagatcctgaagcagaacaacacccggctggagagcaggacccagctggtgaccatgtgccacatgggccccaaggtgttcatgaactgtgccggcttcctgaagattgacacagccagcctgggggacagcacagacagctacatcgaggtgctggatggcagccgggtgcaccctgagacctatgagtgggccaggaagatggctgtggatgccctggagtatgatgaatctgcagaagatgccaacccagctggggccctggaggagatcctggagaaccctgagcggctgaaggacctggacctggatgcctttgctgaggagctggagcggcagggctacggggacaagcacatcaccctgtatgacatccgggcagagctgagctgccgctacaaggacctgaggacagcctaccgcagccccaacacagaggagatcttcaacatgctgaccaaggagaccccagagaccttctacatcggcaagctgatcatctgcaatgtgacaggcatcgcccacagaagaccccagggcgagagctatgaccaggccatcagaaatgatgaaacaggcctgtggcagtgccccttctgccagcaggacaacttccctgagctgtctgaggtgtggaaccactttgacagcggcagctgccccggccaggccatcggcgtgaagacccggctggacaacggggtgacaggcttcatccccaccaagttcctgagtgacaaggtggtgaagaggcctgaggagcgggtgaaggtgggcatgacagtgcactgccgcatcatgaagattgacatcgagaagttctctgctgacctgacctgcaggaccagtgacctgatggacagaaataatgagtggaagctgcccaaggacacctactatgactttgatgctgaggccgctgaccacaagcaggaggaggacatgaagaggaagcagcagaggaccacctacatcaagagggtcatcgcccaccccagcttccacaacatcaacttcaagcaggccgagaagatgatggagaccatggaccagggagatgtgatcatccggcccagcagcaagggggagaaccacctgactgtgacctggaaggtgtctgatggcatctaccagcacgtggatgtgcgggaggagggcaaggaaaatgccttcagcctgggcgccaccctgtggatcaacagcgaggagtttgaggacctggatgaaattgtggcccgctacgtgcagcccatggccagctttgcccgggacctgctgaaccacaagtactaccaggactgcagcggcggggacaggaagaagctggaggagctgctgatcaagaccaagaaggagaagcccaccttcatcccctacttcatctgtgcctgcaaggagctgcccgggaagttcctgctgggctaccagccccggggcaagccccgcatcgagtatgtgacagtgaccccagagggcttccgctaccggggccagatcttccccaccgtgaatggcctcttccgctggttcaaggaccactaccaggaccctgtgcccggcatcacccccagcagcagcagcaggaccaggaccccagccagcatcaatgccaccccagccaacatcaacctggccgacctgaccagggctgtgaatgccctgccccagaacatgaccagccagatgttttctgccatcgctgctgtgacaggccagggccagaaccccaatgccaccccagcccagtgggccagcagccagtatggctatggaggcagcggcggcggcagcagcgcctaccacgtgttccccaccccagcccagcagcctgtggccacccccctgatgacccccagctacagctacaccacccccagccagcccatcaccaccccccagtaccaccagctgcaggccagcaccaccccccagagcgcccaggcccagccccagcccagcagcagcagccggcagaggcagcagcagcccaagagcaacagccacgccgccatcgactggggcaagatggccgagcagtggctgcaggagaaggaggccgagaggaggaagcagaagcagaggctgaccccccggcccagccccagccccatgattgagagcacccccatgagcattgctggagatgccacccccctgctggatgagatggacagatag

SEQ ID NO: 172073 - DNA, 2181 bp, Artificial Sequence
  Description of Artificial Sequence: Synthetic coding sequence
atgtctgactttgtggagagcgaggccgaggagagcgaggaggagtacaatgatgaaggagaggtggtgccccgggtgaccaagaagtttgtggaggaggaggatgatgatgaggaggaggaggaggagaacctggatgaccaggatgagcagggcaacctgaagggcttcatcaatgatgatgatgatgaagatgaaggagaagaagatgagggcagtgacagcggggacagtgaagatgatgtgggccacaagaagaggaagaggaccagctttgatgaccggctggaggatgatgactttgacctgattgaggagaacctgggcgtgaaggtgaagaggggccagaagtacagaagagtgaagaagatgtctgatgatgaagatgatgatgaggaggagtatggcaaggaggagcacgagaaggaggccatcgccgaggagatcttccaggatggagagggggaggagggccaggaggccatggaggcccccatggcccctcctgaggaggaggaggaggatgatgaggagagtgacattgatgacttcatcgtggatgatgatggccagcccctgaagaagcccaagtggaggaagaagctgcccggctacacagatgctgccctgcaggaggcccaggagatctttggagtggactttgattatgatgaatttgagaagtacaatgaatatgatgaggagctggaggaggagtatgaatatgaagatgatgaagctgagggggagatccgggtgcggcccaagaagaccaccaagaagagggtgtccagaagaagcatctttgagatgtatgagcccagcgagctggagagcagccacctgacagaccaggacaatgagatccgggccacagacctgcctgagcgcttccagctgcggagcatccctgtgaagggagcagaagatgatgagctggaggaggaggccgactggatctacagaaatgcctttgccacccccaccatcagcctgcaggagagctgtgactacctggaccggggccagcctgccagcagcttcagcaggaagggccccagcaccatccagaagatcaaggaggccctgggcttcatgaggaaccagcactttgaggtgcccttcatcgccttctacaggaaggagtatgtggagcctgagctgcacatcaatgacctgtggagggtgtggcagtgggatgagaagtggacccagctgcgcatcagaaaagaaaacctgacccggctgtttgagaagatgcaggcctaccagtatgagcagatctctgctgaccctgacaagcccctggctgatggcatccgggccctggacaccacagacatggagcggctgaaggatgtgcagagcatggatgagctgaaggatgtgtacaaccacttcctgctgtactacggccgggacatccccaagatgcagaatgctgccaaggccagcaggaagaagctgaagagggtgcgggaggagggagatgaggagggggagggagatgaagcagaagatgaggagcagaggggccctgagctgaagcaggccagccggcgggacatgtacaccatctgccagagcgctggcctggatggcctggccaagaagtttggcctgaccccagagcagtttggagagaacctgcgggacagctaccagagacatgaaacagagcagtttcctgctgagcccctggagctggccaaggactatgtgtgcagccagttccccaccccagaggccgtgctggagggcgcccgctacatggtggccctgcagatcgcccgggagcccctggtgcggcaggtgctgcggcagaccttccaggagcgggccaagctgatgacccccagctacagctacaccacccccagccagcccatcaccaccccccagtaccaccagctgcaggccagcaccaccccccagagcgcccaggcccagccccagcccagcagcagcagccggcagaggcagcagcagcccaagagcaacagccacgccgccatcgactggggcaagatggccgagcagtggctgcaggagaaggaggccgagaggaggaagcagaagcagaggctgaccccccggcccagccccagccccatgattgagagcacccccatgagcattgctggagatgccacccccctgctggatgagatggacagatag

SEQ ID NO: 172074 - DNA, 2361 bp, Artificial Sequence
  Description of Artificial Sequence: Synthetic coding sequence
atgtccttcagccgggccctgctgtgggcccggctgcctgctggccggcaggccggccaccgggccgccatctgcagcgccctgcggccccacttcggccccttccctggggtgctgggccaggtgtctgtgctggccacagccagcagcagcgccagcggcggcagcaagatccccaacaccagcctgtttgtgcccctgactgtgaagccccagggccccagcgcagatggagatgtgggcgctgagctgacccggcccctggacaagaatgaggtgaagaaggtgctggacaagttctacaagaggaaggagatccagaagctgggcgctgactatggcctggatgcccggctcttccaccaggccttcatctccttcaggaactacatcatgcagagccacagcctggatgtggacatccacatcgtgctgaatgacatctgcttcggggccgcccatgctgatgacctcttccccttcttcctgcggcatgccaagcagatcttccctgtgctggactgcaaggatgacctgaggaagatcagtgacctgcgcatcccccccaactggtacccagatgcccgggccatgcagaggaagatcatcttccacagcggccccaccaacagcggcaagacctaccacgccatccagaagtacttcagcgccaagagcggcgtgtactgcggccccctgaagctgctggcccacgagatctttgagaagagcaatgctgctggggtgccctgtgacctggtgactggagaggagcgggtgacagtgcagcccaacgggaagcaggccagccacgtgtcctgcaccgtggagatgtgcagcgtgaccaccccctatgaggtggccgtgattgatgagatccagatgatccgggaccctgcccggggctgggcctggacccgggccctgctgggcctgtgtgccgaggaggtgcacctgtgtggggagcctgctgccatcgacctggtgatggagctgatgtacaccaccggggaggaggtggaggtgcgggactacaagaggctgacccccatctctgtgctggaccacgccctggagagcctggacaacctgcggcctggggactgcatcgtgtgcttcagcaagaatgacatctacagcgtgtcccggcagatcgagatccggggcctggagagcgctgtgatctacggcagcctgcccccaggcaccaagctggcccaggccaagaagttcaatgaccccaatgacccctgcaagatcctggtggccacagatgccatcggcatgggcctgaacctgagcatccgccgcatcatcttctacagcctcatcaagcccagcatcaatgaaaaaggagagcgggagctggagcccatcaccaccagccaggccctgcagattgctggccgggccggccgcttcagcagccgcttcaaggagggggaggtgaccaccatgaaccacgaggacctgagcctgctgaaggagatcctgaagaggcctgtggaccccatccgggccgccggcctgcaccccacagctgagcagatcgagatgtttgcctaccacctgcctgatgccaccctgagcaacctgattgacatctttgtggacttcagccaggtggatggccagtactttgtgtgcaacatggatgacttcaagttctctgctgagctgatccagcacatccccctgagcctgcgggtgcgctacgtgttctgcacagcccccatcaacaagaagcagccctttgtgtgcagcagcctgctgcagtttgcccggcagtacagcagaaatgagcccctgacctttgcctggctgcggcgctacatcaagtggcccctgctgccccccaagaacatcaaggacctgatggacctggaggccgtgcatgatgtgctggacctgtacctgtggctgagctaccgcttcatggacatgtttcctgatgccagcctcatccgggacctgcagaaggagctggatggcatcatccaggatggagtgcacaacatcaccaagctgatcaagatgtctgagacccacaagctgctgaacctggagggcttccccagcggcagccagagccggctgagcggcaccctgaagagccaggcccggaggacccggggcaccaaggccctgggcagcaaggccacagagccccccagcccagatgctggggagctgagcctggccagccggctggtgcagcagggcctgctgaccccagacatgctgaagcagctggagaaggagtggatgacccagcagacagagcacaacaaggagaagacagaaagtggcacccaccccaagggcaccaggaggaagaagaaggagccagacagcgactag

SEQ ID NO: 172075 - DNA, 792 bp, Artificial Sequence
  Description of Artificial Sequence: Synthetic coding sequence
atgtccttcagccgggccctgctgtgggcccggctgcctgctggccggcaggccggccaccgggccgccatctgcagcgccctgcggccccacttcggccccttccctggggtgctgggccaggtgtctgtgctggccacagccagcagcagcgccagcggcggcagcaagatccccaacaccagcctgtttgtgcccctgactgtgaagccccagggccccagcgcagatggagatgtgggcgctgagctgacccggcccctggacaagaatgaggtggccgtgattgatgagatccagatgatccgggaccctgcccggggctgggcctggacccgggccctgctgggcctgtgtgccgaggaggtgcacctgtgtggggagcctgctgccatcgacctggtgatggagctgatgtacaccaccggggaggaggtggaggtgcgggactacaagaggctgacccccatctctgtgctggaccacgccctggagagcctggacaacctgcggcctggggactgcatcgtgtgcttcagcaagaatgacatctacagcgtgtcccggcagatcgagatccggggcctggagagcgctgtgatctacggcagcctgcccccaggcaccaagctggcccaggccaagaagttcaatgaccccaatgacccctgcaagatcctggtggccacagatgccatcggcatgggcctgaacctgagcatccgccgcatcatcttctacagcctcatcaagcccagcatcaatgaaaaaggagagcgggagctggagtag

SEQ ID NO: 172076 - DNA, 1233 bp, Artificial Sequence
  Description of Artificial Sequence: Synthetic coding sequence
atggctgctgtgggcgctgaggcccggggggcctggtgtgtgccctgcctggtgtccctggacaccctgcaggagctgtgcaggaaggagaagctgacctgcaagagcatcggcatcaccaagaggaacctgaacaactatgaggtggagtacctgtgtgactacaaggtggtgaaggacatggagtactacctggtgaagtggaagggctggccagacagcaccaacacctgggagcccctgcagaacctgaagtgccccctgctgctgcagcagttcagcaatgacaagcacaactacctgagccaggtgaagaagggcaaggccatcacccccaaggacaacaacaagaccctgaagccagccatcgccgagtacatcgtgaagaaggccaagcagagaattgccctgcagcgctggcaggatgagctgaacagaaggaagaaccacaagggcatgatctttgtggagaacacagtggacctggagggccccccaagtgacttctactacatcaatgagtacaagccagcccctggcatcagcctggtgaatgaggccaccttcggctgcagctgcacagactgcttcttccagaagtgctgcccagctgaggccggcgtgctgctggcctacaacaagaaccagcagatcaagatccccccaggcacccccatctatgagtgcaacagccgctgccagtgtggccctgactgccccaacagaattgtgcagaagggcacccagtacagcctgtgcatcttccgcaccagcaatggccggggctggggcgtgaagaccctggtgaagatcaagaggatgagctttgtgatggagtatgtgggggaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172077 - DNA, 693 bp, Artificial Sequence
  Description of Artificial Sequence: Synthetic coding sequence
atggctgctgtgggcgctgaggcccggggggcctggtgtgtgccctgcctggtgtccctggacaccctgcaggagctgtgcaggaaggagaagctgacctgcaagagcatcggcatcaccaagaggaacctgaacaactatgaggtggagtacctgtgtgactacaaggtggtgaaggacatggagtactacctggtgaagtggaagggctggccagacagcaccaacacctgggagcccctgcagaacctgaagtgccccctgctgctgcagcagttcagcaatgacaagcacaactacctgagccaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172078 - DNA, 459 bp, Artificial Sequence
  Description of Artificial Sequence: Synthetic coding sequence
atggagtactacctggtgaagtggaagggctggccagacagcaccaacacctgggagcccctgcagaacctgaagtgccccctgctgctgcagcagttcagcaatgacaagcacaactacctgagccaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagtag

SEQ ID NO: 172079 - DNA, 1053 bp, Artificial Sequence
  Description of Artificial Sequence: Synthetic coding sequence
atggagtactacctggtgaagtggaagggctggccagacagcaccaacacctgggagcccctgcagaacctgaagtgccccctgctgctgcagcagttcagcaatgacaagcacaactacctgagccaggtgaagaagggcaaggccatcacccccaaggacaacaacaagaccctgaagccagccatcgccgagtacatcgtgaagaaggccaagcagagaattgccctgcagcgctggcaggatgagctgaacagaaggaagaaccacaagggcatgatctttgtggagaacacagtggacctggagggccccccaagtgacttctactacatcaatgagtacaagccagcccctggcatcagcctggtgaatgaggccaccttcggctgcagctgcacagactgcttcttccagaagtgctgcccagctgaggccggcgtgctgctggcctacaacaagaaccagcagatcaagatccccccaggcacccccatctatgagtgcaacagccgctgccagtgtggccctgactgccccaacagaattgtgcagaagggcacccagtacagcctgtgcatcttccgcaccagcaatggccggggctggggcgtgaagaccctggtgaagatcaagaggatgagctttgtgatggagtatgtgggggaggtgatcaccagcgaggaggccgagcggcggggccagttctatgacaacaagggcatcacctacctgtttgacctggactatgaaagtgatgagttcaccgtggatgctgcccgctatggaaatgtgagccactttgtgaaccacagctgtgaccccaacctgcaggtgttcaacgtgttcatcgacaacctggacacccggctgccccgcatcgccctcttcagcaccaggaccatcaatgctggggaggagctgacctttgactaccagatgaagggcagcggggacatcagcagtgacagcattgaccacagccctgccaagaagagggtgaggacagtgtgcaagtgtggggctgtgacctgccggggctacctgaactag

SEQ ID NO: 172080 - DNA, 2658 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagcttcagccacaacaaccctgtgcgcttccggcccatcaagggccggcaggaggagctgaaggaggtgattgagcgcttcaagaaggatgagcacctggagaaggccttcaagtgcctgaccagcggggagtgggcccggcactacttcctgaacaagaacaagatgcaggagaagctgttcaaggagcacgtgttcatctacctgaggatgtttgccacagattctggctttgagatcctgccctgcaaccgctacagcagcgagcagaatggagccaagatcgtggccaccaaggagtggaagagaaatgacaagattgagctgctggtgggctgcatcgccgagctgtctgaaattgaggagaacatgctgctgcggcatggagaaaatgacttctctgtgatgtacagcaccaggaagaactgtgcccagctgtggctgggccctgctgccttcatcaaccacgactgccggcccaactgcaagtttgtgtccacaggccgggacacagcctgtgtgaaggccctgcgggacatcgagcctggagaggagatcagctgctactatggagatggcttcttcggggagaacaatgagttctgtgagtgctacacctgtgagcggcggggcactggagccttcaagagccgggtgggcctgcctgccccagcccctgtgatcaacagcaaatatggcctgcgggagacagacaagaggctgaaccggctgaagaagctgggggacagcagcaagaacagcgacagccagagcgtgagcagcaacacagatgctgacaccacccaggagaagaacaatgccaccagcaacaggaagagctctgtgggcgtgaagaagaacagcaagagcaggaccctgacccggcagagcatgagccgcatcccagccagcagcaacagcaccagcagcaagctgacccacatcaacaacagccgggtgcccaagaagctgaagaagccagccaagcccctgctgagcaagatcaagctgaggaaccactgcaagaggctggagcagaagaatgccagcaggaagctggagatgggcaacctggtgctgaaggagcccaaggtggtgctgtacaagaacctgcccatcaagaaggacaaggagcctgagggccctgcccaggccgctgtggccagcggctgcctgaccaggcatgctgcccgggagcaccggcagaaccctgtgcggggggcccacagccagggcgagagcagcccctgcacctacatcaccaggagatctgtgaggaccaggaccaacctgaaggaggccagtgacatcaagctggagcccaacaccctgaatggctacaagagctctgtgacagagccctgcccagattctggagagcagctgcagcctgcccctgtgctgcaggaggaggagctggcccacgagacagcccagaagggggaggccaagtgccacaagagtgacaccggcatgagcaagaagaagagccggcagggcaagctggtgaagcagtttgccaagattgaggagagcacccctgtgcatgacagccctgggaaggatgatgctgtgcctgacctgatgggcccccacagcgaccagggcgagcacagcggcaccgtgggcgtgcctgtgtcctacacagactgtgcccccagccctgtgggctgcagcgtggtgaccagtgacagcttcaagaccaaggacagcttcagaacagccaagagcaagaagaagaggcgcatcaccaggtatgatgcccagctgatcctggagaacaacagcggcatccccaagctgaccctgcggaggagacatgacagcagcagcaagaccaatgaccaggagaatgatggcatgaacagcagcaagatcagcatcaagctgagcaaggaccatgacaatgacaacaacctgtatgtggccaagctgaacaacggcttcaacagcggcagcggcagcagcagcaccaagctgaagatccagctgaagagagatgaggagaacagaggcagctacacagagggcctgcatgaaaatggagtgtgctgcagcgaccccctgagcctgctggagagcaggatggaggtggatgactacagccagtatgaggaggagagcacagatgacagcagcagcagtgaaggagatgaggaggaggatgattatgatgatgactttgaagatgacttcatccccctgcccccagccaagaggctgcggctgattgtgggcaaggacagcattgatattgacatcagcagcagaagaagagaggaccagagcctgcggctgaatgcctag

SEQ ID NO: 172081 - DNA, 1182 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagcttcagccacaacaaccctgtgcgcttccggcccatcaagggccggcaggaggagctgaaggaggtgattgagcgcttcaagaaggatgagcacctggagaaggccttcaagtgcctgaccagcggggagtgggcccggcactacttcctgaacaagaacaagatgcaggagaagctgttcaaggagcacgtgttcatctacctgaggatgtttgccacagattctggctttgagatcctgccctgcaaccgctacagcagcgagcagaatggagccaagatcgtggccaccaaggagtggaagagaaatgacaagattgagctgctggtgggctgcatcgccgagctgtctgaaattgaggagaacatgctgctgcggcatggagaaaatgacttctctgtgatgtacagcaccaggaagaactgtgcccagctgtggctgggccctgctgccttcatcaaccacgactgccggcccaactgcaagtttgtgtccacaggccgggacacagcctgtgtgaaggccctgcgggacatcgagcctggagaggagatcagctgctactatggagatggcttcttcggggagaacaatgagttctgtgagtgctacacctgtgagcggcggggcactggagccttcaagagccgggtgggcctgcctgccccagcccctgtgatcaacagcaaatatggcctgcgggagacagacaagaggctgaaccggctgaagaagctgggggacagcagcaagaacagcgacagccagagcgtgagcagcaacacagatgctgacaccacccaggagaagaacaatgccagcaagtag

SEQ ID NO: 172082 - DNA, 1182 bp, Artificial Sequence; identical to SEQ ID NO: 172081
  Description of Artificial Sequence: Synthetic coding sequence

SEQ ID NO: 172083 - DNA, 357 bp, Artificial Sequence
  Description of Artificial Sequence: Synthetic coding sequence
atgaagtggctgggggagagcaagatcatggtggtgaatggaagaagaaatggaggcaagctgagcaatgaccaccagcagaaccagagcaagctgcagcacacaggcaaggacaccctgaaggccggcaagaatgctgtggagaggaggagcaaccgctgcaatggaaacagcggctttgagggccagagccgctacgtgcccagcagcggcatgtctgccaaggagctgtgtgaaaatgatgacctggccaccagcctggtgctggacccctacctgggcttccagacccacaagatgaacaccagcgccttccccagccgcagcagccgccacttcagcaagagtgacagctag

SEQ ID NO: 172084 - DNA, 1389 bp, Artificial Sequence
  Description of Artificial Sequence: Synthetic coding sequence
atgggccctgacagagtgacagcccgggagctgtgtgaaaatgatgacctggccaccagcctggtgctggacccctacctgggcttccgcacccacaagatgaatgtgtcccctgtgccccccctgcggcggcagcagcacctgcggagcgccctggagaccttcctgcggcagagggacctggaggccgcctaccgggccctgaccctgggcggctggacagcccgctacttccagagccggggcccccggcaggaggccgccctgaagacccacgtgtaccgctacctgcgggccttcctgcctgagagcggcttcaccatcctgccctgcacccgctacagcatggagaccaatggagccaagatcgtgtccacccgggcctggaagaagaatgagaagctggagctgctggtgggctgcatcgccgagctgcgggaggctgatgagggcctgctgcgggctggagaaaatgacttcagcatcatgtacagcaccaggaagaggtctgcccagctgtggctgggccctgctgccttcatcaaccacgactgcaagcccaactgcaagtttgtgcctgcagatggaaatgctgcctgtgtgaaggtgctgcgggacatcgagcctggagatgaggtgacctgcttctatggagagggcttcttcggggagaagaatgagcactgtgagtgccacacctgtgagaggaaaggagagggcgccttccgcacccggccccgggagcccgccctgcccccccggcccctggacaagtaccagctgcgggagaccaagaggcggctgcagcagggcctggacagcggcagccggcagggcctgctgggcccccgggcctgtgtgcaccccagccccctgcggcgggaccccttctgtgccgcctgccagcccctgcggctgcctgcctgcagcgcccggccagacaccagccccctgtggctgcagtggctgccccagccccagccccgggtgcggcccaggaagagaagaagaccccggccccggcgggcccctgtgctgagcacccaccacgccgcccgggtgtccctgcaccgctggggcggctgcggcccccactgccgcctgcggggggaggccctggtggccctgggccagccccctcatgcccgctgggccccccagcaggactggcactgggcccggcgctatggcctgccctacgtggtgcgggtggacctgcggcggctggccccagcccccccagccaccccagccccagctggcaccccaggccccatcctgatccccaagcaggccctggcctttgcccccttcagcccccccaagaggctgcggctggtggtgagccacggcagcattgacctggatgtgggcggggaggagctgtag

SEQ ID NO: 172085 - DNA, 390 bp, Artificial Sequence
  Description of Artificial Sequence: Synthetic coding sequence
atgccccggcggggccgctggctgagctgcagccctgaggccgagggcatccggcgggtgggcagccgggccgccctgcgggtgcaccccctggagcaccggccccgctggggcacccctgggggcatgaccaagggcagccgcttcctggcccctgagagcgagctgtcctggggccctggagatgccaccccaggcctgtggttcttcatcagtgatggagtgggggaggacctgtggaacagcgctggctggagctctgtgcctgagggcttcggccagaggatgaggggccctggcctgaccccccacacagatgctggaggagatggcaacaagaggaggcacagcgagcggctgtgccgggcctctgtgctgcagcccccatag

SEQ ID NO: 172086 - DNA, 744 bp, Artificial Sequence
  Description of Artificial Sequence: Synthetic coding sequence
atgcacctggcccggctggtgggcagctgcagcctgctgctgctgctgggcgccctgagcggctgggccgccagtgatgaccccatcgagaaggtgattgagggcatcaacagaggcctgagcaatgctgagcgggaggtgggcaaggccctggatggcatcaacagcggcatcacccatgctggccgggaggtggagaaggtgttcaacggcctgagcaacatgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccaggccggcaaggaggccgacaaggctgtgcagggcttccacactggagtgcaccaggccggcaaggaggccgagaagctgggccagggcgtgaaccacgccgctgaccaggccggcaaggaggtggagaagctgggccagggcgcccaccacgccgccggccaggccggcaaggagctgcagaatgcccacaatggagtgaaccaggccagcaaggaggccaaccagctgctgaatggaaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172087 - DNA, 1773 bp, Artificial Sequence
  Description of Artificial Sequence: Synthetic coding sequence
atgcacctggcccggctggtgggcagctgcagcctgctgctgctgctgggcgccctgagcggctgggccgccagtgatgaccccatcgagaaggtgattgagggcatcaacagaggcctgagcaatgctgagcgggaggtgggcaaggccctggatggcatcaacagcggcatcacccatgctggccgggaggtggagaaggtgttcaacggcctgagcaacatgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccaggtgggcaaggaggccgacaagctgatccaccacggcgtgcaccacggggccaaccaggccggcagcgaggccggcaagtttggccagggcgtggacaatgctgctggccaggccggaaatgaagctggccgcttcggccagggcgtgcaccacgccgccggccaggccggaaatgaagctggccgcttcggccagggcgtgcaccacgccgccggccaggccggaaatgaagctggccgcttcggccagggcgcccaccacggcctgtctgagggctggaaggagacagagaagtttggccagggcatccaccacgccgccggccaggtgggcaaggaggccgagaagtttggccagggcgcccaccacgccgccggccaggccggaaatgaagctggccgcttcggccagggcgtgcaccacggcctgtctgagggctggaaggagacagagaagtttggccagggcgtgcaccacacagctggccaggtgggcaaggaggccgagaagtttggccagggcgcccaccacgccgccggccaggccggaaatgaagctggccgcttcggccagggcgcccaccacgccgccggccaggccggaaatgaagctggccgcttcggccagggcgtgcaccacggcctgtctgagggctggaaggagacagagaagtttggccagggcgtgcaccacgccgccagccagtttgggaaggagacagagaagctgggccacggcgtgcaccacggcgtgaatgaggcctggaaggaggccgagaagtttggccagggcgtgcaccacgccgccagccaggtgggcaaggaggaggacagagtggtgcagggcctgcaccacggcgtgtcccaggccggccgggaggccggccagtttggacatgacatccaccacacagctggccaggccggcaaggagggggacattgctgtgcacggcgtgcagcccggggtgcatgaagctgggaaggaggccggccagtttggccagggcgtgcaccacaccctggagcaggccggcaaggaggccgacaaggctgtgcagggcttccacactggagtgcaccaggccggcaaggaggccgagaagctgggccagggcgtgaaccacgccgctgaccaggccggcaaggaggtggagaagctgggccagggcgcccaccacgccgccggccaggccggcaaggagctgcagaatgcccacaacggggtgaaccaggccagcaaggaggccaaccagctgctgaatggaaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172088 - DNA, 288 bp, Artificial Sequence
  Description of Artificial Sequence: Synthetic coding sequence
atgggcagccacacaggcaaggagctggacaagggcgtgcagggcctgaaccacggcatggacaaggtggcccacgagatcaaccacggcatcggccaggccggcaaggaggccgagaagctgggccatggagtgaacaatgctgctggccagggcaaccaccagagcggcagcagcagccaccagggcggggccaccaccacccccctggccagcggggcctctgtgaacacccccttcatcaacctgcctgccctgtggaggtctgtggccaacatcatgccctag

SEQ ID NO: 172089 - DNA, 738 bp, Artificial Sequence
  Description of Artificial Sequence: Synthetic coding sequence
atgtggctgtgccccctggccctgaacctgatcctgatggccgccagcggggctgtgtgtgaggtgaaggatgtgtgtgtgggcagccctggcatccctggcaccccaggcagccacggcctgcccggcagagatggaagagatggcctgaagggggaccccggccccccaggccccatgggccccccaggagagatgccctgccccccaggaaatgatggcctgcccggggcccctggcatccctggagaatgtggggagaagggggagcctggagagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccaggaaccctgaggagaatgaggccatcgccagctttgtgaagaagtacaacacctacgcctacgtgggcctgacagagggccccagccctggggacttccgctacagtgatggcacccctgtgaactacaccaactggtacagaggagagcctgctggccggggcaaggagcagtgtgtggagatgtacacagatggccagtggaatgacaggaactgcctgtacagccggctgaccatctag

SEQ ID NO: 172090 - DNA, 570 bp, Artificial Sequence
  Description of Artificial Sequence: Synthetic coding sequence
atgggccccccaggagagatgccctgccccccaggaaatgatggcctgcccggggcccctggcatccctggagaatgtggggagaagggggagcccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccagaaatccagaagaaaatgaggccatcgccagctttgtgaagaagtacaacacctacgcctacgtgggcctgacagagggccccagccctggggacttccgctacagtgatggcacccctgtgaactacaccaactggtacagaggagagcccgccggccggggcaaggagcagtgtgtggagatgtacacagatggccagtggaatgacaggaactgcctgtacagccggctgaccatctgtgagttctag

SEQ ID NO: 172091 - DNA, 747 bp, Artificial Sequence
  Description of Artificial Sequence: Synthetic coding sequence
atgtggctgtgccccctggccctgaacctgatcctgatggccgccagcggggctgtgtgtgaggtgaaggatgtgtgtgtgggcagccctggcatccctggcaccccaggcagccacggcctgcccggcagagatggaagagatggcctgaagggggaccccggccccccaggccccatgggccccccaggagagatgccctgccccccaggaaatgatggcctgcccggggcccctggcatccctggagaatgtggggagaagggggagcctggagagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccaggaaccctgaggagaatgaggccatcgccagctttgtgaagaagtacaacacctacgcctacgtgggcctgacagagggccccagccctggggacttccgctacagtgatggcacccctgtgaactacaccaactggtacagaggagagcctgctggccggggcaaggagcagtgtgtggagatgtacacagatggccagtggaatgacaggaactgcctgtacagccggctgaccatctgtgagttctag

SEQ ID NO: 172092 - DNA, 747 bp, Artificial Sequence; identical to SEQ ID NO: 172091
  Description of Artificial Sequence: Synthetic coding sequence

SEQ ID NO: 172093 - DNA, 792 bp, Artificial Sequence
  Description of Artificial Sequence: Synthetic coding sequence
atgaggccctgccaggtgcctggagctgccaccggcccccgggccatgtggctgtgccccctggccctgaacctgatcctgatggccgccagcggggctgtgtgtgaggtgaaggatgtgtgtgtgggcagccctggcatccctggcaccccaggcagccacggcctgcccggcagagatggaagagatggcctgaagggggaccccggccccccaggccccatgggccccccaggagagatgccctgccccccaggaaatgatggcctgcccggggcccctggcatccctggagaatgtggggagaagggggagcccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccagaaatccagaagaaaatgaggccatcgccagctttgtgaagaagtacaacacctacgcctacgtgggcctgacagagggccccagccctggggacttccgctacagtgatggcacccctgtgaactacaccaactggtacagaggagagcccgccggccggggcaaggagcagtgtgtggagatgtacacagatggccagtggaatgacaggaactgcctgtacagccggctgaccatctgtgagttctag

SEQ ID NO: 172094 - DNA, 747 bp, Artificial Sequence; identical to SEQ ID NO: 172091
  Description of Artificial Sequence: Synthetic coding sequence

SEQ ID NO: 172095 - DNA, 477 bp, Artificial Sequence
  Description of Artificial Sequence: Synthetic coding sequence
atgtggctgtgccccctggccctgaacctgatcctgatggccgccagcggggctgtgtgtgaggtgaaggatgtgtgtgtgggcagccctggcatccctggcaccccaggcagccacggcctgcccggcagagatggaagagatggcctgaagggggaccccggccccccaggccccatgggccccccaggagagatgccctgccccccaggaaatgatggcctgcccggggcccctggcatccctggagaatgtggggagaagggggagcctggagagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggcctag

SEQ ID NO: 172096 - DNA, 477 bp, Artificial Sequence; identical to SEQ ID NO: 172095
  Description of Artificial Sequence: Synthetic coding sequence

SEQ ID NO: 172097 - DNA, 747 bp, Artificial Sequence
  Description of Artificial Sequence: Synthetic coding sequence
atgtggctgtgccccctggccctgaccctcatcctgatggccgccagcggggccgcctgtgaggtgaaggatgtgtgtgtgggcagccctggcatccctggcaccccaggcagccacggcctgcccggcagagatggaagagatggagtgaagggggaccccggccccccaggccccatgggccccccaggagagaccccctgccccccaggcaacaacggcctgcccggggcccctggggtgcctggagagcggggggagaagggggaggccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccaggaaccctgaggagaatgaggccatcgccagctttgtgaagaagtacaacacctacgcctacgtgggcctgacagagggccccagccctggggacttccgctacagtgatggcacccctgtgaactacaccaactggtacagaggagagcctgctggccggggcaaggagcagtgtgtggagatgtacacagatggccagtggaatgacaggaactgcctgtacagccggctgaccatctgtgagttctag

SEQ ID NO: 172098 - DNA, 747 bp, Artificial Sequence; identical to SEQ ID NO: 172097
  Description of Artificial Sequence: Synthetic coding sequence

SEQ ID NO: 172099 - DNA, 477 bp, Artificial Sequence
  Description of Artificial Sequence: Synthetic coding sequence
atgtggctgtgccccctggccctgaccctcatcctgatggccgccagcggggccgcctgtgaggtgaaggatgtgtgtgtgggcagccctggcatccctggcaccccaggcagccacggcctgcccggcagagatggaagagatggagtgaagggggaccccggccccccaggccccatgggccccccaggagagaccccctgccccccaggcaacaacggcctgcccggggcccctggggtgcctggagagcggggggagaagggggaggccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggcctag

SEQ ID NO: 172100 - DNA, 645 bp, Artificial Sequence
  Description of Artificial Sequence: Synthetic coding sequence
atgaggccctgccaggtgcctggagctgccaccggcccccgggccatgtggctgtgccccctggccctgaccctcatcctgatggccgccagcggggccgcctgtgaggtgaaggatgtgtgtgtgggcagccctggcatccctgggaagagaggagagaagggggaggccggggagcggggccccccaggcctgcctgcccacctggatgaggagctgcaggccaccctgcatgacttccgccaccagatcctgcagaccaggggggccctgagcctgcagggcagcatcatgacagtgggggagaaggtgttcagcagcaatggccagagcatcacctttgatgccatccaggaggcctgtgcccgggccggcggcagaattgctgtgcccaggaaccctgaggagaatgaggccatcgccagctttgtgaagaagtacaacacctacgcctacgtgggcctgacagagggccccagccctggggacttccgctacagtgatggcacccctgtgaactacaccaactggtacagaggagagcctgctggccggggcaaggagcagtgtgtggagatgtacacagatggccagtggaatgacaggaactgcctgtacagccggctgaccatctgtgagttctag

SEQ ID NO: 172101 - DNA, 1146 bp, Artificial Sequence
  Description of Artificial Sequence: Synthetic coding sequence
atggccgagagccacctgctgcagtggctgctgctgctgctgcccaccctgtgtggccctggaacagctgcctggaccaccagcagcctggcctgtgcccagggccctgagttctggtgccagagcctggagcaggccctgcagtgccgggccctgggccactgcctgcaggaggtgtggggccacgtgggcgcagatgacctgtgccaggagtgtgaagatattgtgcacatcctgaacaagatggccaaggaggccatcttccaggacaccatgaggaagttcctggagcaggagtgcaatgtgctgcccctgaagctgctgatgccccagtgcaaccaggtgctggatgactacttccccctggtgattgactacttccagaaccagacagacagcaatggcatctgcatgcacctgggcctgtgcaagagccggcagcctgagcctgagcaggagcccggcatgtctgaccccctgcccaagcccctgcgggaccccctgcctgaccccctgctggacaagctggtgctgcctgtgctgcccggggccctgcaggcccggcccggcccccacacccaggacctgtctgagcagcagttccccatccccctgccctactgctggctgtgccgggccctgatcaagaggatccaggccatgatccccaagggggccctggccgtggccgtggcccaggtgtgccgggtggtgcccctggtggccggcggcatctgccagtgcctggccgagcgctacagcgtcatcctgctggacaccctgctgggccgcatgctgccccagctggtgtgccgcctggtgctgcgctgcagcatggatgacagcgctggccccaggagccccactggagagtggctgccccgggacagcgagtgccacctgtgcatgtctgtgaccacccaggccggcaacagcagcgagcaggccatcccccaggccatgctgcaggcctgtgtgggctcctggctggaccgggagaagtgcaagcagtttgtggagcagcacaccccccagctgctgaccctggtgccccggggctgggatgcccacaccacctgccaggccctgggcgtgtgtggcaccatgagcagccccctgcagtgcatccacagcccagacctgtag

SEQ ID NO: 172102 - DNA, 1128 bp, Artificial Sequence
  Description of Artificial Sequence: Synthetic coding sequence
atgctgctcttcctgctgagcgccctggtgctgctgacccagcccctgggctacctggaggccgagatgaagacctacagccacaggaccatgcccagcgcctgcaccctggtgatgtgcagctctgtggagagcggcctgcccggcagagatggaagagatggccgggagggccccagaggagagaagggggaccccggcctgcctggagctgctggccaggccggcatgcctggccaggccggccctgtgggccccaagggggacaatggatctgtgggggagcccggccccaagggggacaccggccccagcggccccccaggccccccaggagtgcccggccctgctggccgggagggccccctgggcaagcagggcaacatcggcccccagggcaagccaggccccaagggggaggccggccccaagggggaggtgggcgcccctggcatgcagggcagcgctggggcccggggcctggccggccccaagggggagcggggcgtgcctggagagcggggcgtgcccggcaacacaggagctgctggcagcgctggggccatgggcccccagggcagccctggggcccggggccccccaggcctgaagggggacaagggcatccctggggacaagggggccaagggggagagcggcctgcctgatgtggccagcctgcggcagcaggtggaggccctgcagggccaggtgcagcacctgcaggccgccttcagccagtacaagaaggtggagctgttccccaacggccagagcgtgggggagaagatcttcaagacagctggctttgtgaagcccttcacagaggcccagctgctgtgcacccaggccggcggccagctggccagccccaggtctgctgctgaaaatgctgccctgcagcagctggtggtggccaagaatgaggccgccttcctgtccatgacagacagcaagacagagggcaagttcacctaccccaccggggagagcctggtgtacagcaactgggcccctggagagcccaatgatgatggcggcagcgaggactgtgtggagatcttcaccaacgggaagtggaatgaccgggcctgtggggagaagaggctggtggtgtgtgagttctag

SEQ ID NO: 172103 - DNA, 657 bp, Artificial Sequence
  Description of Artificial Sequence: Synthetic coding sequence
atgttcctgagcaccagcaagcacggccggcaggaggccatgctgctcttcctgctgagcgccctggtgctgctgacccagcccctgggctacctggaggccgagatgaagacctacagccacaggaccatgcccagcgcctgcaccctggtgatgtgcagctctgtggagagcggcctgcccggcagagatggaagagatggccgggagggccccagaggagagaagggggaccccggcctgcccggggctgctggccaggccggcatgcctggccaggccggccctgtgggccccaagggggacaatggatctgtgggggagcccggccccaagggggacaccggccccagcggccccccaggccccccaggagtgcccggccctgctggccgggagggccccctgggcaagcagggcaacatcggcccccagggcaagccaggccccaagggggaggccggccccaagggggaggtgggcgcccctggcatgcagggcagcgctggggcccggggcctggccggccccaagggggagcggggcgtgcctggagagcggggcgtgcccggcaacacaggagctgctggcagcgctggggccatgggcccccagggcagccctggggcccggggccccccaggcctgaagggctag

SEQ ID NO: 172104 - DNA, 903 bp, Artificial Sequence
  Description of Artificial Sequence: Synthetic coding sequence
atggctgctgtggccgccctgcagctgggcctgcgggccgccggcctgggccgggccccagccagcgctgcctggaggtctgtgctgcgggtgagccccaggcctggggtggcctggaggcccagccgctgtggcagcagcgctgctgaggccagcgccaccaaggcagaagatgacagcttcctgcagtgggtgctgctgctgatccctgtgacagccttcggcctgggcacctggcaggtgcagaggaggaagtggaagctgaacctgattgctgagctggagagccgggtgctggccgagcctgtgcccctgcctgctgaccccatggagctgaagaacctggagtacagacctgtgaaggtgcggggctgctttgaccacagcaaggagctgtacatgatgcccaggaccatggtggaccctgtgcgggaggcccgggagggcggcctcatcagcagcagcacccagagcggggcctacgtggtgacccccttccactgcacagacctgggcgtgaccatcctggtgaacagaggatttgtgcccaggaagaaggtgaaccctgagacccggcagaagggccagattgaaggagaggtggacctgattggcatggtgcggctgacagagacccggcagccctttgtgcctgagaacaaccctgagaggaaccactggcactacagagacctggaggccatggcccgcatcactggagctgagcccatcttcattgatgccaacttccagagcacagtgcctgggggccccatcggcggccagaccagggtgaccctgagaaatgagcacctgcagtacatcgtgacctggtacggcctgtctgctgccaccagctacctgtggttcaagaagttcctgcggggcaccccaggagtgtag

SEQ ID NO: 172105 - DNA, 813 bp, Artificial Sequence
  Description of Artificial Sequence: Synthetic coding sequence
gccccagccagcgctgcctggaggtctgtgctgcgggtgagccccaggcctggggtggcctggaggcccagccgctgtggcagcagcgctgctgaggccagcgccaccaaggcagaagatgacagcttcctgcagtgggtgctgctgctgatccctgtgacagccttcggcctgggcacctggcaggtgcagaggaggaagtggaagctgaacctgattgctgagctggagagccgggtgctggccgagcctgtgcccctgcctgctgaccccatggagctgaagaacctggagtacagacctgtgaaggtgcggggctgctttgaccacagcaaggagctgtacatgatgcccaggaccatggtggaccctgtgcgggaggcccgggagggcggcctcatcagcagcagcacccagagcggggcctacgtggtgacccccttccactgcacagacctgggcaagaaggtgaaccctgagacccggcagaagggccagattgaaggagaggtggacctgattggcatggtgcggctgacagagacccggcagccctttgtgcctgagaacaaccctgagaggaaccactggcactacagagacctggaggccatggcccgcatcactggagctgagcccatcttcattgatgccaacttccagagcacagtgcctgggggccccatcggcggccagaccagggtgaccctgagaaatgagcacctgcagtacatcgtgacctggtacggcctgtctgctgccaccagctacctgtggttcaagaagttcctgcggggcaccccaggagtgtag

SEQ ID NO: 172106 - DNA, 771 bp, Artificial Sequence
  Description of Artificial Sequence: Synthetic coding sequence
atgtctgagctgcctggagatgtgcgggccttcctgcgggagcaccccagcctgcggctgcagacagatgccaggaaggtgcgctgcatcctgaccggccacgagctgccctgccgcctgcctgagctgcaggtgtacacccggggcaagaagtaccagaggctggtgcgggccagccctgcctttgattatgcagagtttgagccccacatcgtgcccagcaccaagaacccccaccagctgttctgcaagctgaccctgcggcacatcaacaagtgcccagagcacgtgctgcggcacacccagggccgccgctaccagagggccctgtgcaagtatgaggagtgccagaagcagggcgtggagtatgtgcctgcctgcctggtgcacagaagaagaagaagagaggaccagatggatggagatggcccccggccccgggaggccttctgggagcccaccagcagtgatgaaggaggagctgccagtgatgacagcatgacagacctgtacccacctgagctgttcaccaggaaggacctgggcagcacagaagatggagatggaacagatgacttcctgacagacaaggaggatgagaaggccaagccaccccgggagaaggccacagatgagagccggcgggagaccaccgtgtaccggggcctggtgcagaagaggggcaagaagcagctgggcagcctgaagaagaagttcaagagccaccacaggaagcccaagagcttcagcagctgcaagcagcctggatag

SEQ ID NO: 172107 - DNA, 810 bp, Artificial Sequence
  Description of Artificial Sequence: Synthetic coding sequence
atgggccagaatgacctgatgggcacagcagaagattttgctgaccagttcctgcgggtgaccaagcagtacctgccccacgtggcccggctgtgcctgatcagcaccttcctggaggatggcatccgcatgtggttccagtggagcgagcagagggactacatcgacaccacctggaactgtggctacctgctggccagcagctttgtgttcctgaacctgctgggccagctgaccggctgtgtgctggtgctgagcaggaactttgtgcagtatgcctgcttcggcctgtttggcatcatcgccctgcagaccatcgcctacagcatcctgtgggacctgaagttcctgatgaggaacctggccctgggcggcggcctgctgctgctgctggccgagagccgctctgagggcaagtccatgtttgctggggtgcccaccatgagggagagcagccccaagcagtacatgcagctgggcggccgggtgctgctggtgctgatgttcatgaccctgctgcactttgatgccagcttcttcagcatcgtgcagaacatcgtgggcacagccctgatgatcctggtggccatcggcttcaagaccaagctggccgccctgaccctggtggtgtggctgtttgccatcaacgtgtacttcaatgccttctggaccatccctgtgtacaagcccatgcatgacttcctgaagtatgacttcttccagaccatgtctgtcatcggcggcctgctgctggtggtggccctgggccctggaggagtgtccatggatgagaagaagaaggagtggtag

SEQ ID NO: 172108 - DNA, 561 bp, Artificial Sequence
  Description of Artificial Sequence: Synthetic coding sequence
atgggccagaatgacctgatgggcacagcagaagattttgctgaccagttcctgcgggtgaccaagcagtacctgccccacgtggcccggctgtgcctgatcagcaccttcctggaggatggcatccgcatgtggttccagtggagcgagcagagggactacatcgacaccacctggaactgtggctacctgctggccagcagctttgtgttcctgaacctgctgggccagctgaccggctgtgtgctggtgctgagcaggaactttgtgcagtatgcctgcttcggcctgtttggcatcatcgccctgcagaccatcgcctacagcatcctgtgggacctgaagttcctgatgaggaacctggccctgggcggcggcctgctgctgctgctggccgagagccgctctgagggcaagtccatgtttgctggggtgcccaccatgagggagagcagccccaagcagtacatgcagctgggcggccgggtgctgctggtgctgatgttcatgaccctgctgcactttgatgccagcttcttcagccagcccagccagcagtag

SEQ ID NO: 172109 - DNA, 567 bp, Artificial Sequence
  Description of Artificial Sequence: Synthetic coding sequence
atgggccagaatgacctgatgggcacagcagaagattttgctgaccagttcctgcgggtgaccaagcagtacctgccccacgtggcccggctgtgcctgatcagcaccttcctggaggatggcatccgcatgtggttccagtggagcgagcagagggactacatcgacaccacctggaactgtggctacctgctggccagcagctttgtgttcctgaacctgctgggccagctgaccggctgtgtgctggtgctgagcaggaactttgtgcagtatgcctgcttcggcctgtttggcatcatcgccctgcagaccatcgcctacagcatcctgtgggacctgaagttcctgatgaggaacctggccctgggcggcggcctgctgctgctgctggccgagagccgctctgagggcaagtccatgtttgctggggtgcccaccatgagggagagcagccccaagcacacctgcctggccaagacccggggccggcagggcctggtgcggggcggcttcaacaagacagccagcttctacgtgagcagcagcctgcccctgccctggtag

SEQ ID NO: 172110 - DNA, 783 bp, Artificial Sequence
  Description of Artificial Sequence: Synthetic coding sequence
atgaggagcctggccacagagttcctgcgggtgaccaagcagtacctgccccacgtggcccggctgtgcctgatcagcaccttcctggaggatggcatccgcatgtggttccagtggagcgagcagagggactacatcgacaccacctggaactgtggctacctgctggccagcagctttgtgttcctgaacctgctgggccagctgaccggctgtgtgctggtgctgagcaggaactttgtgcagtatgcctgcttcggcctgtttggcatcatcgccctgcagaccatcgcctacagcatcctgtgggacctgaagttcctgatgaggaacctggccctgggcggcggcctgctgctgctgctggccgagagccgctctgagggcaagtccatgtttgctggggtgcccaccatgagggagagcagccccaagcagtacatgcagctgggcggccgggtgctgctggtgctgatgttcatgaccctgctgcactttgatgccagcttcttcagcatcgtgcagaacatcgtgggcacagccctgatgatcctggtggccatcggcttcaagaccaagctggccgccctgaccctggtggtgtggctgtttgccatcaacgtgtacttcaatgccttctggaccatccctgtgtacaagcccatgcatgacttcctgaagtatgacttcttccagaccatgtctgtgattggaggcctgctgctggtggtggccctgggccctgggggcgtgtccatggatgagaagaagaaggagtggtag

SEQ ID NO: 172111 - DNA, 387 bp, Artificial Sequence
  Description of Artificial Sequence: Synthetic coding sequence
atgggccagaatgacctgatgggcacagcagaagattttgctgaccagttcctgcgggtgaccaagcagtacctgccccacgtggcccggctgtgcctgatcagcaccttcctggaggatggcatccgcatgtggttccagtggagcgagcagagggactacatcgacaccacctggaactgtggctacctgctggccagcagctttgtgttcctgaacctgctgggccagctgaccggctgtgtgctggtgctgagcaggaactttgtgcagtatgcctgcttcggcctgtttggcatcatcgccctgcagaccatcgcctacagcatcctgtgggacctgaagttcctgatgaggctgagcaggacctcctgggcccagctgtag

SEQ ID NO: 172112 - DNA, 1086 bp, Artificial Sequence
  Description of Artificial Sequence: Synthetic coding sequence
atggccagcctgctggccaaggatgcctacctgcagagcctggccaagaagatctgcagccacagcgcccctgagcagcaggcccggacccgggccggcaagacccagggcagcgagacagctggcccccccaagaagaagaggaagaagacccagaagaagttcaggaagcgggaggagaaggctgctgagcacaaggccaagagcctgggggagaagagccctgctgccagcggggcccggcggcctgaggccgccaaggaggaggccgcctgggccagcagcagcgctggcaacccagcagatggcctggccacagagcctgagagcgtgtttgccctggatgtgctgcggcagaggctgcacgagaagatccaggaggcccggggccagggcagcgccaaggagctgagccctgctgccctggagaagagaagaagaaggaagcaggagcgggacaggaagaagaggaagaggaaggagctgcgggccaaggagaaggccaggaaggccgaggaggccacagaggcccaggaggtggtggaggccaccccagagggcgcctgcacagagccccgggagcccccaggcctcatcttcaacaaggtggaggtgtctgaagatgagcccgccagcaaggcccagaggaggaaggagaagaggcagagggtgaagggcaacctgacccccctgaccggcaggaactaccggcagctgctggagcggctgcaggcccggcagagccggctggatgagctgcggggccaggatgagggcaaggcccaggagctggaggccaagatgaagtggaccaacctgctgtacaaggccgagggcgtgaagatcagagatgatgagcggctgctgcaggaggccctgaagaggaaggagaagagaagagcccagaggcagaggcgctgggagaagaggacagctggggtggtggagaagatgcagcagaggcaggacagaagacggcagaacctgcggaggaagaaggccgcccgggcagagcggcggctgctgcgggccaggaagaagggccgcatcctgccccaggacctggagcgggccggcctggtgtag

SEQ ID NO: 172113 - DNA, 789 bp, Artificial Sequence
  Description of Artificial Sequence: Synthetic coding sequence
atggccatgagcagcggcggcagcggcggcggcgtgcctgagcaggaggacagcgtgctcttccggcggggcaccggccagagtgatgacagcgacatctgggatgacacagccctgatcaaggcctatgacaaggctgtggccagcttcaagcacgccctgaagaatggagacatctgtgagaccagcggcaagcccaagaccacccccaagaggaagccagccaagaagaacaagagccagaagaagaacacagctgccagcctgcagcagtggaaggtgggggacaagtgcagcgccatctggagcgaagatggctgcatctacccagccaccatcgccagcattgacttcaagcgggagacctgtgtggtggtgtacacaggctacggcaaccgggaggagcagaacctgagtgacctgctgagccccatctgtgaggtggccaacaacatcgagcagaatgcccaggagaatgaaaatgaaagccaggtgtccacagatgaaagtgagaacagccgcagccctggcaacaagagtgacaacatcaagcccaagagcgccccctggaacagcttcctgcccccacctccacccatgcctggcccccggctgggccctgggaagatcatccccccacctccacccatctgcccagacagcctggatgatgctgatgccctgggctccatgctgatctcctggtacatgagcggctaccacacaggctactacatgggcttccggcagaaccagaaggagggccgctgcagccacagcctgaactag

SEQ ID NO: 172114 - DNA, 885 bp, Artificial Sequence
  Description of Artificial Sequence: Synthetic coding sequence
atggccatgagcagcggcggcagcggcggcggcgtgcctgagcaggaggacagcgtgctcttccggcggggcaccggccagagtgatgacagcgacatctgggatgacacagccctgatcaaggcctatgacaaggctgtggccagcttcaagcacgccctgaagaatggagacatctgtgagaccagcggcaagcccaagaccacccccaagaggaagccagccaagaagaacaagagccagaagaagaacacagctgccagcctgcagcagtggaaggtgggggacaagtgcagcgccatctggagcgaagatggctgcatctacccagccaccatcgccagcattgacttcaagcgggagacctgtgtggtggtgtacacaggctacggcaaccgggaggagcagaacctgagtgacctgctgagccccatctgtgaggtggccaacaacatcgagcagaatgcccaggagaatgaaaatgaaagccaggtgtccacagatgaaagtgagaacagccgcagccctggcaacaagagtgacaacatcaagcccaagagcgccccctggaacagcttcctgcccccacctccacccatgcctggcccccggctgggccctgggaagccaggcctgaagttcaatggacctcctcctcctcctcctcctcctccaccccacctgctgagctgctggctgccccccttccccagcggcccccccatcatccccccacctccacccatctgcccagacagcctggatgatgctgatgccctgggctccatgctgatctcctggtacatgagcggctaccacacaggctactacatgggcttccggcagaaccagaaggagggccgctgcagccacagcctgaactag

SEQ ID NO: 172115 - DNA, 789 bp, Artificial Sequence; identical to SEQ ID NO: 172113
  Description of Artificial Sequence: Synthetic coding sequence

SEQ ID NO: 172116 - DNA, 849 bp, Artificial Sequence
  Description of Artificial Sequence: Synthetic coding sequence
atggccatgagcagcggcggcagcggcggcggcgtgcctgagcaggaggacagcgtgctcttccggcggggcaccggccagagtgatgacagcgacatctgggatgacacagccctgatcaaggcctatgacaaggctgtggccagcttcaagcacgccctgaagaatggagacatctgtgagaccagcggcaagcccaagaccacccccaagaggaagccagccaagaagaacaagagccagaagaagaacacagctgccagcctgcagcagtggaaggtgggggacaagtgcagcgccatctggagcgaagatggctgcatctacccagccaccatcgccagcattgacttcaagcgggagacctgtgtggtggtgtacacaggctacggcaaccgggaggagcagaacctgagtgacctgctgagccccatctgtgaggtggccaacaacatcgagcagaatgcccaggagaatgaaaatgaaagccaggtgtccacagatgaaagtgagaacagccgcagccctggcaacaagagtgacaacatcaagcccaagagcgccccctggaacagcttcctgcccccacctccacccatgcctggcccccggctgggccctgggaagccaggcctgaagttcaatggacctcctcctcctcctcctcctcctccaccccacctgctgagctgctggctgccccccttccccagcggcccccccatcatccccccacctccacccatctgcccagacagcctggatgatgctgatgccctgggctccatgctgatctcctggtacatgagcggctaccacacaggctactacatggagatgctggcctag

SEQ ID NO: 172117 - DNA, 885 bp, Artificial Sequence
  Description of Artificial Sequence: Synthetic coding sequence
atggccatgagcagcggcggcagcggcggcggcgtgcctgagcaggaggacagcgtgctcttccggcggggcaccggccagagtgatgacagcgacatctgggatgacacagccctgatcaaggcctatgacaaggctgtggccagcttcaagcacgccctgaagaatggagacatctgtgagaccagcggcaagcccaagaccacccccaagaggaagccagccaagaagaacaagagccagaagaagaacacagctgccagcctgcagcagtggaaggtgggggacaagtgcagcgccatctggagcgaagatggctgcatctacccagccaccatcgccagcattgacttcaagcgggagacctgtgtggtggtgtacacaggctacggcaaccgggaggagcagaacctgagtgacctgctgagccccatctgtgaggtggccaacaacatcgagcagaatgcccaggagaatgaaaatgaaagccaggtgtccacagatgaaagtgagaacagccgcagccctggcaacaagagtgacaacatcaagcccaagagcgccccctggaacagcttcctgcccccacctccacccatgcctggcccccggctgggccctgggaagccaggcctgaagttcaatggacctcctcctcctcctcctcctcctccaccccacctgctgagctgctggctgccccccttccccagcggcccccccatcatccccccacctccacccatctgcccagacagcctggatgatgctgatgccctgggctccatgctgatctcctggtacatgagcggctaccacacaggctactacatgacaggcttccactgtgtgtcccaggacggcctgaacctgctgaccccctag

SEQ ID NO: 172118 - DNA, 684 bp, Artificial Sequence
  Description of Artificial Sequence: Synthetic coding sequence
atggccatgagcagcggcggcagcggcggcggcgtgcctgagcaggaggacagcgtgctcttccggcggggcaccggccagagtgatgacagcgacatctgggatgacacagccctgatcaaggcctatgacaaggctgtggccagcttcaagcacgccctgaagaatggagacatctgtgagaccagcggcaagcccaagaccacccccaagaggaagccagccaagaagaacaagagccagaagaagaacacagctgccagcctgcagcagaatgaaaatgaaagccaggtgtccacagatgaaagtgagaacagccgcagccctggcaacaagagtgacaacatcaagcccaagagcgccccctggaacagcttcctgcccccacctccacccatgcctggcccccggctgggccctgggaagccaggcctgaagttcaacggccccccacctcctcctcctcctcctccaccccacctgctgagctgctggctgccccccttccccagcggcccccccatcatccccccacctccacccatctgcccagacagcctggatgatgctgatgccctgggctccatgctgatctcctggtacatgagcggctaccacacaggctactacatgggcttccggcagaaccagaaggagggccgctgcagccacagcctgaactag

SEQ ID NO: 172119 - DNA, 849 bp, Artificial Sequence; identical to SEQ ID NO: 172116
  Description of Artificial Sequence: Synthetic coding sequence

SEQ ID NO: 172120 - DNA, 789 bp, Artificial Sequence; identical to SEQ ID NO: 172113
  Description of Artificial Sequence: Synthetic coding sequence

SEQ ID NO: 172121 - DNA, 885 bp, Artificial Sequence; identical to SEQ ID NO: 172114
  Description of Artificial Sequence: Synthetic coding sequence

SEQ ID NO: 172122 - DNA, 885 bp, Artificial Sequence; identical to SEQ ID NO: 172117
  Description of Artificial Sequence: Synthetic coding sequence

SEQ ID NO: 172123 - DNA, 684 bp, Artificial Sequence; identical to SEQ ID NO: 172118
  Description of Artificial Sequence: Synthetic coding sequence

SEQ ID NO: 172124 - DNA, 4494 bp, Artificial Sequence
  Description of Artificial Sequence: Synthetic coding sequence
atgccccgctgcatcgcccacttctgtgagaagccacccagcgtgtcctacagcatcctggagagcgtgtccaaggccaagtttgctgctggctctgtggtgtccttcaagtgcatggagggctttgtgctgaacaccagcgccaagattgagtgcatgagaggaggccagtggaaccccagccccatgagcatccagtgcatccctgtgcgctgtggggagcccccatccatcatgaatggctacgccagcggcagcaactacagctttggagccatggtggcctacagctgcaacaagggcttctacatcaagggggagaagaagagcacctgtgaggccaccggccagtggagcagccccatccccacctgccaccctgtgtcctgtggggagccccccaaggtggagaatggcttcctggagcacaccaccggccgcatctttgaaagtgaggtgcgctaccagtgcaaccctggctacaagtctgtgggcagccctgtgtttgtgtgccaggccaacagacactggcacagcgagagccccctgatgtgtgtgcccctggactgtgggaagcccccacccatccagaatggcttcatgaagggggagaactttgaggtgggcagcaaggtgcagttcttctgcaatgaaggctatgagctggtgggggacagctcctggacctgccagaagagcggcaagtggaacaagaagagcaaccccaagtgcatgcctgccaagtgcccagagccccccctgctggagaaccagctggtgctgaaggagctgaccacagaggtgggcgtggtgaccttcagctgcaaggagggccacgtgctgcagggccccagcgtgctgaagtgcctgcccagccagcagtggaatgacagcttccctgtgtgcaagatcgtgctgtgcaccccaccacccctcatcagctttggagtgcccatccccagcagcgccctgcacttcggcagcacagtgaagtacagctgtgtgggcggcttcttcctgcggggcaacagcaccaccctgtgccagccagatggcacctggagcagccccctgcctgaatgtgtgcctgtggagtgcccccagcctgaggagatccccaacggcatcattgatgtgcagggcctggcctacctgagcacagccctgtacacctgcaagccaggctttgagctggtgggcaacaccaccaccctgtgtggggagaatggccactggctgggcggcaagcccacctgcaaggccattgaatgtctgaagcccaaggagatcctgaatggcaagttctcctacacagacctgcactacggccagacagtgacctacagctgcaacagaggcttccggctggagggccccagcgccctgacctgcctggagactggagactgggatgtggatgcccccagctgcaatgccatccactgtgacagcccccagcccattgaaaatggatttgtggagggcgctgactacagctatggagccatcatcatctacagctgcttccctggcttccaggtggccggccacgccatgcagacctgtgaggagagcggctggagcagcagcatccccacctgcatgcccatcgactgtggcctgcccccccacatcgactttggagactgcaccaagctgaaggatgaccagggctactttgagcaggaggatgacatgatggaggtgccctacgtgaccccccaccccccctaccacctgggcgctgtggccaagacctgggagaacaccaaggagagccctgccacccacagcagcaacttcctgtatggcaccatggtgtcctacacctgcaaccctggctatgagctgctgggcaaccctgtgctgatctgccaggaggatggcacctggaatggcagcgcccccagctgcatcagcattgaatgtgacctgcccacagccccagaaaatggcttcctgcgcttcacagagacctccatgggcagcgctgtgcagtacagctgcaagccaggccacatcctggccggcagtgacctgcggctgtgcctggagaacaggaagtggagcggggccagcccccgctgtgaggccatcagctgcaagaagcccaaccctgtgatgaatggcagcatcaagggcagcaactacacctacctgagcaccctgtactatgaatgtgaccccggctacgtgctgaatggaacagagaggaggacctgccaggatgacaagaactgggatgaagatgagcccatctgcatccctgtggactgcagcagcccccctgtgtctgccaacggccaggtgagaggagatgagtacaccttccagaaggagattgagtacacctgcaatgaaggcttcctgctggagggcgcccggagccgggtgtgcctggccaacggctcctggagcggggccaccccagactgtgtgcctgtgcgctgtgccaccccaccccagctggccaatggagtgacagagggcctggactatggcttcatgaaggaggtgaccttccactgccacgagggctacatcctgcacggggcccccaagctgacctgccagagtgatggcaactgggatgctgagatccccctgtgcaagcctgtgaactgtggccccccagaggacctggcccacggcttccccaacggcttctccttcatccatggaggccacatccagtaccagtgcttccctggctacaagctgcacggcaacagcagccgccgctgcctgagcaatggctcctggagcggcagcagccccagctgcctgccctgccgctgcagcacccctgtgattgaatatggcaccgtgaatggaacagactttgactgtgggaaggccgcccgcatccagtgcttcaagggcttcaagctgctgggcctgtctgagatcacctgtgaggctgatggccagtggagcagcggcttcccccactgtgagcacaccagctgtggcagcctgcccatgatccccaatgccttcatcagcgagaccagctcctggaaggaaaatgtcatcacctacagctgccgcagcggctacgtgatccagggcagcagtgacctgatctgcacagagaagggcgtgtggagccagccctaccctgtgtgtgagcccctgagctgtggcagccccccatctgtggccaatgctgtggccaccggggaggcccacacctatgagagcgaggtgaagctgcgctgcctggagggctacaccatggacacagacacagacaccttcacctgccagaaggatggccgctggttccctgagcgcatcagctgcagccccaagaagtgccccctgcctgagaacatcacccacatcctggtgcatggagatgacttctctgtgaaccggcaggtgtctgtgtcctgtgccgagggctacacctttgaaggagtgaacatctctgtgtgccagctggatggcacctgggagccccccttcagtgatgagagctgcagccctgtgtcctgtgggaagccagagagccctgagcacggctttgtggtgggcagcaagtacacctttgagagcaccatcatctaccagtgtgagcccggctatgagctggagggcaaccgggagcgggtgtgccaggagaaccggcagtggagcggcggcgtggccatctgcaaggagacccgctgtgagacccccctggagttcctgaatggcaaggctgacattgaaaatagaaccaccggccccaacgtggtgtacagctgcaacagaggctacagcctggagggccccagcgaggcccactgcacagaaaatggcacctggagccaccctgtgcccctgtgcaagcccaacccctgccctgtgccctttgtgatcccagaaaatgccctgctgtctgagaaggagttctacgtggaccagaatgtgtccatcaagtgccgggagggcttcctgctgcagggccacggcatcatcacctgcaacccagatgagacctggacccagaccagcgccaagtgtgagaagatcagctgtggccccccagcccacgtggagaatgccatcgcccggggcgtgcactaccagtacggggacatgatcacctacagctgctacagcggctacatgctggagggcttcctgcggtctgtgtgcctggagaatggcacctggaccagcccccccatctgcagagctgtgtgccgcttcccctgccagaatggaggcatctgccagaggcccaatgcctgcagctgcccagagggctggatgggccgcctgtgtgaggagcccatctgcatcctgccctgcctgaatggaggccgctgtgtggccccctaccagtgtgactgccccccaggctggacaggcagccgctgccacacagctgtgtgccagagcccctgcctgaatggaggaaaatgtgtgcggcccaaccgctgccactgcctgagctcctggacaggccacaactgcagcaggaagagaagaacaggcttctag

SEQ ID NO: 172125 - DNA, 4650 bp, Artificial Sequence
  Description of Artificial Sequence: Synthetic coding sequence
atgtggccccggctggccttctgctgctggggcctggccctggtgtctggctgggccaccttccagcagatgagccccagcaggaacttctccttccgcctcttccctgagacagcccctggggcccctggcagcatcccagcccccccagcccctggagatgaggccgccggcagccgggtggagcggctgggccaggccttcagaagaagagtgcggctgctgcgggagctgtctgagcggctggagctggtgttcctggtggatgacagcagctctgtgggggaggtgaacttccgctctgagctgatgtttgtgaggaagctgctgagtgacttccctgtggtgcccacagccaccagggtggccatcgtgaccttcagcagcaagaactacgtggtgccccgggtggactacatcagcacccggcgggcccggcagcacaagtgtgccctgctgctgcaggagatcccagccatctcctaccggggcggcggcacctacaccaagggggccttccagcaggccgcccagatcctgctgcacgcccgggagaacagcaccaaggtggtgttcctgatcacagatggctacagcaatggaggagacccccggcccatcgccgccagcctgcgggacagcggcgtggagatcttcaccttcggcatctggcagggcaacatccgggagctgaatgacatggccagcacccccaaggaggagcactgctacctgctgcacagctttgaggagtttgaggccctggcccggcgggccctgcacgaggacctgcccagcggcagcttcatccaggatgacatggtgcactgcagctacctgtgtgatgagggcaaggactgctgtgacaggatgggcagctgcaagtgtggcacccacacaggccactttgagtgcatctgtgagaagggctactacggcaagggcctgcagtatgaatgtacagcctgccccagcggcacctacaagccagagggcagccctgggggcatcagcagctgcatcccctgcccagatgagaaccacaccagccccccaggcagcaccagccctgaggactgtgtgtgccgggagggctaccgggccagcggccagacctgtgagctggtgcactgcccagccctgaagcccccagaaaatggctacttcatccagaacacctgcaacaaccacttcaatgctgcctgtggggtgcgctgccaccctggctttgacctggtgggcagcagcatcatcctgtgcctgcccaacggcctgtggagcggcagcgagagctactgccgggtgaggacctgcccccacctgcggcagcccaagcacggccacatcagctgcagcacccgggagatgctgtacaagaccacctgcctggtggcctgtgatgagggctaccgcctggagggcagtgacaagctgacctgccagggcaacagccagtgggatggccctgagccccgctgtgtggagcggcactgcagcaccttccagatgcccaaggatgtgatcatcagcccccacaactgtgggaagcagcctgccaagtttggcaccatctgctacgtgtcctgccggcagggcttcatcctgagcggcgtgaaggagatgctgcgctgcaccaccagcggcaagtggaatgtgggcgtgcaggccgctgtgtgcaaggatgtggaggccccccagatcaactgccccaaggacatcgaggccaagaccctggagcagcaggacagcgccaacgtgacctggcagatccccacagccaaggacaacagcggggagaaggtgtctgtgcacgtgcacccagccttcaccccaccctacctgttccccatcggagatgtggccatcgtgtacacagccacagacctgagcggcaaccaggccagctgcatcttccacatcaaggtgattgatgctgagccccctgtgattgactggtgccgcagccccccacctgtgcaggtgtctgagaaggtgcatgctgcctcctgggatgagccccagttcagtgacaacagcggggctgagctggtgatcaccaggagccacacccagggcgacctcttcccccagggcgagaccatcgtgcagtacacagccacagaccccagcggcaacaacagaacctgtgacatccacatcgtcatcaagggcagcccctgtgagatccccttcacccctgtgaatggagacttcatctgcaccccagacaacacaggagtgaactgcaccctgacctgcctggagggctatgacttcacagagggcagcacagacaagtactactgtgcctatgaagatggagtgtggaagcccacctacaccacagagtggccagactgtgccaagaagagatttgccaaccacggcttcaagagctttgagatgttctacaaggccgcccgctgtgatgacacagacctgatgaagaagttcagcgaggcctttgagaccaccctgggcaagatggtgcccagcttctgcagtgatgctgaggacatcgactgccgcctggaggagaacctgaccaagaagtactgcctggagtacaactatgactatgaaaatggatttgccatcggccctgggggctggggcgccgccaaccggctggactacagctatgatgacttcctggacacagtgcaggagacagccaccagcattggaaatgccaagagcagccgcatcaagaggtctgcccccctgagtgactacaagatcaagctgatcttcaacatcacagcctctgtgcccctgcctgatgaaagaaatgacaccctggagtgggagaaccagcagaggctgctgcagaccctggagaccatcaccaacaagctgaagaggaccctgaacaaggaccccatgtacagcttccagctggccagcgagatcctgattgctgacagcaacagcctggagaccaagaaggccagccccttctgccggcccggctctgtgctgcggggccgcatgtgtgtgaactgccccctgggcacctactacaacctggagcacttcacctgtgagagctgccgcatcggcagctaccaggatgaggagggccagctggagtgcaagctgtgccccagcggcatgtacacagagtacatccacagcaggaacatcagtgactgcaaggcccagtgcaagcagggcacctacagctacagcggcctggagacctgtgagagctgccccctgggcacctaccagcccaagtttggcagccgcagctgcctgagctgcccagagaacaccagcacagtgaagagaggagctgtgaacatcagcgcctgtggggtgccctgcccagagggcaagttcagccgcagcggcctgatgccctgccacccctgcccccgggactactaccagcccaatgccggcaaggccttctgcctggcctgccccttctacggcaccaccccatttgctggcagccgcagcatcacagaatgtagcagcttcagcagcaccttctctgctgctgaggagagcgtggtgcccccagccagcctgggccacatcaagaagagacatgagatcagcagcagggtcttccacgagtgcttcttcaacccctgccacaacagcggcacctgccagcagctgggccggggctacgtgtgcctgtgccccctgggctacacaggcctgaagtgtgaaacagacattgatgagtgcagccccctgccctgcctgaacaatggagtgtgcaaggacctggtgggggagttcatctgtgagtgccccagcggctacacaggccagagatgtgaggagaacatcaatgaatgtagcagcagcccctgcctgaacaagggcatctgtgtggatggagtggccggctaccgctgcacctgtgtgaagggctttgtgggcctgcactgtgaaacagaggtgaatgaatgccagagcaacccctgcctgaacaatgctgtgtgtgaggaccaggtgggcggcttcctgtgcaagtgccccccaggcttcctgggcacccgctgtgggaagaatgtggatgagtgcctgagccagccctgcaagaatggagccacctgcaaggatggagccaacagcttccgctgcctgtgtgccgccggcttcaccggcagccactgtgagctgaacatcaatgaatgccagagcaacccctgcaggaaccaggccacctgtgtggatgagctgaacagctacagctgcaagtgccagcccggcttcagcggcaagagatgtgaaacagagcagagcacaggcttcaacctggactttgaggtgtctggcatctacggctacgtgatgctggatggcatgctgcccagcctgcacgccctgacctgcaccttctggatgaagagcagtgatgacatgaactacggcacccccatctcctatgctgtggacaatggaagtgacaacaccctgctgctgacagactacaacggctgggtgctgtatgtgaatggccgggagaagatcaccaactgccccagcgtgaatgatggccgctggcaccacatcgccatcacctggaccagcgccaacggcatctggaaggtgtacattgatggcaagctgagtgatggaggagctggcctgtctgtgggcctgcccatccctggcatgttttag

SEQ ID NO: 172126 - DNA, 2538 bp, Artificial Sequence
  Description of Artificial Sequence: Synthetic coding sequence
atgagccccagcaggaacttctccttccgcctcttccctgagacagcccctggggcccctggcagcatcccagcccccccagcccctggagatgaagctgctggcagccgggtggagcggctgggccaggccttcagaagaagagtgcggctgctgcgggagctgtctgagcggctggagctggtgttcctggtggatgacagcagctctgtgggggaggtgaacttccgctctgagctgatgtttgtgaggaagctgctgagtgacttccctgtggtgcccacagccaccagggtggccatcgtgaccttcagcagcaagaactacgtggtgccccgggtggactacatcagcacccggcgggcccggcagcacaagtgtgccctgctgctgcaggagatcccagccatctcctacagaggaggcggcacctacaccaagggggccttccagcaggccgcccagatcctgctgcacgcccgggagaacagcaccaaggtggtgttcctgatcacagatggctacagcaatggaggagacccccggcccatcgccgccagcctgcgggacagcggcgtggagatcttcaccttcggcatctggcagggcaacatccgggagctgaatgacatggccagcacccccaaggaggagcactgctacctgctgcacagctttgaggagtttgaggccctggcccggcgggccctgcacgaggacctgcccagcggcagcttcatccaggatgacatggtgcactgcagctacctgtgtgatgagggcaaggactgctgtgacaggatgggcagctgcaagtgtggcacccacacaggccactttgagtgcatctgtgagaagggctactacggcaagggcctgcagtatgagtgcacagcctgccccagcggcacctacaagccagagggcagccctgggggcatcagcagctgcatcccctgcccagatgagaaccacaccagccccccaggcagcaccagccctgaggactgtgtgtgccgggagggctaccgggccagcggccagacctgtgagctggtgcactgcccagccctgaagcccccagaaaatggctacttcatccagaacacctgcaacaaccacttcaatgctgcctgtggggtgcgctgccaccctggctttgacctggtgggcagcagcatcatcctgtgcctgcccaacggcctgtggagcggcagcgagagctactgccgggtgaggacctgcccccacctgcggcagcccaagcacggccacatcagctgcagcacccgggagatgctgtacaagaccacctgcctggtggcctgtgatgagggctaccgcctggagggcagtgacaagctgacctgccagggcaacagccagtgggatggccctgagccccgctgtgtggagcggcactgcagcaccttccagatgcccaaggatgtgatcatcagcccccacaactgtgggaagcagcctgccaagtttggcaccatctgctacgtgtcctgccggcagggcttcatcctgtctggagtgaaggagatgctgcgctgcaccaccagcggcaagtggaatgtgggcgtgcaggccgctgtgtgcaaggatgtggaggccccccagatcaactgccccaaggacatcgaggccaagaccctggagcagcaggacagcgccaacgtgacctggcagatccccacagccaaggacaacagcggggagaaggtgtctgtgcacgtgcacccagccttcaccccaccctacctgttccccatcggagatgtggccatcgtgtacacagccacagacctgagcggcaaccaggccagctgcatcttccacatcaaggtgattgatgctgagccccctgtgattgactggtgccgcagccccccacctgtgcaggtgtctgagaaggtgcacgccgcctcctgggatgagccccagttcagtgacaacagcggggctgagctggtgatcaccaggagccacacccagggcgacctcttcccccagggcgagaccatcgtgcagtacacagccacagaccccagcggcaacaacagaacctgtgacatccacatcgtcatcaagggcagcccctgtgagatccccttcacccctgtgaatggagacttcatctgcaccccagacaacacaggagtgaactgcaccctgacctgcctggagggctatgacttcacagagggcagcacagacaagtactactgtgcctatgaagatggagtgtggaagcccacctacaccacagagtggccagactgtgccaagaagagatttgccaaccacggcttcaagagctttgagatgttctacaaggccgcccgctgtgatgacacagacctgatgaagaagttcagcgaggcctttgagaccaccctgggcaagatggtgcccagcttctgcagtgatgctgaagatattgactgccgcctggaggagaacctgaccaagaagtactgcctggagtacaactatgactatgaaaatggatttgccatcggcaactag

SEQ ID NO: 172127 - DNA, 1548 bp, Artificial Sequence
  Description of Artificial Sequence: Synthetic coding sequence
ctggagaaccagctggtgctgaaggagctgaccacagaggtgggcgtggtgaccttcagctgcaaggagggccacgtgctgcagggccccagcgtgctgaagtgcctgcccagccagcagtggaatgacagcttccctgtgtgcaagatcgtgctgtgcaccccaccacccctcatcagctttggagtgcccatccccagcagcgccctgcacttcggcagcacagtgaagtacagctgtgtgggcggcttcttcctgcggggcaacagcaccaccctgtgccagccagatggcacctggagcagccccctgcctgaatgtgtgcctgtggagtgcccccagcctgaggagatccccaacggcatcattgatgtgcagggcctggcctacctgagcacagccctgtacacctgcaagccaggctttgagctggtgggcaacaccaccaccctgtgtggggagaatggccactggctgggcggcaagcccacctgcaaggccattgaatgtctgaagcccaaggagatcctgaatggcaagttctcctacacagacctgcactacggccagacagtgacctacagctgcaacagaggcttccggctggagggccccagcgccctgacctgcctggagactggagactgggatgtggatgcccccagctgcaatgccatccactgtgacagcccccagcccattgaaaatggatttgtggagggcgctgactacagctatggagccatcatcatctacagctgcttccctggcttccaggtggccggccacgccatgcagacctgtgaggagagcggctggagcagcagcatccccacctgcatgcccatcgactgtggcctgcccccccacatcgactttggagactgcaccaagctgaaggatgaccagggctactttgagcaggaggatgacatgatggaggtgccctacgtgaccccccaccccccctaccacctgggcgctgtggccaagacctgggagaacaccaaggagagccctgccacccacagcagcaacttcctgtatggcaccatggtgtcctacacctgcaaccctggctatgagctgctgggcaaccctgtgctgatctgccaggaggatggcacctggaatggcagcgcccccagctgcatcagcattgaatgtgacctgcccacagccccagaaaatggcttcctgcgcttcacagagacctccatgggcagcgctgtgcagtacagctgcaagccaggccacatcctggccggcagtgacctgcggctgtgcctggagaacaggaagtggagcggggccagcccccgctgtgaggccatcagctgcaagaagcccaaccctgtgatgaatggcagcatcaagggcagcaactacacctacctgagcaccctgtactatgaatgtgaccccggctacgtgctgaatggaacagagaggaggacctgccaggatgacaagacaggcatgaggatgagcccctttgccttcctgtggacagctgtgcacccccagagccagcccatggccaggtag

SEQ ID NO: 172128 - DNA, 10647 bp, Artificial Sequence
  Description of Artificial Sequence: Synthetic coding sequence
atgagccccagcaggaacttctccttccgcctcttccctgagacagcccctggggcccctggcagcatcccagcccccccagcccctggagatgaagctgctggcagccgggtggagcggctgggccaggccttcagaagaagagtgcggctgctgcgggagctgtctgagcggctggagctggtgttcctggtggatgacagcagctctgtgggggaggtgaacttccgctctgagctgatgtttgtgaggaagctgctgagtgacttccctgtggtgcccacagccaccagggtggccatcgtgaccttcagcagcaagaactacgtggtgccccgggtggactacatcagcacccggcgggcccggcagcacaagtgtgccctgctgctgcaggagatcccagccatctcctacagaggaggcggcacctacaccaagggggccttccagcaggccgcccagatcctgctgcacgcccgggagaacagcaccaaggtggtgttcctgatcacagatggctacagcaatggaggagacccccggcccatcgccgccagcctgcgggacagcggcgtggagatcttcaccttcggcatctggcagggcaacatccgggagctgaatgacatggccagcacccccaaggaggagcactgctacctgctgcacagctttgaggagtttgaggccctggcccggcgggccctgcacgaggacctgcccagcggcagcttcatccaggatgacatggtgcactgcagctacctgtgtgatgagggcaaggactgctgtgacaggatgggcagctgcaagtgtggcacccacacaggccactttgagtgcatctgtgagaagggctactacggcaagggcctgcagtatgagtgcacagcctgccccagcggcacctacaagccagagggcagccctgggggcatcagcagctgcatcccctgcccagatgagaaccacaccagccccccaggcagcaccagccctgaggactgtgtgtgccgggagggctaccgggccagcggccagacctgtgagctggtgcactgcccagccctgaagcccccagaaaatggctacttcatccagaacacctgcaacaaccacttcaatgctgcctgtggggtgcgctgccaccctggctttgacctggtgggcagcagcatcatcctgtgcctgcccaacggcctgtggagcggcagcgagagctactgccgggtgaggacctgcccccacctgcggcagcccaagcacggccacatcagctgcagcacccgggagatgctgtacaagaccacctgcctggtggcctgtgatgagggctaccgcctggagggcagtgacaagctgacctgccagggcaacagccagtgggatggccctgagccccgctgtgtggagcggcactgcagcaccttccagatgcccaaggatgtgatcatcagcccccacaactgtgggaagcagcctgccaagtttggcaccatctgctacgtgtcctgccggcagggcttcatcctgtctggagtgaaggagatgctgcgctgcaccaccagcggcaagtggaatgtgggcgtgcaggccgctgtgtgcaaggatgtggaggccccccagatcaactgccccaaggacatcgaggccaagaccctggagcagcaggacagcgccaacgtgacctggcagatccccacagccaaggacaacagcggggagaaggtgtctgtgcacgtgcacccagccttcaccccaccctacctgttccccatcggagatgtggccatcgtgtacacagccacagacctgagcggcaaccaggccagctgcatcttccacatcaaggtgattgatgctgagccccctgtgattgactggtgccgcagccccccacctgtgcaggtgtctgagaaggtgcacgccgcctcctgggatgagccccagttcagtgacaacagcggggctgagctggtgatcaccaggagccacacccagggcgacctcttcccccagggcgagaccatcgtgcagtacacagccacagaccccagcggcaacaacagaacctgtgacatccacatcgtcatcaagggcagcccctgtgagatccccttcacccctgtgaatggagacttcatctgcaccccagacaacacaggagtgaactgcaccctgacctgcctggagggctatgacttcacagagggcagcacagacaagtactactgtgcctatgaagatggagtgtggaagcccacctacaccacagagtggccagactgtgccaagaagagatttgccaaccacggcttcaagagctttgagatgttctacaaggccgcccgctgtgatgacacagacctgatgaagaagttcagcgaggcctttgagaccaccctgggcaagatggtgcccagcttctgcagtgatgctgaagatattgactgccgcctggaggagaacctgaccaagaagtactgcctggagtacaactatgactatgaaaatggatttgccatcggccctgggggctggggcgccgccaaccggctggactacagctatgatgacttcctggacacagtgcaggagacagccaccagcattggaaatgccaagagcagccgcatcaagaggtctgcccccctgagtgactacaagatcaagctgatcttcaacatcacagcctctgtgcccctgcctgatgaaagaaatgacaccctggagtgggagaaccagcagaggctgctgcagaccctggagaccatcaccaacaagctgaagaggaccctgaacaaggaccccatgtacagcttccagctggccagcgagatcctgattgctgacagcaacagcctggagaccaagaaggccagccccttctgcaggcctggctctgtgctgcggggccgcatgtgtgtgaactgccccctgggcacctactacaacctggagcacttcacctgtgagagctgcagaattggcagctaccaggatgaggagggccagctggagtgcaagctgtgccccagcggcatgtacacagagtacatccacagcaggaacatcagtgactgcaaggcccagtgcaagcagggcacctacagctacagcggcctggagacctgtgagagctgccccctgggcacctaccagcccaagtttggcagccgcagctgcctgagctgcccagagaacaccagcacagtgaagagaggagctgtgaacatcagcgcctgtggggtgccctgcccagagggcaagttcagccgcagcggcctgatgccctgccacccctgcccccgggactactaccagcccaatgctgggaaggccttctgcctggcctgccccttctacggcaccaccccatttgctggcagccgcagcatcacagagtgcagcagcttcagcagcaccttctctgctgctgaggagagcgtggtgcccccagccagcctgggccacatcaagaagagacatgagatcagcagccaggtgttccacgagtgcttcttcaacccctgccacaacagcggcacctgccagcagctgggccggggctacgtgtgcctgtgccccctgggctacacaggcctgaagtgtgaaacagacattgatgaatgtagccccctgccctgcctgaacaacggggtgtgcaaggacctggtgggggagttcatctgtgaatgtcccagcggctacacaggccagagatgtgaggagaacatcaatgaatgtagcagcagcccctgcctgaacaagggcatctgtgtggatggagtggccggctaccgctgcacctgtgtgaagggctttgtgggcctgcactgtgaaacagaggtgaatgaatgccagagcaacccctgcctgaacaatgctgtgtgtgaggaccaggtgggcggcttcctgtgcaagtgccccccaggcttcctgggcacccgctgtgggaagaatgtggatgaatgtctgagccagccctgcaagaatggagccacctgcaaggatggagccaacagcttccgctgcctgtgtgccgccggcttcaccggcagccactgtgagctgaacatcaatgaatgccagagcaacccctgcaggaaccaggccacctgtgtggatgagctgaacagctacagctgcaagtgccagcccggcttcagcggcaagagatgtgaaacagagcagagcacaggcttcaacctggactttgaggtgtctggcatctacggctacgtgatgctggatggcatgctgcccagcctgcacgccctgacctgcaccttctggatgaagagcagtgatgacatgaactacggcacccccatctcctatgctgtggacaatggaagtgacaacaccctgctgctgacagactacaacggctgggtgctgtatgtgaatggccgggagaagatcaccaactgccccagcgtgaatgatggccgctggcaccacatcgccatcacctggaccagcgccaacggcatctggaaggtgtacattgatggcaagctgagtgatggaggagctggcctgtctgtgggcctgcccatccctgggggcggggccctggtgctgggccaggagcaggacaagaagggggagggcttctccccagctgagagctttgtgggcagcatcagccagctgaacctgtgggactatgtgctgagcccccagcaggtgaagagcctggccaccagctgcccagaggagctgagcaaaggaaatgtgctggcctggccagacttcctgagcggcatcgtgggcaaggtgaagattgacagcaagagcatcttctgcagcgactgcccccggctgggcggctctgtgccccacctgaggacagccagcgaggacctgaagccaggcagcaaggtgaacctcttctgtgaccccggcttccagctggtgggcaaccctgtgcagtactgcctgaaccagggccagtggacccagcccctgccccactgtgagcgcatcagctgtggggtgcccccacccctggagaatggcttccacagcgcagatgacttctacgccggcagcacagtgacctaccagtgcaacaacggctactacctgctgggggacagcaggatgttctgcacagacaatggctcctggaatggagtgagccccagctgcctggatgtggatgaatgtgctgtgggcagtgactgcagcgagcacgccagctgcctgaatgtggatggcagctacatctgcagctgtgtgcccccctacacaggagatggcaagaactgtgccgagcccatcaagtgcaaggcccctggcaacccagaaaatggccacagcagcggggagatctacacagtgggcgctgaggtgaccttcagctgccaggagggctaccagctgatgggcgtgaccaagatcacctgcctggagagcggggagtggaaccacctgatcccctactgcaaggctgtgtcctgtgggaagccagccatcccagaaaatggctgcatcgaggagctggccttcaccttcggcagcaaggtgacctaccgctgcaacaagggctacaccctggccggggacaaggagagcagctgcctggccaacagctcctggagccacagcccccctgtgtgtgagcctgtgaagtgcagcagccctgagaacatcaacaacgggaagtacatcctgagcggcctgacctacctgagcacagccagctacagctgtgacaccggctacagcctgcagggccccagcatcattgaatgtacagccagcggcatctgggaccgggcccccccagcctgccacctggtgttctgtggggagcccccagccatcaaggatgctgtgatcaccggcaacaacttcaccttcaggaacacagtgacctacacctgcaaggagggctacaccctggccggcctggacaccattgaatgtctggctgatggcaagtggagcagaagtgaccagcagtgcctggccgtgtcctgtgatgagccccccatcgtggaccacgccagccctgagacagcccaccggctgtttggagacatcgccttctactactgcagtgatggctacagcctggccgacaacagccagctgctgtgcaatgcccagggcaagtgggtgcccccagagggccaggacatgccccgctgcatcgcccacttctgtgagaagcccccatctgtgtcctacagcatcctggagagcgtgtccaaggccaagtttgctgctggctctgtggtgtccttcaagtgcatggagggctttgtgctgaacaccagcgccaagattgagtgcatgaggggcggccagtggaaccccagccccatgagcatccagtgcatccctgtgcgctgtggggagccccccagcatcatgaatggctacgccagcggcagcaactacagctttggagccatggtggcctacagctgcaacaagggcttctacatcaagggggagaagaagagcacctgtgaggccaccggccagtggagcagccccatccccacctgccaccctgtgtcctgtggggagccccccaaggtggagaatggcttcctggagcacaccaccggccgcatctttgagagcgaggtgcgctaccagtgcaaccctggctacaagtctgtgggcagccctgtgtttgtgtgccaggccaacagacactggcacagcgagagccccctgatgtgtgtgcccctggactgtgggaagcccccacccatccagaatggcttcatgaagggagaaaattttgaggtgggcagcaaggtgcagttcttctgcaatgaaggctatgagctggtgggggacagctcctggacctgccagaagagcggcaagtggaacaagaagagcaaccccaagtgcatgcctgccaagtgcccagagccccccctgctggagaaccagctggtgctgaaggagctgaccacagaggtgggcgtggtgaccttcagctgcaaggagggccacgtgctgcagggccccagcgtgctgaagtgcctgcccagccagcagtggaatgacagcttccctgtgtgcaagatcgtgctgtgcaccccacctcctctcatcagctttggagtgcccatccccagcagcgccctgcacttcggcagcacagtgaagtacagctgtgtgggcggcttcttcctgcggggcaacagcaccaccctgtgccagccagatggcacctggagcagccccctgcctgaatgtgtgcctgtggagtgcccccagcctgaggagatccccaacggcatcattgatgtgcagggcctggcctacctgagcacagccctgtacacctgcaagccaggctttgagctggtgggcaacaccaccaccctgtgtggagaaaatggccactggctgggcggcaagcccacctgcaaggccatcgagtgcctgaagcccaaggagatcctgaatggcaagttctcctacacagacctgcactacggccagacagtgacctacagctgcaacagaggcttccggctggagggccccagcgccctgacctgcctggagaccggggactgggatgtggatgcccccagctgcaatgccatccactgtgacagcccccagcccattgaaaatggatttgtggagggcgctgactacagctatggagccatcatcatctacagctgcttccctggcttccaggtggccggccacgccatgcagacctgtgaggagagcggctggagcagcagcatccccacctgcatgcccatcgactgtggcctgcccccccacatcgactttggagactgcaccaagctgaaggatgaccagggctactttgagcaggaggatgacatgatggaggtgccctacgtgaccccccaccccccctaccacctgggcgctgtggccaagacctgggagaacaccaaggagagccctgccacccacagcagcaacttcctgtatggcaccatggtgtcctacacctgcaaccctggctatgagctgctgggcaaccctgtgctgatctgccaggaggatggcacctggaatggaagtgcccccagctgcatcagcattgaatgtgacctgcccacagccccagaaaatggcttcctgcgcttcacagagacctccatgggcagcgctgtgcagtacagctgcaagccaggccacatcctggccggcagtgacctgcggctgtgcctggagaacaggaagtggagcggggccagcccccgctgtgaggccatcagctgcaagaagcccaaccctgtgatgaatggcagcatcaagggcagcaactacacctacctgagcaccctgtactatgaatgtgaccccggctacgtgctgaatggaacagaaagaaggacctgccaggatgacaagaactgggatgaagatgagcccatctgcatccctgtggactgcagcagcccccctgtgtctgccaacggccaggtgagaggagatgagtacaccttccagaaggagattgagtacacctgcaatgaaggcttcctgctggagggcgcccggagccgggtgtgcctggccaacggctcctggagcggggccaccccagactgtgtgcctgtgcgctgtgccaccccaccccagctggccaacggggtgacagagggcctggactatggcttcatgaaggaggtgaccttccactgccacgagggctacatcctgcatggagcccccaagctgacctgccagagtgatggcaactgggatgctgagatccccctgtgcaagcctgtgaactgtggccccccagaggacctggcccacggcttccccaacggcttctccttcatccacggcggccacatccagtaccagtgcttccctggctacaagctgcacggcaacagcagccgccgctgcctgagcaatggctcctggagcggcagcagccccagctgcctgccctgccgctgcagcacccctgtgattgaatatggaacagtgaatggaacagactttgactgtgggaaggccgcccgcatccagtgcttcaagggcttcaagctgctgggcctgtctgagatcacctgtgaggctgatggccagtggagcagcggcttcccccactgtgagcacaccagctgtggcagcctgcccatgatccccaatgccttcatcagcgagaccagctcctggaaggaaaatgtcatcacctacagctgccgcagcggctacgtgatccagggcagcagtgacctgatctgcacagagaagggcgtgtggagccagccctaccctgtgtgtgagcccctgagctgtggcagcccccccagcgtggccaatgctgtggccactggagaggcccacacctatgaaagtgaggtgaagctgcgctgcctggagggctacaccatggacacagacacagacaccttcacctgccagaaggatggccgctggttccctgagcgcatcagctgcagccccaagaagtgccccctgcctgagaacatcacccacatcctggtgcatggagatgacttctctgtgaaccggcaggtgtctgtgtcctgtgccgagggctacacctttgagggcgtgaacatctctgtgtgccagctggatggcacctgggagccccccttcagtgatgagagctgcagccctgtgtcctgtgggaagccagagagccctgagcacggctttgtggtgggcagcaagtacacctttgagagcaccatcatctaccagtgtgagcccggctatgagctggagggcaaccgggagcgggtgtgccaggagaaccggcagtggagcggaggagtggccatctgcaaggagacccgctgtgagacccccctggagttcctgaatggcaaggctgacatcgagaacagaaccaccggccccaacgtggtgtacagctgcaacagaggctacagcctggagggccccagcgaggcccactgcacagaaaatggcacctggagccaccctgtgcccctgtgcaagcccaacccctgccctgtgcccttcgtcatcccagaaaatgccctgctgtctgagaaggagttctacgtggaccagaatgtgtccatcaagtgccgggagggcttcctgctgcagggccacggcatcatcacctgcaacccagatgagacctggacccagaccagcgccaagtgtgagaagatcagctgtggccccccagcccacgtggagaatgccatcgcccggggcgtgcactaccagtatggagacatgatcacctacagctgctacagcggctacatgctggagggcttcctgcggtctgtgtgcctggagaatggcacctggaccagcccccccatctgcagagctgtgtgccgcttcccctgccagaatggaggcatctgccagaggcccaatgcctgcagctgcccagagggctggatgggccgcctgtgtgaggagcccatctgcatcctgccctgcctgaatggaggccgctgtgtggccccctaccagtgtgactgccccccaggctggacaggcagccgctgccacacagctgtgtgccagagcccctgcctgaatggaggaaaatgtgtgcggcccaaccgctgccactgcctgagctcctggacaggccacaactgcagcaggaagagaagaacaggcttctag

SEQ ID NO: 172129 - DNA, 10716 bp, Artificial Sequence
  Description of Artificial Sequence: Synthetic coding sequence
atgtggccccggctggccttctgctgctggggcctggccctggtgtctggctgggccaccttccagcagatgagccccagcaggaacttctccttccgcctcttccctgagacagcccctggggcccctggcagcatcccagcccccccagcccctggagatgaggccgccggcagccgggtggagcggctgggccaggccttcagaagaagagtgcggctgctgcgggagctgtctgagcggctggagctggtgttcctggtggatgacagcagctctgtgggggaggtgaacttccgctctgagctgatgtttgtgaggaagctgctgagtgacttccctgtggtgcccacagccaccagggtggccatcgtgaccttcagcagcaagaactacgtggtgccccgggtggactacatcagcacccggcgggcccggcagcacaagtgtgccctgctgctgcaggagatcccagccatctcctaccggggcggcggcacctacaccaagggggccttccagcaggccgcccagatcctgctgcacgcccgggagaacagcaccaaggtggtgttcctgatcacagatggctacagcaatggaggagacccccggcccatcgccgccagcctgcgggacagcggcgtggagatcttcaccttcggcatctggcagggcaacatccgggagctgaatgacatggccagcacccccaaggaggagcactgctacctgctgcacagctttgaggagtttgaggccctggcccggcgggccctgcacgaggacctgcccagcggcagcttcatccaggatgacatggtgcactgcagctacctgtgtgatgagggcaaggactgctgtgacaggatgggcagctgcaagtgtggcacccacacaggccactttgagtgcatctgtgagaagggctactacggcaagggcctgcagtatgaatgtacagcctgccccagcggcacctacaagccagagggcagccctgggggcatcagcagctgcatcccctgcccagatgagaaccacaccagccccccaggcagcaccagccctgaggactgtgtgtgccgggagggctaccgggccagcggccagacctgtgagctggtgcactgcccagccctgaagcccccagaaaatggctacttcatccagaacacctgcaacaaccacttcaatgctgcctgtggggtgcgctgccaccctggctttgacctggtgggcagcagcatcatcctgtgcctgcccaacggcctgtggagcggcagcgagagctactgccgggtgaggacctgcccccacctgcggcagcccaagcacggccacatcagctgcagcacccgggagatgctgtacaagaccacctgcctggtggcctgtgatgagggctaccgcctggagggcagtgacaagctgacctgccagggcaacagccagtgggatggccctgagccccgctgtgtggagcggcactgcagcaccttccagatgcccaaggatgtgatcatcagcccccacaactgtgggaagcagcctgccaagtttggcaccatctgctacgtgtcctgccggcagggcttcatcctgagcggcgtgaaggagatgctgcgctgcaccaccagcggcaagtggaatgtgggcgtgcaggccgctgtgtgcaaggatgtggaggccccccagatcaactgccccaaggacatcgaggccaagaccctggagcagcaggacagcgccaacgtgacctggcagatccccacagccaaggacaacagcggggagaaggtgtctgtgcacgtgcacccagccttcaccccaccctacctgttccccatcggagatgtggccatcgtgtacacagccacagacctgagcggcaaccaggccagctgcatcttccacatcaaggtgattgatgctgagccccctgtgattgactggtgccgcagccccccacctgtgcaggtgtctgagaaggtgcatgctgcctcctgggatgagccccagttcagtgacaacagcggggctgagctggtgatcaccaggagccacacccagggcgacctcttcccccagggcgagaccatcgtgcagtacacagccacagaccccagcggcaacaacagaacctgtgacatccacatcgtcatcaagggcagcccctgtgagatccccttcacccctgtgaatggagacttcatctgcaccccagacaacacaggagtgaactgcaccctgacctgcctggagggctatgacttcacagagggcagcacagacaagtactactgtgcctatgaagatggagtgtggaagcccacctacaccacagagtggccagactgtgccaagaagagatttgccaaccacggcttcaagagctttgagatgttctacaaggccgcccgctgtgatgacacagacctgatgaagaagttcagcgaggcctttgagaccaccctgggcaagatggtgcccagcttctgcagtgatgctgaggacatcgactgccgcctggaggagaacctgaccaagaagtactgcctggagtacaactatgactatgaaaatggatttgccatcggccctgggggctggggcgccgccaaccggctggactacagctatgatgacttcctggacacagtgcaggagacagccaccagcattggaaatgccaagagcagccgcatcaagaggtctgcccccctgagtgactacaagatcaagctgatcttcaacatcacagcctctgtgcccctgcctgatgaaagaaatgacaccctggagtgggagaaccagcagaggctgctgcagaccctggagaccatcaccaacaagctgaagaggaccctgaacaaggaccccatgtacagcttccagctggccagcgagatcctgattgctgacagcaacagcctggagaccaagaaggccagccccttctgccggcccggctctgtgctgcggggccgcatgtgtgtgaactgccccctgggcacctactacaacctggagcacttcacctgtgagagctgccgcatcggcagctaccaggatgaggagggccagctggagtgcaagctgtgccccagcggcatgtacacagagtacatccacagcaggaacatcagtgactgcaaggcccagtgcaagcagggcacctacagctacagcggcctggagacctgtgagagctgccccctgggcacctaccagcccaagtttggcagccgcagctgcctgagctgcccagagaacaccagcacagtgaagagaggagctgtgaacatcagcgcctgtggggtgccctgcccagagggcaagttcagccgcagcggcctgatgccctgccacccctgcccccgggactactaccagcccaatgccggcaaggccttctgcctggcctgccccttctacggcaccaccccatttgctggcagccgcagcatcacagaatgtagcagcttcagcagcaccttctctgctgctgaggagagcgtggtgcccccagccagcctgggccacatcaagaagagacatgagatcagcagccaggtgttccacgagtgcttcttcaacccctgccacaacagcggcacctgccagcagctgggccggggctacgtgtgcctgtgccccctgggctacacaggcctgaagtgtgaaacagacattgatgagtgcagccccctgccctgcctgaacaatggagtgtgcaaggacctggtgggggagttcatctgtgagtgccccagcggctacacaggccagagatgtgaggagaacatcaatgaatgtagcagcagcccctgcctgaacaagggcatctgtgtggatggagtggccggctaccgctgcacctgtgtgaagggctttgtgggcctgcactgtgaaacagaggtgaatgaatgccagagcaacccctgcctgaacaatgctgtgtgtgaggaccaggtgggcggcttcctgtgcaagtgccccccaggcttcctgggcacccgctgtgggaagaatgtggatgagtgcctgagccagccctgcaagaatggagccacctgcaaggatggagccaacagcttccgctgcctgtgtgccgccggcttcaccggcagccactgtgagctgaacatcaatgaatgccagagcaacccctgcaggaaccaggccacctgtgtggatgagctgaacagctacagctgcaagtgccagcccggcttcagcggcaagagatgtgaaacagagcagagcacaggcttcaacctggactttgaggtgtctggcatctacggctacgtgatgctggatggcatgctgcccagcctgcacgccctgacctgcaccttctggatgaagagcagtgatgacatgaactacggcacccccatctcctatgctgtggacaatggaagtgacaacaccctgctgctgacagactacaacggctgggtgctgtatgtgaatggccgggagaagatcaccaactgccccagcgtgaatgatggccgctggcaccacatcgccatcacctggaccagcgccaacggcatctggaaggtgtacattgatggcaagctgagtgatggaggagctggcctgtctgtgggcctgcccatccctgggggcggggccctggtgctgggccaggagcaggacaagaagggggagggcttcagccctgctgagagctttgtgggcagcatcagccagctgaacctgtgggactatgtgctgagcccccagcaggtgaagagcctggccaccagctgcccagaggagctgagcaaaggaaatgtgctggcctggccagacttcctgtctggaattgtgggcaaggtgaagattgacagcaagagcatcttctgcagcgactgcccccggctgggcggctctgtgccccacctgaggacagccagcgaggacctgaagccaggcagcaaggtgaacctcttctgtgaccccggcttccagctggtgggcaaccctgtgcagtactgcctgaaccagggccagtggacccagcccctgccccactgtgagcgcatcagctgtggggtgcccccacccctggagaatggcttccacagcgcagatgacttctacgccggcagcacagtgacctaccagtgcaacaacggctactacctgctgggggacagcaggatgttctgcacagacaatggctcctggaatggagtgagccccagctgcctggatgtggatgaatgtgctgtgggcagtgactgcagcgagcacgccagctgcctgaatgtggatggcagctacatctgcagctgtgtgcccccctacacaggagatggcaagaactgtgccgagcccatcaagtgcaaggcccctggcaacccagaaaatggccacagcagtggagagatctacacagtgggcgctgaggtgaccttcagctgccaggagggctaccagctgatgggcgtgaccaagatcacctgcctggagagcggggagtggaaccacctgatcccctactgcaaggctgtgtcctgtgggaagccagccatcccagaaaatggctgcatcgaggagctggccttcaccttcggcagcaaggtgacctaccgctgcaacaagggctacaccctggccggggacaaggagagcagctgcctggccaacagctcctggagccacagcccccctgtgtgtgagcctgtgaagtgcagcagccctgagaacatcaacaacgggaagtacatcctgagcggcctgacctacctgagcacagccagctacagctgtgacaccggctacagcctgcagggccccagcatcatcgagtgcacagccagcggcatctgggaccgggcccccccagcctgccacctggtgttctgtggggagcccccagccatcaaggatgctgtgatcactggaaacaacttcaccttcaggaacacagtgacctacacctgcaaggagggctacaccctggccggcctggacaccatcgagtgcctggctgatggcaagtggagcagaagtgaccagcagtgcctggccgtgtcctgtgatgagccccccatcgtggaccacgccagccctgagacagcccaccggctgtttggagacatcgccttctactactgcagtgatggctacagcctggccgacaacagccagctgctgtgcaatgcccagggcaagtgggtgcccccagagggccaggacatgccccgctgcatcgcccacttctgtgagaagccacccagcgtgtcctacagcatcctggagagcgtgtccaaggccaagtttgctgctggctctgtggtgtccttcaagtgcatggagggctttgtgctgaacaccagcgccaagattgagtgcatgagaggaggccagtggaaccccagccccatgagcatccagtgcatccctgtgcgctgtggggagcccccatccatcatgaatggctacgccagcggcagcaactacagctttggagccatggtggcctacagctgcaacaagggcttctacatcaagggggagaagaagagcacctgtgaggccaccggccagtggagcagccccatccccacctgccaccctgtgtcctgtggggagccccccaaggtggagaatggcttcctggagcacaccaccggccgcatctttgaaagtgaggtgcgctaccagtgcaaccctggctacaagtctgtgggcagccctgtgtttgtgtgccaggccaacagacactggcacagcgagagccccctgatgtgtgtgcccctggactgtgggaagcccccacccatccagaatggcttcatgaagggggagaactttgaggtgggcagcaaggtgcagttcttctgcaatgaaggctatgagctggtgggggacagctcctggacctgccagaagagcggcaagtggaacaagaagagcaaccccaagtgcatgcctgccaagtgcccagagccccccctgctggagaaccagctggtgctgaaggagctgaccacagaggtgggcgtggtgaccttcagctgcaaggagggccacgtgctgcagggccccagcgtgctgaagtgcctgcccagccagcagtggaatgacagcttccctgtgtgcaagatcgtgctgtgcaccccaccacccctcatcagctttggagtgcccatccccagcagcgccctgcacttcggcagcacagtgaagtacagctgtgtgggcggcttcttcctgcggggcaacagcaccaccctgtgccagccagatggcacctggagcagccccctgcctgaatgtgtgcctgtggagtgcccccagcctgaggagatccccaacggcatcattgatgtgcagggcctggcctacctgagcacagccctgtacacctgcaagccaggctttgagctggtgggcaacaccaccaccctgtgtggggagaatggccactggctgggcggcaagcccacctgcaaggccattgaatgtctgaagcccaaggagatcctgaatggcaagttctcctacacagacctgcactacggccagacagtgacctacagctgcaacagaggcttccggctggagggccccagcgccctgacctgcctggagactggagactgggatgtggatgcccccagctgcaatgccatccactgtgacagcccccagcccattgaaaatggatttgtggagggcgctgactacagctatggagccatcatcatctacagctgcttccctggcttccaggtggccggccacgccatgcagacctgtgaggagagcggctggagcagcagcatccccacctgcatgcccatcgactgtggcctgcccccccacatcgactttggagactgcaccaagctgaaggatgaccagggctactttgagcaggaggatgacatgatggaggtgccctacgtgaccccccaccccccctaccacctgggcgctgtggccaagacctgggagaacaccaaggagagccctgccacccacagcagcaacttcctgtatggcaccatggtgtcctacacctgcaaccctggctatgagctgctgggcaaccctgtgctgatctgccaggaggatggcacctggaatggcagcgcccccagctgcatcagcattgaatgtgacctgcccacagccccagaaaatggcttcctgcgcttcacagagacctccatgggcagcgctgtgcagtacagctgcaagccaggccacatcctggccggcagtgacctgcggctgtgcctggagaacaggaagtggagcggggccagcccccgctgtgaggccatcagctgcaagaagcccaaccctgtgatgaatggcagcatcaagggcagcaactacacctacctgagcaccctgtactatgaatgtgaccccggctacgtgctgaatggaacagagaggaggacctgccaggatgacaagaactgggatgaagatgagcccatctgcatccctgtggactgcagcagcccccctgtgtctgccaacggccaggtgagaggagatgagtacaccttccagaaggagattgagtacacctgcaatgaaggcttcctgctggagggcgcccggagccgggtgtgcctggccaacggctcctggagcggggccaccccagactgtgtgcctgtgcgctgtgccaccccaccccagctggccaatggagtgacagagggcctggactatggcttcatgaaggaggtgaccttccactgccacgagggctacatcctgcacggggcccccaagctgacctgccagagtgatggcaactgggatgctgagatccccctgtgcaagcctgtgaactgtggccccccagaggacctggcccacggcttccccaacggcttctccttcatccatggaggccacatccagtaccagtgcttccctggctacaagctgcacggcaacagcagccgccgctgcctgagcaatggctcctggagcggcagcagccccagctgcctgccctgccgctgcagcacccctgtgattgaatatggcaccgtgaatggaacagactttgactgtgggaaggccgcccgcatccagtgcttcaagggcttcaagctgctgggcctgtctgagatcacctgtgaggctgatggccagtggagcagcggcttcccccactgtgagcacaccagctgtggcagcctgcccatgatccccaatgccttcatcagcgagaccagctcctggaaggaaaatgtcatcacctacagctgccgcagcggctacgtgatccagggcagcagtgacctgatctgcacagagaagggcgtgtggagccagccctaccctgtgtgtgagcccctgagctgtggcagccccccatctgtggccaatgctgtggccaccggggaggcccacacctatgagagcgaggtgaagctgcgctgcctggagggctacaccatggacacagacacagacaccttcacctgccagaaggatggccgctggttccctgagcgcatcagctgcagccccaagaagtgccccctgcctgagaacatcacccacatcctggtgcatggagatgacttctctgtgaaccggcaggtgtctgtgtcctgtgccgagggctacacctttgaaggagtgaacatctctgtgtgccagctggatggcacctgggagccccccttcagtgatgagagctgcagccctgtgtcctgtgggaagccagagagccctgagcacggctttgtggtgggcagcaagtacacctttgagagcaccatcatctaccagtgtgagcccggctatgagctggagggcaaccgggagcgggtgtgccaggagaaccggcagtggagcggcggcgtggccatctgcaaggagacccgctgtgagacccccctggagttcctgaatggcaaggctgacattgaaaatagaaccaccggccccaacgtggtgtacagctgcaacagaggctacagcctggagggccccagcgaggcccactgcacagaaaatggcacctggagccaccctgtgcccctgtgcaagcccaacccctgccctgtgccctttgtgatcccagaaaatgccctgctgtctgagaaggagttctacgtggaccagaatgtgtccatcaagtgccgggagggcttcctgctgcagggccacggcatcatcacctgcaacccagatgagacctggacccagaccagcgccaagtgtgagaagatcagctgtggccccccagcccacgtggagaatgccatcgcccggggcgtgcactaccagtacggggacatgatcacctacagctgctacagcggctacatgctggagggcttcctgcggtctgtgtgcctggagaatggcacctggaccagcccccccatctgcagagctgtgtgccgcttcccctgccagaatggaggcatctgccagaggcccaatgcctgcagctgcccagagggctggatgggccgcctgtgtgaggagcccatctgcatcctgccctgcctgaatggaggccgctgtgtggccccctaccagtgtgactgccccccaggctggacaggcagccgctgccacacagctgtgtgccagagcccctgcctgaatggaggaaaatgtgtgcggcccaaccgctgccactgcctgagctcctggacaggccacaactgcagcaggaagagaagaacaggcttctag

SEQ ID NO: 172130 - DNA, 1356 bp, Artificial Sequence
  Description of Artificial Sequence: Synthetic coding sequence
atggactttgatgtgggccgcaccacccacctgagcagcagcccctgcagcgccagcaatggaggagagagcggccaggtgtccaagaggcgctgcctgattggagagagcggccatgacaccccctggtgcagccccatcaaggtgaagtatggagatgtgtactgccgggccccccagggcggctactacaagacagccctgggcacccgctgtgacatccgctgccagaagggctatgagctgcacggcagcagcctgctgatctgccagagcaacaagcgctggagcgacaaggtgatctgcaagcagaagcgctgccccaccctggccatgcctgccaatggaggcttcaagtgtgtggatggagcctacttcaacagccgctgtgagtactactgcagccctggctacaccctgaagggggagaggacagtgacctgcatggacaacaaggcctggagcggccggcctgccagctgtgtggacatggagcccccacgcatcaagtgccccagcgtgaaggagagaattgctgagcccaacaagctgactgtgcgggtgtcctgggagaccccagagggccgggacacagcagatggcatcctgacagatgtgatcctgaagggcctgcccccaggcagcaacttccctgagggggaccacaagatccagtacacagtgtatgacagagcagaaaataaaggcacctgcaagttccgggtgaaggtgcgggtgaagagatgtgggaagctgaatgccccagaaaatggctacatgaagtgcagcagtgatggagacaactatggagccacctgtgagttcagctgcatcggcggctatgagctgcagggcagccctgcccgggtgtgccagagcaacctggcctggagcggcacagagcccacctgtgccgccatgaatgtgaatgtgggcgtgaggacagctgctgccctgctggaccagttctatgagaagaggcggctgctgattgtgtccacccccacagccaggaacctgctgtaccgcctgcagctgggcatgctgcagcaggcccagtgtggcctggacctgcggcacatcaccgtggtggagctggtgggcgtcttccccaccctcatcggcagaattggagccaagatcatgcccccagccctggccctgcagctgcggctgctgctgcgcatccccctgtacagcttctccatggtgctggtggacaagcacggcatggacaaggagcgctacgtgtccctggtgatgcctgtggccctcttcaacctgattgacaccttccccctgaggaaggaggagatggtgctgcaggccgagatgagccagacctgcaacacctag

SEQ ID NO: 172131 - DNA, 1395 bp, Artificial Sequence
  Description of Artificial Sequence: Synthetic coding sequence
atgggcagccctgcccacaggcctgccctgctgctgctgctgccccccctgctgctgctgctgctgctgcgggtgccccccagccgctccttccctggcagcggggacagccccctggaggatgatgaggtgggctacagccacccccgctacaaggacaccccctggtgcagccccatcaaggtgaagtatggagatgtgtactgccgggccccccagggcggctactacaagacagccctgggcacccgctgtgacatccgctgccagaagggctatgagctgcacggcagcagcctgctgatctgccagagcaacaagcgctggagcgacaaggtgatctgcaagcagaagcgctgccccaccctggccatgcctgccaacggcggcttcaagtgtgtggatggagcctacttcaacagccgctgtgagtactactgcagccctggctacaccctgaagggggagaggacagtgacctgcatggacaacaaggcctggagcggccgcccagccagctgtgtggacatggagcccccacgcatcaagtgccccagcgtgaaggagagaattgctgagcccaacaagctgactgtgcgggtgtcctgggagaccccagagggccgggacacagcagatggcatcctgacagatgtgatcctgaagggcctgcccccaggcagcaacttccctgagggggaccacaagatccagtacacagtgtatgacagagctgagaacaagggcacctgcaagttccgggtgaaggtgcgggtgaagagatgtgggaagctgaatgccccagaaaatggctacatgaagtgcagcagtgatggagacaactacggggccacctgtgagttcagctgcattggaggctatgagctgcagggcagccctgcccgggtgtgccagagcaacctggcctggagcggcacagagcccacctgtgccgccatgaatgtgaatgtgggcgtgaggacagctgctgccctgctggaccagttctatgagaagaggcggctgctgattgtgtccacccccacagccaggaacctgctgtaccgcctgcagctgggcatgctgcagcaggcccagtgtggcctggacctgcggcacatcaccgtggtggagctggtgggcgtcttccccaccctgattggccgcatcggggccaagatcatgcccccagccctggccctgcagctgcggctgctgctgcgcatccccctgtacagcttctccatggtgctggtggacaagcacggcatggacaaggagagatatgtgtccctggtgatgcctgtggccctcttcaacctgattgacaccttccccctgaggaaggaggagatggtgctgcaggccgagatgagccagacctgcaacacctag

SEQ ID NO: 172132 - DNA, 1218 bp, Artificial Sequence
  Description of Artificial Sequence: Synthetic coding sequence
atgggcagccctgcccacaggcctgccctgctgctgctgctgccccccctgctgctgctgctgctgctgcgggtgccccccagccgctccttccctggcagcggggacagccccctggaggatgatgaggtgggctacagccacccccgctacaaggacaccccctggtgcagccccatcaaggtgaagtatggagatgtgtactgccgggccccccagggcggctactacaagacagccctgggcacccgctgtgacatccgctgccagaagggctatgagctgcacggcagcagcctgctgatctgccagagcaacaagcgctggagcgacaaggtgatctgcaagcacatggagcccccacgcatcaagtgccccagcgtgaaggagagaattgctgagcccaacaagctgactgtgcgggtgtcctgggagaccccagagggccgggacacagcagatggcatcctgacagatgtgatcctgaagggcctgcccccaggcagcaacttccctgagggggaccacaagatccagtacacagtgtatgacagagcagaaaataaaggcacctgcaagttccgggtgaaggtgcgggtgaagagatgtgggaagctgaatgccccagaaaatggctacatgaagtgcagcagtgatggagacaactatggagccacctgtgagttcagctgcatcggcggctatgagctgcagggcagccctgcccgggtgtgccagagcaacctggcctggagcggcacagagcccacctgtgccgccatgaatgtgaatgtgggcgtgaggacagctgctgccctgctggaccagttctatgagaagaggcggctgctgattgtgtccacccccacagccaggaacctgctgtaccgcctgcagctgggcatgctgcagcaggcccagtgtggcctggacctgcggcacatcaccgtggtggagctggtgggcgtcttccccaccctcatcggcagaattggagccaagatcatgcccccagccctggccctgcagctgcggctgctgctgcgcatccccctgtacagcttctccatggtgctggtggacaagcacggcatggacaaggagcgctacgtgtccctggtgatgcctgtggccctcttcaacctgattgacaccttccccctgaggaaggaggagatggtgctgcaggccgagatgagccagacctgcaacacctag

SEQ ID NO: 172133 - DNA, 1140 bp, Artificial Sequence
  Description of Artificial Sequence: Synthetic coding sequence
atgggcagccctgcccacaggcctgccctgctgctgctgctgccccccctgctgctgctgctgctgctgcgggtgccccccagccgctccttccctggcagcggggacagccccctggaggatgatgaggtgggctacagccacccccgctacaaggacaccccctggtgcagccccatcaaggtgaagtatggagatgtgtactgccgggccccccagggcggctactacaagacagccctgggcacccgctgtgacatccgctgccagaagggctatgagctgcacggcagcagcctgctgatctgccagagcaacaagcgctggagcgacaaggtgatctgcaagcagaagcgctgccccaccctggccatgcctgccaacggcggcttcaagtgtgtggatggagcctacttcaacagccgctgtgagtactactgcagccctggctacaccctgaagggggagaggacagtgacctgcatggacaacaaggcctggagcggccgcccagccagctgtgtggacatggagcccccacgcatcaagtgccccagcgtgaaggagagaattgctgagcccaacaagctgactgtgcgggtgtcctgggagaccccagagggccgggacacagcagatggcatcctgacagatgtgatcctgaagggcctgcccccaggcagcaacttccctgagggggaccacaagatccagtacacagtgtatgacagagctgagaacaagggcacctgcaagttccgggtgaaggtgcgggtgaagagatgtgggaagctgaatgccccagaaaatggctacatgaagtgcagcagtgatggagacaactacggggccacctgtgagttcagctgcattggaggctatgagctgcagggcagccctgcccgggtgtgccagagcaacctggcctggagcggcacagagcccacctgtgccgccatgaatgtgaatgtgggcgtgaggacagctgctgccctgctggaccagttctatgagaagaggcggctgctgattgtgtccacccccacagccaggaacctgctgtaccgcctgcagctgggcatgctgcaggccgtggccgccaaccccaccctgctgctgcagtatggagccagcggctag

SEQ ID NO: 172134 - DNA, 1335 bp, Artificial Sequence
  Description of Artificial Sequence: Synthetic coding sequence
atgggcagccctgcccacaggcctgccctgctgctgctgctgccccccctgctgctgctgctgctgctgcgggtgccccccagccgctccttcccagacaccccctggtgcagccccatcaaggtgaagtatggagatgtgtactgccgggccccccagggcggctactacaagacagccctgggcacccgctgtgacatccgctgccagaagggctatgagctgcacggcagcagcctgctgatctgccagagcaacaagcgctggagcgacaaggtgatctgcaagcagaagcgctgccccaccctggccatgcctgccaacggcggcttcaagtgtgtggatggagcctacttcaacagccgctgtgagtactactgcagccctggctacaccctgaagggggagaggacagtgacctgcatggacaacaaggcctggagcggccgcccagccagctgtgtggacatggagcccccacgcatcaagtgccccagcgtgaaggagagaattgctgagcccaacaagctgactgtgcgggtgtcctgggagaccccagagggccgggacacagcagatggcatcctgacagatgtgatcctgaagggcctgcccccaggcagcaacttccctgagggggaccacaagatccagtacacagtgtatgacagagctgagaacaagggcacctgcaagttccgggtgaaggtgcgggtgaagagatgtgggaagctgaatgccccagaaaatggctacatgaagtgcagcagtgatggagacaactacggggccacctgtgagttcagctgcattggaggctatgagctgcagggcagccctgcccgggtgtgccagagcaacctggcctggagcggcacagagcccacctgtgccgccatgaatgtgaatgtgggcgtgaggacagctgctgccctgctggaccagttctatgagaagaggcggctgctgattgtgtccacccccacagccaggaacctgctgtaccgcctgcagctgggcatgctgcagcaggcccagtgtggcctggacctgcggcacatcaccgtggtggagctggtgggcgtcttccccaccctgattggccgcatcggggccaagatcatgcccccagccctggccctgcagctgcggctgctgctgcgcatccccctgtacagcttctccatggtgctggtggacaagcacggcatggacaaggagagatatgtgtccctggtgatgcctgtggccctcttcaacctgattgacaccttccccctgaggaaggaggagatggtgctgcaggccgagatgagccagacctgcaacacctag

SEQ ID NO: 172135 - DNA, 1398 bp, Artificial Sequence
  Description of Artificial Sequence: Synthetic coding sequence
atggccagccagctgacccagagaggagccctcttcctgctcttcttcctgaccccagctgtgacccccacctggtacgccggcagcggctactacccagatgagagctacaatgaggtgtatgcagaggaggtgccccaggccccagccctggactacagagtgccccgctggtgctacaccctgaacatccaggatggagaggccacctgctacagccccaagggcggcaactaccacagcagcctgggcacccgctgtgagctgagctgtgaccggggcttccgcctcatcggccgccgctctgtgcagtgcctgcccagccgccgctggagcggcacagcctactgccggcagatgcgctgccacgccctgcccttcatcaccagcggcacctacacctgcaccaatggagtgctgctggacagccgctgtgactacagctgcagcagcggctaccacctggagggggacaggagccgcatctgcatggaggatggccgctggagcggcggggagcctgtgtgtgtggacattgatcctcccaagatccgctgcccccacagccgggagaagatggccgagcctgagaagctgacagcccgggtgtactgggacccccccctggtgaaggacagcgcagatggcaccatcaccagggtgaccctgcggggccctgagcccggcagccacttccctgagggggagcacgtgatccgctacacagcctatgaccgggcctacaacagagccagctgcaagttcatcgtgaaggtgcaggtgcggcgctgccccaccctgaagccaccccagcacggctacctgacctgcaccagcgctggggacaactacggggccacctgtgagtaccactgtgatggcggctatgaccggcagggcacccccagccgggtgtgccagagcagccggcagtggagcggcagcccccccatctgtgcccccatgaagatcaacgtgaatgtgaacagcgctgctggcctgctggaccagttctatgagaagcagaggctgctgatcatcagcgccccagaccccagcaaccgctactacaagatgcagatctccatgctgcagcagagcacctgtggcctggacctgcggcacgtgaccatcatcgagctggtgggccagcccccccaggaggtgggccgcatccgggagcagcagctgagcgccaacatcatcgaggagctgcggcagttccagaggctgaccaggagctacttcaacatggtgctgattgacaagcagggcatcgaccgggaccgctacatggagcctgtgaccccagaggagatcttcaccttcattgatgactacctgctgagcaaccaggagctgacccagaggcgggagcagagggacatctgtgagtag

SEQ ID NO: 172136 - DNA, 1452 bp, Artificial Sequence
  Description of Artificial Sequence: Synthetic coding sequence
tgaaccttcatggtggaggatgctgtggaggccatcggctttgggaagttccagtggaagctgtctgtgctgaccggcctggcctggatggctgatgccatggagatgatgatcctgagcatcctggccccccagctgcactgtgagtggaggctgcccagctggcaggtggccctgctgacctctgtggtgtttgtgggcatgatgagcagcagcaccctgtggggcaacatcagtgaccagtatggcaggaagacaggcctgaagatctctgtgctgtggaccctgtactacggcatcctgagcgcctttgcccctgtgtacagctggatcctggtgctgcggggcctggtgggcttcggcatcggcggcgtgccccagagcgtgaccctgtatgcagagttcctgcccatgaaggcccgggccaagtgcatcctgctgattgaggtgttctgggccatcggcaccgtgtttgaggtggtgctggccgtgtttgtgatgcccagcctgggctggcgctggctgctgatcctgtctgctgtgcccctgctgctgtttgctgtgctgtgcttctggctgcctgagagcgcccgctatgatgtgctgagcggcaaccaggagaaggccatcgccaccctgaagagaattgccacagaaaatggagcccccatgcccctgggcaagctgatcatcagccggcaggaggaccggggcaagatgagggacctcttcaccccccacttccgctggaccaccctgctgctgtggttcatctggttcagcaatgccttctcctactacggcctggtgctgctgaccacagagctgttccaggccggagatgtgtgtggcatcagcagcaggaagaaggctgtggaggccaagtgcagcctggcctgtgagtacctgtctgaggaggactacatggacctgctgtggaccaccctgtctgagttccctggggtgctggtgaccctgtggatcatcgaccggctgggcaggaagaagaccatggccctgtgcttcgtcatcttctccttctgcagcctgctgctcttcatctgtgtgggcagaaatgtgctgaccctgctgctcttcatcgcccgggccttcatcagcggcggcttccaggccgcctacgtgtacaccccagaggtgtaccccacagccacccgggccctgggcctgggcacctgcagcggcatggcccgggtgggcgccctgatcacccccttcatcgcccaggtgatgctggagagctctgtgtacctgaccctggccgtgtacagcggctgctgcctgctggccgccctggccagctgcttcctgcccatcgagaccaagggccggggcctgcaggagagcagccaccgggagtggggccaggagatggtgggccggggcatgcacggggccggcgtgaccaggagcaacagcggcagccaggagtag

SEQ ID NO: 172137 - DNA, 39 bp, Artificial Sequence
  Description of Artificial Sequence: Synthetic coding sequence
atggaggaggacctcttccagctgcggcagctgccctag

SEQ ID NO: 172138 - DNA, 1023 bp, Artificial Sequence
  Description of Artificial Sequence: Synthetic coding sequence
atggctgctggccgcctcatcatcaagacagagttcctgcccaccaagtaccggggctacatgctgcccctgagccaggtgttctggctggccggcagcctgctgatcatcggcctggccagcgtcatcatccccaccatcggctggcgctggctgatccgggtggccagcatccctggcatcatcctgattgtggccttcaagttcatccctgagagcgcccgcttcaacgtgtccacaggcaacaccagggctgccctggccaccctggagcgggtggccaagatgaacagatctgtgatgcctgagggcaagctggtggagcctgtgctggagaagaggggccgctttgctgacctgctggatgccaagtacctgcggaccaccctgcagatctgggtgatctggctgggcatcagctttgcctactacggcgtcatcctggccagcgctgagctgctggagcgggacctggtgtgtggcagcaagagtgacagcgctgtggtggtgactggaggagacagcggggagagccagagcccctgctactgccacatgtttgcccccagcgactaccgcaccatgatcatcagcaccatcggggagatcgccctgaaccccctgaacatcctgggcatcaacttcctgggccggcggctgagcctgagcatcaccatgggctgcacagccctcttcttcctgctgctgaacatctgcaccagcagcgctggcctcatcggcttcctgttcatgctgcgggccctggtggccgccaacttcaacacagtgtacatctacacagctgaggtgtaccccaccaccatgagggccctgggcatgggcaccagcggcagcctgtgcagaattggagccatggtggcccccttcatcagccaggtgctgatgtctgccagcatcctgggcgccctgtgcctcttcagctctgtgtgtgtggtgtgtgccatcagcgccttcaccctgcccatcgagaccaagggccgggccctgcagcagatcaagtag

SEQ ID NO: 172139 - DNA, 1479 bp, Artificial Sequence
  Description of Artificial Sequence: Synthetic coding sequence
atggccaccaagcccacagagcctgtgaccatcctgagcctgaggaagctgagcctgggcacagctgagccccaggtgaaggagcccaagaccttcaccgtggaggatgctgtggagaccatcggcttcggccgcttccacatcgccctcttcctgatcatgggcagcactggagtggtggaggccatggagatcatgctgattgctgtggtgtcccctgtgatccgctgtgagtggcagctggagaactggcaggtggccctggtgaccaccatggtgttcttcggctacatggtgttcagcatcctgtttggcctgctggccgacagatatggccgctggaagatcctgctgatctccttcctgtggggcgcctacttcagcctgctgaccagctttgcccccagctacatctggtttgtgttcctgcggaccatggtgggctgcggcgtgtctggccacagccagggcctcatcatcaagacagagttcctgcccaccaagtaccggggctacatgctgcccctgagccaggtgttctggctggccggcagcctgctgatcatcggcctggccagcgtcatcatccccaccatcggctggcgctggctgatccgggtggccagcatccctggcatcatcctgattgtggccttcaagttcatccctgagagcgcccgcttcaacgtgtccacaggcaacaccagggctgccctggccaccctggagcgggtggccaagatgaacagatctgtgatgcctgagggcaagctggtggagcctgtgctggagaagaggggccgctttgctgacctgctggatgccaagtacctgcggaccaccctgcagatctgggtgatctggctgggcatcagctttgcctactacggcgtcatcctggccagcgctgagctgctggagcgggacctggtgtgtggcagcaagagtgacagcgctgtggtggtgactggaggagacagcggggagagccagagcccctgctactgccacatgtttgcccccagcgactaccgcaccatgatcatcagcaccatcggggagatcgccctgaaccccctgaacatcctgggcatcaacttcctgggccggcggctgagcctgagcatcaccatgggctgcacagccctcttcttcctgctgctgaacatctgcaccagcagcgctggcctcatcggcttcctgttcatgctgcgggccctggtggccgccaacttcaacacagtgtacatctacacagctgaggtgtaccccaccaccatgagggccctgggcatgggcaccagcggcagcctgtgcagaattggagccatggtggcccccttcatcagccaggtgctgatgtctgccagcatcctgggcgccctgtgcctcttcagctctgtgtgtgtggtgtgtgccatcagcgccttcaccctgcccatcgagaccaagggccgggccctgcagcagatcaagtag

SEQ ID NO: 172140 - DNA, 1023 bp, Artificial Sequence; identical to SEQ ID NO: 172138
  Description of Artificial Sequence: Synthetic coding sequence

SEQ ID NO: 172141 - DNA, 1758 bp, Artificial Sequence
  Description of Artificial Sequence: Synthetic coding sequence
atgggcagcctgaaggaggagctgctgaaggccatctggcacgccttcaccgccctggaccaggaccacagcggcaaggtgtccaagagccagctgaaggtgctgagccacaacctgtgcaccgtgctgaaggtgccccatgaccctgtggccctggaggagcacttcagagatgatgatgagggccctgtgagcaaccagggctacatgccctacctgaaccgcttcatcctggagaaggtgcaggacaactttgacaagattgagttcaacaggatgtgctggaccctgtgtgtgaagaagaacctgaccaagaaccccctgctgatcacagaagaagatgccttcaagatctgggtgatcttcaacttcctgtctgaggacaagtaccccctcatcatcgtgtctgaggagattgagtacctgctgaagaagctgacagaggccatgggcggcggctggcagcaggagcagtttgagcactacaagatcaactttgatgacagcaagaatggcctgagcgcctgggagctgattgagctgattggaaatggccagttcagcaagggcatggaccggcagacagtgtccatggccatcaatgaggtgttcaatgaactcatcctggatgtgctgaagcagggctacatgatgaagaagggccacaggaggaagaactggacagagcgctggtttgtgctgaagcccaacatcatctcctactacgtgtctgaggacctgaaggacaagaagggggacatcctgctggatgagaactgctgcgtggagagcctgcctgacaaggatggcaagaagtgcctcttcctggtgaagtgctttgacaagacctttgagatcagcgccagtgacaagaagaagaagcaggagtggatccaggccatccacagcaccatccacctgctgaagctgggcagccccccaccccacaaggaggcccggcagaggaggaaggagctgaggaagaagcagctggccgagcaggaggagctggagcggcagatgaaggagctgcaggccgccaatgaaagcaagcagcaggagctggaggccgtgaggaagaagctggaggaggccgccagcagagctgctgaggaggagaagaagaggctgcagacccaggtggagctgcaggcccgcttcagcacagagctggagcgggagaagctgatccggcagcagatggaggagcaggtggcccagaagagcagcgagctggagcagtacctgcagagggtgcgggagctggaggacatgtacctgaagctgcaggaggccctggaggatgagcggcaggcccggcaggatgaggagaccgtgaggaagctgcaggcccggctgctggaggaggagagcagcaagagagctgagctggagaagtggcacctggagcagcagcaggccatccagaccacagaggccgagaagcaggagctggagaaccagagggtgctgaaggagcaggccctgcaggaggccatggagcagctggagcagctggagctggagaggaagcaggccctggagcagtatgaggaggtgaagaagaagctggagatggccaccaacaagaccaagtcctggaaggacaaggtggcccaccacgagggcctcatccgcctcatcgagcccggcagcaagaacccccacctgatcaccaactggggccctgctgccttcacagaagctgagctggaggagcgggagaagaactggaaggagaagaagaccacagaatag

SEQ ID NO: 172142 - DNA, 3129 bp, Artificial Sequence
  Description of Artificial Sequence: Synthetic coding sequence
atggagcaggacacagctgctgtggccgccaccgtggccgctgctgatgccacagccaccatcgtggtgattgaagatgagcagcccggccccagcaccagccaggaggagggcgctgctgctgctgccacagaggccacagctgccacagagaagggggagaagaagaaggagaagaatgtgtcctccttccagctgaagctggccgccaaggcccccaagtctgagaaggagatggaccctgaatatgaggagaagatgaaggctgaccgggccaagagatttgagttcctgctgaagcagacagagctgtttgcccacttcatccagcccagcgcccagaagagccccaccagccccctgaacatgaagctgggccggccccgcatcaagaaggatgagaagcagagcctcatctctgctggggactaccgccacagaagaacagagcaggaggaggatgaggagctgctgtctgagagcaggaagaccagcaatgtgtgcatccgctttgaggtgagccccagctatgtgaagggcggccccctgcgggactaccagatccggggcctgaactggctgatcagcctgtatgaaaatggagtgaatggcatcctggctgatgagatgggcctgggcaagaccctgcagaccatcgccctgctgggctacctgaagcactacagaaacatccctggcccccacatggtgctggtgcccaagagcaccctgcacaactggatgaatgagttcaagcgctgggtgcccagcctgcgggtcatctgctttgtgggggacaaggatgcccgggccgccttcatcagagatgagatgatgcctggagagtgggatgtgtgtgtgaccagctatgagatggtgatcaaggagaagagcgtcttcaagaagttccactggagatacctggtgattgatgaggcccaccgcatcaagaatgagaagagcaagctgtctgagatcgtgcgggagttcaagagcaccaaccggctgctgctgaccggcacccccctgcagaacaacctgcacgagctgtgggccctgctgaacttcctgctgcctgatgtgttcaacagcgcagatgactttgacagctggtttgacaccaagaactgcctgggggaccagaagctggtggagcggctgcatgctgtgctgaagcccttcctgctgcggcgcatcaagacagatgtggagaagagcctgccccccaagaaggagatcaagatctacctgggcctgagcaagatgcagcgggagtggtacaccaagatcctgatgaaggacattgatgtgctgaacagcagcggcaagatggacaagatgaggctgctgaacatcctgatgcagctgaggaagtgctgcaaccacccctacctgtttgatggagctgagcccggccccccctacaccacagatgagcacatcgtgagcaacagcggcaagatggtggtgctggacaagctgctggccaagctgaaggagcagggcagccgggtgctgatcttcagccagatgacccggctgctggacatcctggaggactactgcatgtggaggggctatgagtactgccgcctggatggccagacccctcatgaggagcgggaggaggccatcgaggccttcaatgcccccaacagcagcaagttcatcttcatgctgagcacccgggccggcggcctgggcatcaacctggccagcgcagatgtggtgatcctgtatgacagcgactggaacccccaggtggacctgcaggccatggaccgggcccacagaattggccagaagaagcctgtgcgggtcttccgcctcatcacagacaacacagtggaggagcgcatcgtggagcgggcagagatcaagctgcggctggacagcatcgtcatccagcagggccgcctgattgaccagcagagcaacaagctggccaaggaggagatgctgcagatgatcagacatggagccacccacgtgtttgccagcaaggagagcgagctgacagatgaggacatcaccaccatcctggagcggggggagaagaagacagctgagatgaatgaaaggctgcagaagatgggagagagcagcctgaggaacttcaggatggacatcgagcagagcctgtacaagtttgaaggagaggactaccgggagaagcagaagctgggcatggtggagtggattgagccccccaagcgggagaggaaggccaactatgctgtggatgcctacttccgggaggccctgcgggtgtctgagcccaagatccccaaggccccccggccccccaagcagcccaacgtgcaggacttccagttcttccccccccggctgtttgagctgctggagaaggagatcctgtactacaggaagaccatcggctacaaggtgcccagaaatccagacatccccaacccagccctggcccagcgggaggagcagaagaagattgatggagctgagcccctgaccccagaggagacagaggagaaggagaagctgctgacccagggcttcaccaactggaccaagagggacttcaaccagttcatcaaggccaatgagaagtatggaagagatgacatcgacaacatcgcccgggaggtggagggcaagagccctgaggaggtgatggagtacagcgctgtgttctgggagcgctgcaatgagctgcaggacatcgagaagatcatggcccagatcgagcggggggaggcccgcatccagaggcgcatcagcatcaagaaggccctggatgccaagatcgcccgctacaaggcccccttccaccagctgcgcatccagtatggcaccagcaagggcaagaactacacagaggaggaggaccgcttcctgatctgcatgctgcacaagatgggctttgaccgggagaatgtgtatgaggagctgcggcagtgtgtgagaaatgccccccagttccgctttgactggttcatcaagagcaggacagccatggagttccagaggcgctgcaacaccctcatcagcctgattgagaaggagaacatggagattgaggagcgggagcgggcagagaagaagaagagggccaccaagacccccatggtgaagttcagcgccttctcctag

SEQ ID NO: 172143 - DNA, 3165 bp, Artificial Sequence
  Description of Artificial Sequence: Synthetic coding sequence
atggagcaggacacagctgctgtggccgccaccgtggccgctgctgatgccacagccaccatcgtggtgattgaagatgagcagcccggccccagcaccagccaggaggagggcgctgctgctgctgccacagaggccacagctgccacagagaagggggagaagaagaaggagaagaatgtgtcctccttccagctgaagctggccgccaaggcccccaagtctgagaaggagatggaccctgaatatgaggagaagatgaaggctgaccgggccaagagatttgagttcctgctgaagcagacagagctgtttgcccacttcatccagcccagcgcccagaagagccccaccagccccctgaacatgaagctgggccggccccgcatcaagaaggatgagaagcagagcctcatctctgctggggactaccgccacagaagaacagagcaggaggaggatgaggagctgctgtctgagagcaggaagaccagcaatgtgtgcatccgctttgaggtgagccccagctatgtgaagggcggccccctgcgggactaccagatccggggcctgaactggctgatcagcctgtatgaaaatggagtgaatggcatcctggctgatgagatgggcctgggcaagaccctgcagaccatcgccctgctgggctacctgaagcactacagaaacatccctggcccccacatggtgctggtgcccaagagcaccctgcacaactggatgaatgagttcaagcgctgggtgcccagcctgcgggtcatctgctttgtgggggacaaggatgcccgggccgccttcatcagagatgagatgatgcctggagagtgggatgtgtgtgtgaccagctatgagatggtgatcaaggagaagagcgtcttcaagaagttccactggagatacctggtgattgatgaggcccaccgcatcaagaatgagaagagcaagctgtctgagatcgtgcgggagttcaagagcaccaaccggctgctgctgaccggcacccccctgcagaacaacctgcacgagctgtgggccctgctgaacttcctgctgcctgatgtgttcaacagcgcagatgactttgacagctggtttgacaccaagaactgcctgggggaccagaagctggtggagcggctgcatgctgtgctgaagcccttcctgctgcggcgcatcaagacagatgtggagaagagcctgccccccaagaaggagatcaagatctacctgggcctgagcaagatgcagcgggagtggtacaccaagatcctgatgaaggacattgatgtgctgaacagcagcggcaagatggacaagatgaggctgctgaacatcctgatgcagctgaggaagtgctgcaaccacccctacctgtttgatggagctgagcccggccccccctacaccacagatgagcacatcgtgagcaacagcggcaagatggtggtgctggacaagctgctggccaagctgaaggagcagggcagccgggtgctgatcttcagccagatgacccggctgctggacatcctggaggactactgcatgtggaggggctatgagtactgccgcctggatggccagacccctcatgaggagcgggaggacaagttcctggaggtggagttcctgggccagcgggaggccatcgaggccttcaatgcccccaacagcagcaagttcatcttcatgctgagcacccgggccggcggcctgggcatcaacctggccagcgcagatgtggtgatcctgtatgacagcgactggaacccccaggtggacctgcaggccatggaccgggcccacagaattggccagaagaagcctgtgcgggtcttccgcctcatcacagacaacacagtggaggagcgcatcgtggagcgggcagagatcaagctgcggctggacagcatcgtcatccagcagggccgcctgattgaccagcagagcaacaagctggccaaggaggagatgctgcagatgatcagacatggagccacccacgtgtttgccagcaaggagagcgagctgacagatgaggacatcaccaccatcctggagcggggggagaagaagacagctgagatgaatgaaaggctgcagaagatgggagagagcagcctgaggaacttcaggatggacatcgagcagagcctgtacaagtttgaaggagaggactaccgggagaagcagaagctgggcatggtggagtggattgagccccccaagcgggagaggaaggccaactatgctgtggatgcctacttccgggaggccctgcgggtgtctgagcccaagatccccaaggccccccggccccccaagcagcccaacgtgcaggacttccagttcttccccccccggctgtttgagctgctggagaaggagatcctgtactacaggaagaccatcggctacaaggtgcccagaaatccagacatccccaacccagccctggcccagcgggaggagcagaagaagattgatggagctgagcccctgaccccagaggagacagaggagaaggagaagctgctgacccagggcttcaccaactggaccaagagggacttcaaccagttcatcaaggccaatgagaagtatggaagagatgacatcgacaacatcgcccgggaggtggagggcaagagccctgaggaggtgatggagtacagcgctgtgttctgggagcgctgcaatgagctgcaggacatcgagaagatcatggcccagatcgagcggggggaggcccgcatccagaggcgcatcagcatcaagaaggccctggatgccaagatcgcccgctacaaggcccccttccaccagctgcgcatccagtatggcaccagcaagggcaagaactacacagaggaggaggaccgcttcctgatctgcatgctgcacaagatgggctttgaccgggagaatgtgtatgaggagctgcggcagtgtgtgagaaatgccccccagttccgctttgactggttcatcaagagcaggacagccatggagttccagaggcgctgcaacaccctcatcagcctgattgagaaggagaacatggagattgaggagcgggagcgggcagagaagaagaagagggccaccaagacccccatggtgaagttcagcgccttctcctag

SEQ ID NO: 172144 - DNA, 3129 bp, Artificial Sequence; identical to SEQ ID NO: 172142
  Description of Artificial Sequence: Synthetic coding sequence

SEQ ID NO: 172145 - DNA, 3018 bp, Artificial Sequence
  Description of Artificial Sequence: Synthetic coding sequence
atggagcaggacacagctgctgtggccgccaccgtggccgctgctgatgccacagccaccatcgtggtgattgaagatgagcagcccggccccagcaccagccaggaggagaagaatgtgagcagcttccagctgaagctggccgccaaggcccccaagtctgagaaggagatggaccctgaatatgaggagaagatgaaggctgaccgggccaagagatttgagttcctgctgaagcagacagagctgtttgcccacttcatccagcccagcgcccagaagagccccaccagccccctgaacatgaagctgggccggccccgcatcaagaaggatgagaagcagagcctcatctctgctggggactaccgccacagaagaacagagcaggaggaggatgaggagctgctgtctgagagcaggaagaccagcaatgtgtgcatccgctttgaggtgagccccagctatgtgaagggcggccccctgcgggactaccagatccggggcctgaactggctgatcagcctgtatgaaaatggagtgaatggcatcctggctgatgagatgggcctgggcaagaccctgcagaccatcgccctgctgggctacctgaagcactacagaaacatccctggcccccacatggtgctggtgcccaagagcaccctgcacaactggatgaatgagttcaagcgctgggtgcccagcctgcgggtcatctgctttgtgggggacaaggatgcccgggccgccttcatcagagatgagatgatgcctggagagtgggatgtgtgtgtgaccagctatgagatggtgatcaaggagaagtctgtgttcaagaagttccactggagatacctggtgattgatgaggcccaccgcatcaagaatgagaagagcaagctgtctgaaattgtgcgggagttcaagagcaccaaccggctgctgctgaccggcacccccctgcagaacaacctgcacgagctgtgggccctgctgaacttcctgctgcctgatgtgttcaacagcgcagatgactttgacagctggtttgacaccaagaactgcctgggggaccagaagctggtggagcggctgcatgctgtgctgaagcccttcctgctgcggcgcatcaagacagatgtggagaagagcctgccccccaagaaggagatcaagatctacctgggcctgagcaagatgcagcgggagtggtacaccaagatcctgatgaaggacattgatgtgctgaacagcagcggcaagatggacaagatgaggctgctgaacatcctgatgcagctgaggaagtgctgcaaccacccctacctgtttgatggagctgagcccggccccccctacaccacagatgagcacatcgtgagcaacagcggcaagatggtggtgctggacaagctgctggccaagctgaaggagcagggcagccgggtgctgatcttcagccagatgacccggctgctggacatcctggaggactactgcatgtggaggggctatgagtactgccgcctggatggccagacccctcatgaggagcgggaggacaagttcctggaggtggagttcctgggccagcgggaggccatcgaggccttcaatgcccccaacagcagcaagttcatcttcatgctgagcaccagggctgggggcctgggcatcaacctggccagcgcagatgtggtgatcctgtatgacagcgactggaacccccaggtggacctgcaggccatggaccgggcccaccgcatcggccagaagaagcctgtgcgggtcttccgcctcatcacagacaacacagtggaggagagaattgtggagagagctgagatcaagctgcggctggacagcatcgtcatccagcagggccgcctgattgaccagcagagcaacaagctggccaaggaggagatgctgcagatgatccgccacggggccacccacgtgtttgccagcaaggagagcgagctgacagatgaggacatcaccaccatcctggagcggggggagaagaagacagctgagatgaatgaaaggctgcagaagatgggagagagcagcctgaggaacttcaggatggacatcgagcagagcctgtacaagtttgaaggagaggactaccgggagaagcagaagctgggcatggtggagtggattgagccccccaagcgggagaggaaggccaactatgctgtggatgcctacttccgggaggccctgcgggtgtctgagcccaagatccccaaggcccccaggcctcccaagcagcccaacgtgcaggacttccagttcttccccccccggctgtttgagctgctggagaaggagatcctgtactacaggaagaccatcggctacaaggtgcccaggaacccagacatccccaacccagccctggcccagcgggaggagcagaagaagattgatggagctgagcccctgaccccagaggagacagaggagaaggagaagctgctgacccagggcttcaccaactggaccaagagggacttcaaccagttcatcaaggccaatgagaagtatggaagagatgacatcgacaacatcgcccgggaggtggagggcaagagccctgaggaggtgatggagtacagcgctgtgttctgggagcgctgcaatgagctgcaggacatcgagaagatcatggcccagatcgagcggggggaggcccgcatccagaggcgcatcagcatcaagaaggccctggatgccaagatcgcccgctacaaggcccccttccaccagctgcgcatccagtatggcaccagcaagggcaagaactacacagaggaggaggaccgcttcctgatctgcatgctgcacaagatgggctttgacagagaaaatgtgtatgaggagctgcggcagtgtgtgagaaatgccccccagttccgctttgactggttcatcaagagcaggacagccatggagttccagaggcgctgcaacaccctcatcagcctcatcgagaaggagtag

SEQ ID NO: 172146 - DNA, 837 bp, Artificial Sequence
  Description of Artificial Sequence: Synthetic coding sequence
atgctgatgaagaggctggccgcccgctgctttgctggcctgctgatcctgagccccctgaccgtcatcagtgacagcaggcctgctgacagcggcaaggccattgaagatggcaacctggaggagatggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172147 - DNA, 711 bp, Artificial Sequence
  Description of Artificial Sequence: Synthetic coding sequence
atggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172148 - DNA, 4773 bp, Artificial Sequence
  Description of Artificial Sequence: Synthetic coding sequence
atgagcacccccacagatcctggggccatgccccaccctggccccagccctggccctggccccagccctggccccatcctgggccccagccctggccctggccccagccctggctctgtgcacagcatgatgggccccagccctggcccccccagcgtgagccaccccatgcccaccatgggcagcacagacttcccccaggagggcatgcaccagatgcacaagcccattgatggcatccatgacaagggcatcgtggaggacatccactgcggctccatgaagggcaccggcatgaggcctccccaccctggcatgggccccccccagagccccatggaccagcacagccagggctacatgagcccccaccccagccccctgggcgcccctgagcacgtgagcagccccatgtctgggggcggccccaccccaccccagatgccacccagccagcccggggccctgatccctggggacccccaggccatgagccagcccaacagaggccccagccccttcagccctgtgcagctgcaccagctgcgggcccagatcctggcctacaagatgctggcccggggccagcccctgcctgagaccctgcagctggccgtgcagggcaagaggaccctgcccggcctgcagcagcagcagcagcagcagcagcagcagcagcagcagcagcagcagcagcagcagcagcagcagcagccccagcagcagcccccccagccccagacccagcagcagcagcagcctgccctggtgaactacaaccggcccagcggccctggccctgagctgagcggccccagcaccccccagaagctgcctgtgcctgcccctgggggccggcccagccctgcccctcctgctgctgcccagcccccagctgctgctgtgcccggccccagcgtgccccagcctgcccctggccagcccagccctgtgctgcagctgcagcagaagcagagccgcatcagccccatccagaagccccagggcctggaccctgtggagatcctgcaggagcgggagtaccgcctgcaggcccgcatcgcccaccgcatccaggagctggagaacctgcccggcagcctgcccccagacctgcggaccaaggccaccgtggagctgaaggccctgcggctgctgaacttccagaggcagctgcggcaggaggtggtggcctgcatgagaagagacaccaccctggagacagccctgaacagcaaggcctacaagaggagcaagaggcagaccctgcgggaggccaggatgacagagaagctggagaagcagcagaagattgagcaggagaggaagaggcggcagaagcaccaggagtacctgaacagcatcctgcagcacgccaaggacttcaaggagtaccacaggtctgtggccggcaagatccagaagctgagcaaggctgtggccacctggcacgccaacacagagcgggagcagaagaaggagacagagcgcatcgagaaggagaggatgaggcggctgatggctgaagatgaggagggctacaggaagctgattgaccagaagaaggaccggcggctggcctacctgctgcagcagacagatgaatatgtggccaacctgaccaacctggtgtgggagcacaagcaggcccaggccgccaaggagaagaagaagagaagaagaaggaagaagaaggccgaggagaatgctgagggcggggagagcgccctgggcccagatggagagcccattgatgagagcagccagatgtctgacctgcctgtgaaggtgacccacacagagaccgggaaggtgctgtttggacctgaggcccccaaggccagccagctggatgcctggctggagatgaaccctggctatgaggtggcccccaggagtgacagcgaggagagtgacagcgactatgaggaggaggatgaggaggaggagagcagccggcaggagacagaggagaagatcctgctggaccccaacagcgaggaggtgtctgagaaggatgccaagcagatcatcgagacagccaagcaggatgtggatgatgagtacagcatgcagtacagcgcccggggcagccagagctactacacagtggcccacgccatcagcgagcgggtggagaagcagagcgccctgctgatcaatggcaccctgaagcactaccagctgcagggcctggagtggatggtgtccctgtacaacaacaacctgaatggcatcctggctgatgagatgggcctgggcaagaccatccagaccatcgccctgatcacctacctgatggagcacaagaggctgaatggcccctacctgatcatcgtgcccctgagcaccctgagcaactggacctatgaatttgacaagtgggcccccagcgtggtgaagatctcctacaagggcaccccagccatgagaagaagcctggtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcgcatcctgctgaccggcacccccctgcagaacaagctgcctgagctgtgggccctgctgaacttcctgctgcccaccatcttcaagagctgcagcacctttgagcagtggttcaatgccccctttgccatgaccggggagcgggtggacctgaatgaggaggagaccatcctgatcatccggcggctgcacaaggtgctgcggcccttcctgctgcggcggctgaagaaggaggtggagagccagctgcctgagaaggtggagtatgtgatcaagtgtgacatgtctgccctgcagaagatcctgtaccgccacatgcaggccaagggcatcctgctgacagatggcagcgagaaggacaagaagggcaaaggaggagccaagaccctgatgaacaccatcatgcagctgaggaagatctgcaaccacccctacatgttccagcacatcgaggagagctttgctgagcacctgggctacagcaatggagtcatcaatggagctgagctgtaccgggccagcggcaagtttgagctgctggaccgcatcctgcccaagctgcgggccaccaaccaccgggtgctgctcttctgccagatgaccagcctgatgaccatcatggaggactactttgccttcaggaacttcctgtacctgcggctggatggcaccaccaagtcagaagatcgggccgccctgctgaagaagttcaatgaacctggcagccagtacttcatcttcctgctgagcacccgggccggcggcctgggcctgaacctgcaggccgctgacacagtggtgatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggaggagaatgaggaggaggatgaggtgcctgatgatgagaccctgaaccagatgattgcccggcgggaggaggagtttgacctcttcatgaggatggacatggacagaagaagagaagatgccaggaaccccaagaggaagccccggctgatggaggaggatgagctgcccagctggatcatcaaggatgatgctgaggtggagcggctgacctgtgaggaggaggaggagaagatcttcggccggggcagccggcagaggagagatgtggactacagtgatgccctgacagagaagcagtggctgcgggccattgaagatggcaacctggaggagatggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggaccgctgcaatgtggagaaggtgcccagcaacagccagctggagattgagggcaacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172149 - DNA, 4719 bp, Artificial Sequence
  Description of Artificial Sequence: Synthetic coding sequence
atgagcacccccacagatcctggggccatgccccaccctggccccagccctggccctggccccagccctggccccatcctgggccccagccctggccctggccccagccctggctctgtgcacagcatgatgggccccagccctggcccccccagcgtgagccaccccatgcccaccatgggcagcacagacttcccccaggagggcatgcaccagatgcacaagcccattgatggcatccatgacaagggcatcgtggaggacatccactgcggctccatgaagggcaccggcatgaggcctccccaccctggcatgggccccccccagagccccatggaccagcacagccagggctacatgagcccccaccccagccccctgggcgcccctgagcacgtgagcagccccatgtctgggggcggccccaccccaccccagatgccacccagccagcccggggccctgatccctggggacccccaggccatgagccagcccaacagaggccccagccccttcagccctgtgcagctgcaccagctgcgggcccagatcctggcctacaagatgctggcccggggccagcccctgcctgagaccctgcagctggccgtgcagggcaagaggaccctgcccggcctgcagcagcagcagcagcagcagcagcagcagcagcagcagcagcagcagcagcagcagcagcagcagcagccccagcagcagcccccccagccccagacccagcagcagcagcagcctgccctggtgaactacaaccggcccagcggccctggccctgagctgagcggccccagcaccccccagaagctgcctgtgcctgcccctgggggccggcccagccctgcccctcctgctgctgcccagcccccagctgctgctgtgcccggccccagcgtgccccagcctgcccctggccagcccagccctgtgctgcagctgcagcagaagcagagccgcatcagccccatccagaagccccagggcctggaccctgtggagatcctgcaggagcgggagtaccgcctgcaggcccgcatcgcccaccgcatccaggagctggagaacctgcccggcagcctgcccccagacctgcggaccaaggccaccgtggagctgaaggccctgcggctgctgaacttccagaggcagctgcggcaggaggtggtggcctgcatgagaagagacaccaccctggagacagccctgaacagcaaggcctacaagaggagcaagaggcagaccctgcgggaggccaggatgacagagaagctggagaagcagcagaagattgagcaggagaggaagaggcggcagaagcaccaggagtacctgaacagcatcctgcagcacgccaaggacttcaaggagtaccacaggtctgtggccggcaagatccagaagctgagcaaggctgtggccacctggcacgccaacacagagcgggagcagaagaaggagacagagcgcatcgagaaggagaggatgaggcggctgatggctgaagatgaggagggctacaggaagctgattgaccagaagaaggaccggcggctggcctacctgctgcagcagacagatgaatatgtggccaacctgaccaacctggtgtgggagcacaagcaggcccaggccgccaaggagaagaagaagagaagaagaaggaagaagaaggccgaggagaatgctgagggcggggagagcgccctgggcccagatggagagcccattgatgagagcagccagatgtctgacctgcctgtgaaggtgacccacacagagaccgggaaggtgctgtttggacctgaggcccccaaggccagccagctggatgcctggctggagatgaaccctggctatgaggtggcccccaggagtgacagcgaggagagtgacagcgactatgaggaggaggatgaggaggaggagagcagccggcaggagacagaggagaagatcctgctggaccccaacagcgaggaggtgtctgagaaggatgccaagcagatcatcgagacagccaagcaggatgtggatgatgagtacagcatgcagtacagcgcccggggcagccagagctactacacagtggcccacgccatcagcgagcgggtggagaagcagagcgccctgctgatcaatggcaccctgaagcactaccagctgcagggcctggagtggatggtgtccctgtacaacaacaacctgaatggcatcctggctgatgagatgggcctgggcaagaccatccagaccatcgccctgatcacctacctgatggagcacaagaggctgaatggcccctacctgatcatcgtgcccctgagcaccctgagcaactggacctatgaatttgacaagtgggcccccagcgtggtgaagatctcctacaagggcaccccagccatgagaagaagcctggtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcgcatcctgctgaccggcacccccctgcagaacaagctgcctgagctgtgggccctgctgaacttcctgctgcccaccatcttcaagagctgcagcacctttgagcagtggttcaatgccccctttgccatgaccggggagcgggtggacctgaatgaggaggagaccatcctgatcatccggcggctgcacaaggtgctgcggcccttcctgctgcggcggctgaagaaggaggtggagagccagctgcctgagaaggtggagtatgtgatcaagtgtgacatgtctgccctgcagaagatcctgtaccgccacatgcaggccaagggcatcctgctgacagatggcagcgagaaggacaagaagggcaaaggaggagccaagaccctgatgaacaccatcatgcagctgaggaagatctgcaaccacccctacatgttccagcacatcgaggagagctttgctgagcacctgggctacagcaatggagtcatcaatggagctgagctgtaccgggccagcggcaagtttgagctgctggaccgcatcctgcccaagctgcgggccaccaaccaccgggtgctgctcttctgccagatgaccagcctgatgaccatcatggaggactactttgccttcaggaacttcctgtacctgcggctggatggcaccaccaagtcagaagatcgggccgccctgctgaagaagttcaatgaacctggcagccagtacttcatcttcctgctgagcacccgggccggcggcctgggcctgaacctgcaggccgctgacacagtggtgatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggaggagaatgaggaggaggatgaggtgcctgatgatgagaccctgaaccagatgattgcccggcgggaggaggagtttgacctcttcatgaggatggacatggacagaagaagagaagatgccaggaaccccaagaggaagccccggctgatggaggaggatgagctgcccagctggatcatcaaggatgatgctgaggtggagcggctgacctgtgaggaggaggaggagaagatcttcggccggggcagccggcagaggagagatgtggactacagtgatgccctgacagagaagcagtggctgcgggccattgaagatggcaacctggaggagatggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172150 - DNA, 360 bp, Artificial Sequence
  Description of Artificial Sequence: Synthetic coding sequence
atgctgctgtgccacaatgcccagaccttcaacctggagggcagccagatctatgaagattccatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172151 - DNA, 711 bp, Artificial Sequence; identical to SEQ ID NO: 172147
  Description of Artificial Sequence: Synthetic coding sequence

SEQ ID NO: 172152 - DNA, 711 bp, Artificial Sequence; identical to SEQ ID NO: 172147
  Description of Artificial Sequence: Synthetic coding sequence

SEQ ID NO: 172153 - DNA, 765 bp, Artificial Sequence
  Description of Artificial Sequence: Synthetic coding sequence
atggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggaccgctgcaatgtggagaaggtgcccagcaacagccagctggagattgagggcaacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggagcagagcgagggcagcggcacagatgatgaatag

SEQ ID NO: 172154 - DNA, 4719 bp, Artificial Sequence; identical to SEQ ID NO: 172149
  Description of Artificial Sequence: Synthetic coding sequence

SEQ ID NO: 172155 - DNA, 4773 bp, Artificial Sequence; identical to SEQ ID NO: 172148
  Description of Artificial Sequence: Synthetic coding sequence

SEQ ID NO: 172156 - DNA, 534 bp, Artificial Sequence
  Description of Artificial Sequence: Synthetic coding sequence
atggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgagtag

SEQ ID NO: 172157 - DNA, 816 bp, Artificial Sequence
  Description of Artificial Sequence: Synthetic coding sequence
atgaagaggctggccgcccgctgctttgctggcctgctgatcctgagccccctgaccgtcatcagtgacagcaggcctgctgacagcggcaaggccattgaagatggcaacctggaggagatggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgccaaggaggaggagagtgaagatgagagcaatgaggaggaggaggaggaggatgaggaggagagcgagagcgaggccaagtctgtgaaggtgaagatcaagctgaacaagaaggatgacaagggccgggacaagggcaagggcaagaagaggcccaacagaggcaaggccaagcctgtggtgtctgactttgacagtgatgaggagcaggatgagcgggtgtctgtggccgactggtag

SEQ ID NO: 172158 - DNA, 462 bp, Artificial Sequence
  Description of Artificial Sequence: Synthetic coding sequence
atgaagaggctggccgcccgctgctttgctggcctgctgatcctgagccccctgaccgtcatcagtgacagcaggcctgctgacagcggcaaggccattgaagatggcaacctggaggagatggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctgtag

SEQ ID NO: 172159 - DNA, 468 bp, Artificial Sequence
  Description of Artificial Sequence: Synthetic coding sequence
atgagcacccccacagatcctggggccatgccccaccctggccccagccctggccctggccccagccctggccccatcctgggccccagccctggccctggccccagccctggctctgtgcacagcatgatgggccccagccctggcccccccagcgtgagccaccccatgcccaccatgggcagcacagacttcccccaggagggcatgcaccagatgcacaagcccattgatggcatccatgacaagggcatcgtggaggacatccactgcggctccatgaagggcaccggcatgaggcctccccaccctggcatgggccccccccagagccccatggaccagcacagccagggctacatgagcccccaccccagccccctgggcgcccctgagcacgtgagcagccccatgtctgggggcggccccaccccaccccagatgccacccagccagcccggggcctag

SEQ ID NO: 172160 - DNA, 1680 bp, Artificial Sequence
  Description of Artificial Sequence: Synthetic coding sequence
atgagcacccccacagatcctggggccatgccccaccctggccccagccctggccctggccccagccctggccccatcctgggccccagccctggccctggccccagccctggctctgtgcacagcatgatgggccccagccctggcccccccagcgtgagccaccccatgcccaccatgggcagcacagacttcccccaggagggcatgcaccagatgcacaagcccattgatggcatccatgacaagggcatcgtggaggacatccactgcggctccatgaagggcaccggcatgaggcctccccaccctggcatgggccccccccagagccccatggaccagcacagccagggctacatgagcccccaccccagccccctgggcgcccctgagcacgtgagcagccccatgtctgggggcggccccaccccaccccagatgccacccagccagcccggggccctgatccctggggacccccaggccatgagccagcccaacagaggccccagccccttcagccctgtgcagctgcaccagctgcgggcccagatcctggcctacaagatgctggcccggggccagcccctgcctgagaccctgcagctggccgtgcagggcaagaggaccctgcccggcctgcagcagcagcagcagcagcagcagcagcagcagcagcagcagcagcagcagcagcagcagcagcagcagccccagcagcagcccccccagccccagacccagcagcagcagcagcctgccctggtgaactacaaccggcccagcggccctggccctgagctgagcggccccagcaccccccagaagctgcctgtgcctgcccctgggggccggcccagccctgcccctcctgctgctgcccagcccccagctgctgctgtgcccggccccagcgtgccccagcctgcccctggccagcccagccctgtgctgcagctgcagcagaagcagagccgcatcagccccatccagaagccccagggcctggaccctgtggagatcctgcaggagcgggagtaccgcctgcaggcccgcatcgcccaccgcatccaggagctggagaacctgcccggcagcctgcccccagacctgcggaccaaggccaccgtggagctgaaggccctgcggctgctgaacttccagaggcagctgcggcaggaggtggtggcctgcatgagaagagacaccaccctggagacagccctgaacagcaaggcctacaagaggagcaagaggcagaccctgcgggaggccaggatgacagagaagctggagaagcagcagaagattgagcaggagaggaagaggcggcagaagcaccaggagtacctgaacagcatcctgcagcacgccaaggacttcaaggagtaccacaggtctgtggccggcaagatccagaagctgagcaaggctgtggccacctggcacgccaacacagagcgggagcagaagaaggagacagagcgcatcgagaaggagaggatgaggcggctgatggctgaagatgaggagggctacaggaagctgattgaccagaagaaggaccggcggctggcctacctgctgcagcagacagatgaatatgtggccaacctgaccaacctggtgtgggagcacaagcaggcccaggccgccaaggagaagaagaagaggtag

SEQ ID NO: 172161 - DNA, 516 bp, Artificial Sequence
  Description of Artificial Sequence: Synthetic coding sequence
atggaggaggaggtgcggctgaagaagaggaagagaagaagaaatgtggacaaggaccctgccaaggaggatgtggagaaggccaagaagagaagaggccggcccccagctgagaagctgagccccaacccccccaagctgaccaagcagatgaatgccatcatcgacaccgtcatcaactacaaggaccgctgcaatgtggagaaggtgcccagcaacagccagctggagattgagggcaacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgggggacctggagaaggatgtgatgctgctgtgccacaatgcccagaccttcaacctggagggcagccagatctatgaggacagcatcgtgctgcagagcgtcttcaagagcgcccggcagaagatcgcctag

SEQ ID NO: 172162 - DNA, 201 bp, Artificial Sequence
  Description of Artificial Sequence: Synthetic coding sequence
atgagcacccccacagatcctggggccatgccccaccctggccccagccctggccctggccccagccctggccccatcctgggccccagccctggccctggccccagccctggctctgtgcacagcatgatgggccccagccctggcccccccagcgtgagccaccccatgcccaccatgggcagcacagacttcccctag

SEQ ID NO: 172163 - DNA, 4944 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgagagccgccactgcagcacaggcagcggcagcgccagctttgcccacacagcccctcctcctgctggggtgaacccagacctggaggagccccccctgaaggaggaggatgaggtgcctgatgatgaaacagtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaggacagcatcgtgctgcagagcgtcttcacctctgtgcggcagaagattgagaaggaggatgacagcgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgattctgaggaggagcaggaggaggacaggagcggcagcggcagcgaggaggactag

SEQ ID NO: 172164 - DNA, 5040 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgagagccgccactgcagcacaggcagcggcagcgccagctttgcccacacagcccctcctcctgctggggtgaacccagacctggaggagccccccctgaaggaggaggatgaggtgcctgatgatgaaacagtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaagaagatcaccgggaaggacatccatgacacagccagctctgtggcccggggcctgcagttccagaggggcctgcagttctgcacccgggccagcaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaggacagcatcgtgctgcagagcgtcttcacctctgtgcggcagaagattgagaaggaggatgacagcgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgattctgaggaggagcaggaggaggacaggagcggcagcggcagcgaggaggactag

SEQ ID NO: 172165 - DNA, 4854 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgaggaggaggatgaggtgcctgatgatgagaccgtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaagaccctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaggacagcatcgtgctgcagagcgtcttcacctctgtgcggcagaagattgagaaggaggatgacagcgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgattctgaggaggagcaggaggaggacaggagcggcagcggcagcgaggaggactag

SEQ ID NO: 172166 - DNA, 5046 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatgggccagcgggagaagagccggcggggcctgggcagccagagctgggcccgcatctttgctgacctgagtgaccaccagaatgactgtgtgacctctgtgacagagagcctggtgggccagatcctggccgcctgcagcggggaggagggggaggtggagtggaagggccgggacagagtgcggcggctgcgggcagaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgaggaggaggatgaggtgcctgatgatgagaccgtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaagaccctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaggacagcatcgtgctgcagagcgtcttcacctctgtgcggcagaagattgagaaggaggatgacagcgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgattctgaggaggagcaggaggaggacaggagcggcagcggcagcgaggaggactag

SEQ ID NO: 172167 - DNA, 4944 bp, Artificial Sequence; identical to SEQ ID NO: 172163
  Description of Artificial Sequence: Synthetic coding sequence

SEQ ID NO: 172168 - DNA, 4842 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgaggaggaggatgaggtgcctgatgatgagaccgtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaggacagcatcgtgctgcagagcgtcttcacctctgtgcggcagaagattgagaaggaggatgacagcgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgattctgaggaggagcaggaggaggacaggagcggcagcggcagcgaggaggactag

SEQ ID NO: 172169 - DNA, 4851 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgaggaggaggatgaggtgcctgatgatgagaccgtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaagaccctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaagattccatcgtgctgcagagcgtcttcacctctgtgcggcagaagattgagaaggaggatgattctgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgacagcgaggaggagcaggaggaggacagaagtggcagcggctctgaagaagattag

SEQ ID NO: 172170 - DNA, 4845 bp, Artificial Sequence
  Description of Artificial Sequence: Synthetic coding sequence
atgagcaccccagacccccccctgggcggcaccccccggcccggccccagccctggccctggccccagccctggggccatgctgggccccagccctggccccagccctggcagcgcccacagcatgatgggccccagccctggccccccatctgctggccaccccatccccacccagggccctgggggctacccccaggacaacatgcaccagatgcacaagcccatggagagcatgcatgagaagggcatgtctgatgacccccgctacaaccagatgaagggcatgggcatgaggtctgggggccacgccggcatgggccccccacccagccccatggaccagcacagccagggctaccccagccccctgggcggcagcgagcacgccagcagccctgtgcctgccagcggccccagcagcggcccccagatgagcagcggccctggaggagcccccctggatggagctgacccccaggccctgggccagcagaacagaggccccacccccttcaaccagaaccagctgcaccagctgcgggcccagatcatggcctacaagatgctggcccggggccagcccctgcctgaccacctgcagatggctgtgcagggcaagaggcccatgcctggcatgcagcagcagatgcccaccctgcccccacccagcgtgtctgccaccggccctggccctggccctggccctggccctggccctggccctggccctgccccacccaactacagccggccccacggcatgggcggccccaacatgcctcctcctggccccagcggcgtgcccccaggcatgcctggccagcccccaggcggcccccccaagccctggccagagggccccatggccaatgctgctgcccccaccagcaccccccagaagctgatccccccccagcccaccggccggcccagccctgcccctcctgctgtgcccccagctgccagccctgtgatgccaccccagacccagagccctggccagcctgcccagcctgcccccatggtgcccctgcaccagaagcagagccgcatcacccccatccagaagccccggggcctggaccctgtggagatcctgcaggagcgggagtaccgcctgcaggcccgcatcgcccaccgcatccaggagctggagaacctgcccggcagcctggccggggacctgcggaccaaggccaccatcgagctgaaggccctgcggctgctgaacttccagaggcagctgcggcaggaggtggtggtgtgcatgagaagagacacagccctggagacagccctgaatgccaaggcctacaagaggagcaagaggcagagcctgcgggaggcccgcatcacagagaagctggagaagcagcagaagattgagcaggagaggaagaggcggcagaagcaccaggagtacctgaacagcatcctgcagcacgccaaggacttcaaggagtaccacaggtctgtgacaggcaagatccagaagctgaccaaggctgtggccacctaccacgccaacacagagcgggagcagaagaaggaaaatgaaagaattgagaaggagaggatgaggcggctgatggctgaagatgaggagggctacaggaagctgattgaccagaagaaggacaagaggctggcctacctgctgcagcagacagatgaatatgtggccaacctgacagagctggtgcggcagcacaaggccgcccaggtggccaaggagaagaagaagaagaagaagaagaagaaggccgagaatgctgagggccagaccccagccatcggcccagatggagagcccctggatgagaccagccagatgtctgacctgcctgtgaaggtgattcatgtggagagcggcaagatcctgactggaacagatgcccccaaggccggccagctggaggcctggctggagatgaaccctggctatgaggtggcccccaggagtgacagcgaggagagcggcagcgaggaggaggaggaggaggaggaggaggagcagccccaggccgcccagccccccaccctgcctgtggaggagaagaagaagatcccagaccctgacagtgatgatgtgtctgaggtggatgcccggcacatcattgaaaatgccaagcaggatgtggatgatgaatatggagtgtcccaggccctggcccggggcctgcagagctactatgctgtggcccatgctgtgacagagcgggtggacaagcagagcgccctgatggtgaatggagtgctgaagcagtaccagatcaagggcctggagtggctggtgtccctgtacaacaacaacctgaatggcatcctggctgatgagatgggcctgggcaagaccatccagaccatcgccctgatcacctacctgatggagcacaagaggatcaatggccccttcctgatcatcgtgcccctgagcaccctgagcaactgggcctatgaatttgacaagtgggcccccagcgtggtgaaggtgtcctacaagggcagccctgctgcccggcgggcctttgtgccccagctgcggagcggcaagttcaacgtgctgctgaccacctatgagtacatcatcaaggacaagcacatcctggccaagatccgctggaagtacatgattgtggatgagggccacaggatgaagaaccaccactgcaagctgacccaggtgctgaacacccactacgtggccccccggcggctgctgctgaccggcacccccctgcagaacaagctgcctgagctgtgggccctgctgaacttcctgctgcccaccatcttcaagagctgcagcacctttgagcagtggttcaatgccccctttgccatgaccggggagaaggtggacctgaatgaggaggagaccatcctgatcatccggcggctgcacaaggtgctgcggcccttcctgctgcggcggctgaagaaggaggtggaggcccagctgcctgagaaggtggagtatgtgatcaagtgtgacatgtctgccctgcagagggtgctgtaccgccacatgcaggccaagggcgtgctgctgacagatggcagcgagaaggacaagaagggcaaaggaggcaccaagaccctgatgaacaccatcatgcagctgaggaagatctgcaaccacccctacatgttccagcacatcgaggagagcttcagcgagcacctgggcttcaccggcggcatcgtgcagggcctggacctgtaccgggccagcggcaagtttgagctgctggaccgcatcctgcccaagctgcgggccaccaaccacaaggtgctgctcttctgccagatgaccagcctgatgaccatcatggaggactactttgcctaccggggcttcaagtacctgcggctggatggcaccaccaaggcagaagatcggggcatgctgctgaagaccttcaatgaacctggcagcgagtacttcatcttcctgctgagcacccgggccggcggcctgggcctgaacctgcagagcgctgacaccgtcatcatctttgacagcgactggaacccccaccaggacctgcaggcccaggaccgggcccacagaattggccagcagaatgaggtgcgggtgctgcggctgtgcaccgtgaacagcgtggaggagaagatcctggccgccgccaagtacaagctgaatgtggaccagaaggtgatccaggccggcatgtttgaccagaagagcagcagccatgaaagaagagccttcctgcaggccatcctggagcacgaggagcaggatgaggaggaggatgaggtgcctgatgatgagaccgtgaaccagatgattgcccggcatgaggaggagtttgacctcttcatgaggatggacctggacagaagaagagaggaggccaggaaccccaagaggaagccccggctgatggaggaggatgagctgcccagctggatcatcaaggatgatgctgaggtggagcggctgacctgtgaggaggaggaggagaagatgtttggccggggcagccgccacaggaaggaggtggactacagcgacagcctgacagagaagcagtggctgaaggccatcgaggagggcaccctggaggagattgaggaggaggtgcggcagaagaagagcagcaggaagaggaagagggacagtgatgctggcagcagcacccccaccaccagcaccaggagccgggacaaggatgatgagagcaagaagcagaagaagaggggccggcccccagctgagaagctgagccccaacccccccaacctgaccaagaagatgaagaagatcgtggatgctgtgatcaagtacaaggacagcagcagcggccggcagctgtctgaggtgttcatccagctgcccagcaggaaggagctgcctgagtactatgagctgatcaggaagcctgtggacttcaagaagatcaaggagcgcatccggaaccacaagtaccgcagcctgaatgacctggagaaggatgtgatgctgctgtgccagaatgcccagaccttcaacctggagggcagcctcatctatgaagattccatcgtgctgcagagcgtcttcacctctgtgcggcagaagattgagaaggaggatgattctgagggggaggagagcgaggaggaggaggagggggaggaggagggcagcgagagcgagagccgctctgtgaaggtgaagatcaagctgggcaggaaggagaaggcccaggaccggctgaagggcggcagaagaagacccagccggggcagccgggccaagcctgtggtgtctgatgatgacagcgaggaggagcaggaggaggacagaagtggcagcggctctgaagaagattag

SEQ ID NO: 172171 - DNA, 3159 bp, Artificial Sequence
  Description of Artificial Sequence: Synthetic coding sequence
atgagcagcgctgctgagcccccacctcctcctcctcctgagagcgcccccagcaagccagctgccagcatcgccagcggcggcagcaacagcagcaacaagggcggccctgagggcgtggccgcccaggccgtggccagcgctgccagcgctggccctgcagatgctgagatggaggagatctttgatgatgccagccctgggaagcagaaggagatccaggagccagaccccacctatgaggagaagatgcagacagaccgggccaacagatttgagtacctgctgaagcagacagagctgtttgcccacttcatccagcctgctgcccagaagacccccaccagccccctgaagatgaagccaggccggccccgcatcaagaaggatgagaagcagaacctgctgtctgtgggggactaccgccacagaagaacagagcaggaggaggatgaggagctgctgacagagagcagcaaggccaccaacgtgtgcaccaggtttgaggacagccccagctatgtgaagtggggcaagctgcgggactaccaggtgcggggcctgaactggctgatcagcctgtatgaaaatggcatcaatggcatcctggctgatgagatgggcctgggcaagaccctgcagaccatcagcctgctgggctacatgaagcactacagaaacatccctggcccccacatggtgctggtgcccaagagcaccctgcacaactggatgtctgagttcaagcgctgggtgcccaccctgcggtctgtgtgcctgattggagacaaggagcagagagctgcctttgtgagagatgtgctgctgcctggagagtgggatgtgtgtgtgaccagctatgagatgctgatcaaggagaagtctgtgttcaagaagttcaactggagatacctggtgattgatgaggcccaccgcatcaagaatgagaagagcaagctgtctgaaattgtgcgggagttcaagaccaccaaccggctgctgctgaccggcacccccctgcagaacaacctgcacgagctgtggagcctgctgaacttcctgctgcctgatgtgttcaacagcgcagatgactttgacagctggtttgacaccaacaactgcctgggggaccagaagctggtggagcggctgcacatggtgctgcggcccttcctgctgcggcgcatcaaggcagatgtggagaagagcctgccccccaagaaggaggtgaagatctacgtgggcctgagcaagatgcagcgggagtggtacacccgcatcctgatgaaggacatcgacatcctgaacagcgctgggaagatggacaagatgaggctgctgaacatcctgatgcagctgaggaagtgctgcaaccacccctacctgtttgatggagctgagcccggccccccctacaccacagacatgcacctggtgaccaacagcggcaagatggtggtgctggacaagctgctgcccaagctgaaggagcagggcagccgggtgctgatcttcagccagatgaccagggtgctggacatcctggaggactactgcatgtggaggaactatgagtactgccgcctggatggccagacccctcatgatgagcggcaggacagcatcaatgcctacaatgagcccaacagcaccaagtttgtgttcatgctgagcaccagggctgggggcctgggcatcaacctggccacagcagatgtggtgatcctgtatgacagcgactggaacccccaggtggacctgcaggccatggaccgggcccaccgcatcggccagaccaagacagtgcgggtcttccgcttcatcacagacaacacagtggaggagagaattgtggagagagctgagatgaagctgcggctggacagcatcgtcatccagcagggccgcctggtggaccagaacctgaacaagattggcaaggatgagatgctgcagatgatccgccacggggccacccacgtgtttgccagcaaggagagcgagatcacagatgaggacattgatggcatcctggagcggggggccaagaagacagctgagatgaatgagaagctgagcaagatgggagagagcagcctgaggaacttcaccatggacacagagagctctgtgtacaactttgaaggagaggactaccgggagaagcagaagatcgccttcacagagtggattgagccccccaagcgggagaggaaggccaactatgctgtggatgcctacttccgggaggccctgcgggtgtctgagcccaaggcccccaaggcccccaggcctcccaagcagcccaacgtgcaggacttccagttcttccccccccggctgtttgagctgctggagaaggagatcctcttctacaggaagaccatcggctacaaggtgcccaggaaccctgagctgcccaatgctgcccaggcccagaaggaggagcagctgaagattgatgaagctgagagcctgaatgatgaggagctggaggagaaggagaagctgctgacccagggcttcaccaactggaacaagagggacttcaaccagttcatcaaggccaatgagaagtggggcagagatgacatcgagaacatcgcccgggaggtggagggcaagaccccagaggaggtgattgagtacagcgctgtgttctgggagcgctgcaatgagctgcaggacatcgagaagatcatggcccagatcgagcggggggaggcccgcatccagaggcgcatcagcatcaagaaggccctggacaccaagattggccgctacaaggcccccttccaccagctgcgcatctcctatggcaccaacaagggcaagaactacacagaggaggaggaccgcttcctgatctgcatgctgcacaagctgggctttgacaaggaaaatgtgtatgatgagctgcggcagtgcatccggaacagcccccagttccgctttgactggttcctgaagagcaggacagccatggagctgcagaggcgctgcaacaccctcatcaccctcatcgagcgggagaacatggagctggaggagaaggagaaggccgagaagaagaagaggggccccaagcccagcacccagaagaggaagatggatggagccccagatggccggggcaggaagaagaagctgaagctgtag

SEQ ID NO: 172172 - DNA, 2988 bp, Artificial Sequence
  Description of Artificial Sequence: Synthetic coding sequence
atggaggagatctttgatgatgccagccctgggaagcagaaggagatccaggagccagaccccacctatgaggagaagatgcagacagaccgggccaacagatttgagtacctgctgaagcagacagagctgtttgcccacttcatccagcctgctgcccagaagacccccaccagccccctgaagatgaagccaggccggccccgcatcaagaaggatgagaagcagaacctgctgtctgtgggggactaccgccacagaagaacagagcaggaggaggatgaggagctgctgacagagagcagcaaggccaccaacgtgtgcaccaggtttgaggacagccccagctatgtgaagtggggcaagctgcgggactaccaggtgcggggcctgaactggctgatcagcctgtatgaaaatggcatcaatggcatcctggctgatgagatgggcctgggcaagaccctgcagaccatcagcctgctgggctacatgaagcactacagaaacatccctggcccccacatggtgctggtgcccaagagcaccctgcacaactggatgtctgagttcaagcgctgggtgcccaccctgcggtctgtgtgcctgattggagacaaggagcagagagctgcctttgtgagagatgtgctgctgcccggggagtgggatgtgtgtgtgaccagctatgagatgctgatcaaggagaagagcgtcttcaagaagttcaactggagatacctggtgattgatgaggcccaccgcatcaagaatgagaagagcaagctgtctgagatcgtgcgggagttcaagaccaccaaccggctgctgctgaccggcacccccctgcagaacaacctgcacgagctgtggagcctgctgaacttcctgctgcctgatgtgttcaacagcgcagatgactttgacagctggtttgacaccaacaactgcctgggggaccagaagctggtggagcggctgcacatggtgctgcggcccttcctgctgcggcgcatcaaggcagatgtggagaagagcctgccccccaagaaggaggtgaagatctacgtgggcctgagcaagatgcagcgggagtggtacacccgcatcctgatgaaggacatcgacatcctgaacagcgctgggaagatggacaagatgaggctgctgaacatcctgatgcagctgaggaagtgctgcaaccacccctacctgtttgatggagctgagcccggccccccctacaccacagacatgcacctggtgaccaacagcggcaagatggtggtgctggacaagctgctgcccaagctgaaggagcagggcagccgggtgctgatcttcagccagatgaccagggtgctggacatcctggaggactactgcatgtggagaaattatgagtactgccgcctggatggccagacccctcatgatgagcggcaggacagcatcaatgcctacaatgagcccaacagcaccaagtttgtgttcatgctgagcacccgggccggcggcctgggcatcaacctggccacagcagatgtggtgatcctgtatgacagcgactggaacccccaggtggacctgcaggccatggaccgggcccacagaattggccagaccaagacagtgcgggtcttccgcttcatcacagacaacacagtggaggagcgcatcgtggagcgggcagagatgaagctgcggctggacagcatcgtcatccagcagggccgcctggtggaccagaacctgaacaagattggcaaggatgagatgctgcagatgatcagacatggagccacccacgtgtttgccagcaaggagagcgagatcacagatgaagatattgatggcatcctggagcggggggccaagaagacagctgagatgaatgagaagctgagcaagatgggagagagcagcctgaggaacttcaccatggacacagagagctctgtgtacaactttgaaggagaggactaccgggagaagcagaagatcgccttcacagagtggattgagccccccaagcgggagaggaaggccaactatgctgtggatgcctacttccgggaggccctgcgggtgtctgagcccaaggcccccaaggccccccggccccccaagcagcccaacgtgcaggacttccagttcttccccccccggctgtttgagctgctggagaaggagatcctcttctacaggaagaccatcggctacaaggtgcccagaaatcctgagctgcccaatgctgcccaggcccagaaggaggagcagctgaagattgatgaggccgagagcctgaatgatgaggagctggaggagaaggagaagctgctgacccagggcttcaccaactggaacaagagggacttcaaccagttcatcaaggccaatgagaagtggggcagagatgacattgaaaatattgcccgggaggtggagggcaagaccccagaggaggtgattgagtacagcgctgtgttctgggagcgctgcaatgagctgcaggacatcgagaagatcatggcccagatcgagcggggggaggcccgcatccagaggcgcatcagcatcaagaaggccctggacaccaagattggccgctacaaggcccccttccaccagctgcgcatctcctatggcaccaacaagggcaagaactacacagaggaggaggaccgcttcctgatctgcatgctgcacaagctgggctttgacaaggaaaatgtgtatgatgagctgcggcagtgcatccggaacagcccccagttccgctttgactggttcctgaagagcaggacagccatggagctgcagaggcgctgcaacaccctcatcaccctgattgagcgggagaacatggagctggaggagaaggagaaggccgagaagaagaagaggggccccaagcccagcacccagaagaggaagatggatggagccccagatggccggggcaggaagaagaagctgaagctgtag

SEQ ID NO: 172173 - DNA, 2988 bp, Artificial Sequence; identical to SEQ ID NO: 172172
  Description of Artificial Sequence: Synthetic coding sequence

SEQ ID NO: 172174 - DNA, 2865 bp, Artificial Sequence
  Description of Artificial Sequence: Synthetic coding sequence
atgagcctgcccctgacagaggagcagaggaagaagattgaagaaaatcggcagaaggccctggccaggagagctgagaagctgctggccgagcagcaccagaggaccagcagcggcaccagcattgctggcaaccccttccaggccaagcagggccccagccagaacttcccccgggagagctgcaagcctgtgtcccatggagtcatcttcaagcagcagaacctgagcagcagcagcaatgctgaccagaggcctcatgacagccacagcttccaggccaagggcatctggaagaagccagaggagatgcccacagcctgccccggccacagccccaggagccagatggccctgaccggcatcagcccccccctggcccagagccccccagaggtgcccaagcagcagctgctgtcctatgagctgggccagggccacgcccaggccagccctgagatccgcttcaccccatttgccaaccccacccacaagcccctggccaagcccaagagcagccaggagaccccagcccacagcagcggccagcccccaagagatgccaagctggaggccaagacagccaaggccagccccagcggccagaacatctcctacatccacagcagcagcgagagcgtgacccccaggacagagggccgcctgcagcagaagagcggcagctctgtgcagaagggcgtgaacagccagaagggcaaatgtgtgagaaatggagaccgcttccaggtgctgattggctacaatgctgagctgattgctgtgttcaagaccctgcccagcaagaactatgaccctgacaccaagacctggaacttctccatgaatgactacagcgccctgatgaaggccgcccagagcctgcccaccgtgaacctgcagcccctggagtgggcctacggcagcagcgagagccccagcaccagcagcgagggccaggccggcctgcccagcgcccccagcctgagctttgtgaagggccgctgcatgctgatcagccgggcctactttgaagctgacatctcctacagccaggacctgattgccctcttcaagcagatggacagcagaagatatgatgtgaagaccaggaagtggagcttcctgctggaggagcacagcaagctgattgccaaggtgcgctgcctgccccaggtgcagctggaccccctgcccaccaccctgaccctggcctttgccagccagctgaagaagaccagcctgagcctgaccccagatgtgcctgaggccgacctgtctgaggtggaccccaagctggtgagcaacctgatgcccttccagagagctggggtgaactttgccatcgccaagggcggccgcctgctgctggctgatgacatgggcctgggcaagaccatccaggccatctgcatcgccgccttctacaggaaggagtggcccctgctggtggtggtgcccagctctgtgcgcttcacctgggagcaggccttcctgcgctggctgcccagcctgagcccagactgcatcaacgtggtggtgacaggcaaggaccggctgacagctggcctcatcaacatcgtgtcctttgacctgctgagcaagctggagaagcagctgaagacccccttcaaggtggtgatcattgatgagagccacttcctgaagaacagcaggacagcccgctgccgggccgccatgcctgtgctgaaggtggccaagagggtcatcctgctgagcggcaccccagccatgagcaggcctgctgagctgtacacccagatcatcgctgtgaagcccaccttcttcccccagttccacgccttcggcctgcgctactgtgatgccaagaggatgccctggggctgggactacagcggcagcagcaacctgggggagctgaagctgctgctggaggaggccgtgatgctgcggcggctgaagagtgatgtgctgagccagctgcctgccaagcagaggaagatcgtggtgattgcccctggccgcatcaatgcccggaccagggctgccctggatgctgctgccaaggagatgaccaccaaggacaagaccaagcagcagcagaaggatgccctgatcctcttcttcaacagaacagctgaggccaagatccccagcgtcatcgagtacatcctggacctgctggagagcggccgggagaagttcctggtgtttgcccaccacaaggtggtgctggatgccatcacccaggagctggagaggaagcacgtgcagcacatcagaattgatggcagcaccagcagcgctgagcgggaggacctgtgccagcagttccagctgtctgaaagacatgctgtggccgtgctgagcatcacagctgccaacatgggcctgaccttcagcagcgctgacctggtggtgtttgctgagctgttctggaaccctggggtgctgatccaggctgaagatagagtgcacagaattggccagaccagctctgtgggcatccactacctggtggccaagggcacagcagatgactacctgtggcccctcatccaggagaagatcaaggtgctggccgaggccggcctgtctgagaccaacttcagcgagatgacagagagcacagactacctgtacaaggaccccaagcagcagaagatctatgacctcttccagaagagctttgagaaggagggcagtgacatggagctgctggaggccgctgagagctttgaccccggcagcgccagcggcaccagcggcagcagcagccagaacatgggagacaccctggatgagagcagcctgacagccagcccccagaagaagagaagatttgagttctttgacaactgggacagcttcaccagccccctgtag

SEQ ID NO: 172175 - DNA, 2865 bp, Artificial Sequence; identical to SEQ ID NO: 172174
  Description of Artificial Sequence: Synthetic coding sequence

SEQ ID NO: 172176 - DNA, 60 bp, Artificial Sequence
  Description of Artificial Sequence: Synthetic coding sequence
atgagcctgcccctgacagaggagcagaggaagaagattgaagaaaatcggcagaagtag

SEQ ID NO: 172177 - DNA, 441 bp, Artificial Sequence
  Description of Artificial Sequence: Synthetic coding sequence
atgagcctgcccctgacagaggagcagaggaagaagattgaagaaaatcggcagaaggccctggccaggagagctgagaagctgctggccgagcagcaccagaggaccagcagcggcaccagcattgctggcaaccccttccaggccaagcagggccccagccagaacttcccccgggagagctgcaagcctgtgtcccatggagtcatcttcaagcagcagaacctgagcagcagcagcaatgctgaccagaggcctcatgacagccacagcttccaggccaagggcatctggaagaagccagaggagatgcccacagcctgccccggccacagccccaggagccagatggccctgaccggcatcagcccccccctggcccagagccccccagaggtgcccaagcagcagctgctgtcctatgagctgggccagggctag

SEQ ID NO: 172178 - DNA, 279 bp, Artificial Sequence
  Description of Artificial Sequence: Synthetic coding sequence
atgagcctgcccctgacagaggagcagaggaagaagattgaagaaaatcggcagaaggccctggccaggagagctgagaagctgctggccgagcagcaccagaggaccagcagcggcaccagcattgctggcaaccccttccaggccaagcagggccccagccagaacttcccccgggagagctgcaagcctgtgtcccatggagtcatcttcaagcagcagaacctgagcagcagcagcaatgctgaccagaggcctcatgacagccacagcttctag

SEQ ID NO: 172179 - DNA, 393 bp, Artificial Sequence
  Description of Artificial Sequence: Synthetic coding sequence
atgagcctgcccctgacagaggagcagaggaagaagattgaagaaaatcggcagaaggccctggccaggagagctgagaagctgctggccgagcagcaccagaggaccagcagcggcaccagcattgctggcaaccccttccaggccaagcagggccccagccagaacttcccccgggagagctgcaagcctgtgtcccatggagtcatcttcaagcagcagaacctgagcagcagcagcaatgctgaccagaggcctcatgacagccacagcttccaggccaagggcatctggaagaagccagaggagatgcccacagcctgccccggccacagccccaggagccagatggccctgaccggcatcagcccccccctggcccagagcccctag

SEQ ID NO: 172180 - DNA, 3318 bp, Artificial Sequence
  Description of Artificial Sequence: Synthetic coding sequence
atggctgctgctgctgggggcggcggccctggaacagctgtgggcgccactggaagtggcattgctgctgctgctgctggcctggccgtgtacagaaggaaggatggcggccctgccaccaagttctgggagagccctgagaccgtgtcccagctggacagcgtgcgggtgtggctgggcaagcactacaagaagtatgtgcatgctgatgcccccaccaacaagaccctggccggcctggtggtgcagctgctgcagttccaggaggatgccttcggcaagcacgtgaccaacccagccttcaccaagctgcctgccaagtgcttcatggacttcaaggccggcggggccctgtgccacatcctgggcgccgcctacaagtacaagaatgagcagggctggaggagatttgacctgcagaaccccagcaggatggacagaaatgtggagatgttcatgaacatcgagaagaccctggtgcagaacaactgcctgacccggcccaacatctacctgatcccagacatcgacctgaagctggccaacaagctgaaggacatcatcaagaggcaccagggcaccttcacagatgagaagagcaaggccagccaccacatctacccctacagcagcagccaggatgatgaggagtggctgcggcctgtgatgaggaaggagaagcaggtgctggtgcactggggcttctacccagacagctatgacacctgggtgcacagcaatgatgtggatgctgagattgaggacccccccatccctgagaagccctggaaggtgcacgtgaagtggatcctggacacagacatcttcaatgagtggatgaatgaagaagattatgaggtggatgaaaataggaagcctgtgtccttccggcagaggatcagcaccaagaatgaggagcctgtgcgcagccctgagcggcgggacaggaaggccagcgccaatgccaggaagaggaagcacagccccagccccccaccacccacccccacagagagcaggaagaagagcggcaagaagggccaggccagcctgtatggcaagagaagaagccagaaggaggaggatgagcaggaggacctgaccaaggacatggaggaccccacccctgtgcccaacatcgaggaggtggtgctgcccaagaatgtgaacctgaagaaggacagcgagaacacccctgtgaagggcggcaccgtggccgacctggatgagcaggatgaggagaccgtgacagctgggggcaaggaggatgaggaccctgccaagggggaccagagccgctctgtggacctgggagaagataatgtgacagagcagaccaaccacatcatcatccccagctatgcctcctggtttgactacaactgcatccacgtgattgaaagaagagccctgcctgagttcttcaacgggaagaacaagagcaagaccccagagatctacctggcctacagaaacttcatgattgacacctaccgcctgaacccccaggagtacctgaccagcacagcctgcagaagaaacctgactggagatgtgtgtgctgtgatgagggtgcacgccttcctggagcagtggggcctggtgaactaccaggtggaccctgagagccggcccatggccatgggccccccacccaccccccacttcaacgtgctggccgacacccccagcggcctggtgcccctgcacctgcggagcccccaggtgcctgctgcccagcagatgctgaacttccctgagaagaacaaggagaagcctgtggacctgcagaactttggcctgaggacagacatctacagcaagaagaccctggccaagagcaaaggagccagcgctggccgggagtggacagagcaggagaccctgctgctgctggaggccctggagatgtacaaggatgactggaacaaggtgtctgagcacgtgggcagcaggacccaggatgagtgcatcctgcacttcctgcggctgcccatcgaggacccctacctggagaacagtgatgccagcctgggccccctggcctaccagcctgtgcccttcagccagagcggcaaccctgtgatgagcacagtggccttcctggcctctgtggtggacccccgggtggccagcgctgctgccaaggccgccctggaggagttcagccgggtgcgggaggaggtgcccctggagctggtggaggcccacgtgaagaaggtgcaggaggccgcccgggccagcggcaaggtggaccccacctacggcctggagagcagctgcatcgccggcactggaccagatgagcctgagaagctggagggcgctgaggaggagaagatggaggccgaccctgatggccagcagcctgagaaggccgagaacaaggtggagaatgaaacagatgaaggagacaaggcccaggatggagaaaatgagaagaacagcgagaaggagcaggacagcgaggtgtctgaggacaccaagtctgaggagaaggagacagaggagaacaaggagctgacagacacctgcaaggagcgggagagtgacaccgggaagaagaaggtggagcacgagatcagcgagggcaatgtggccacagctgctgctgctgccctggccagcgctgccaccaaggccaagcacctggccgctgtggaggagaggaagatcaagagcctggtggccctgctggtggagacccagatgaagaagctggagatcaagctgcggcactttgaggagctggagaccatcatggaccgggagaaggaggccctggagcagcagaggcagcagctgctgacagagcggcagaacttccacatggagcagctgaagtatgcagagctgcgggcccggcagcagatggagcagcagcagcacggccagaacccccagcaggcccaccagcacagcggcggccctggcctggcccccctgggcgctgctggccaccctggcatgatgccccaccagcagcccccaccctaccccctgatgcaccaccagatgcccccaccccaccccccccagcccggccagatccctggccctggctccatgatgcctggccagcacatgcctggccgcatgatccccaccgtggccgccaacatccaccccagcggcagcggccccaccccacctggcatgccacccatgcctggcaacatcctgggcccccgggtgcccctgacagccccaaatggcatgtacccacctccaccccagcagcagcccccacctcctcctccagcagatggagtgcccccacctccagcccctggccccccagccagcgctgccccctag

SEQ ID NO: 172181 - DNA, 3645 bp, Artificial Sequence
  Description of Artificial Sequence: Synthetic coding sequence
atggctgtgaggaagaaggatggcggccccaacgtgaagtactatgaagctgctgacacagtgacccagtttgacaacgtgcggctgtggctgggcaagaactacaagaagtacatccaggccgagccccccaccaacaagagcctgagcagcctggtggtgcagctgctgcagttccaggaggaggtgtttgggaagcacgtgtccaatgcccccctgaccaagctgcccatcaagtgcttcctggacttcaaggccggcggcagcctgtgccacatcctggccgccgcctacaagttcaagagtgaccagggctggaggagatatgacttccagaaccccagcaggatggacagaaatgtggagatgttcatgaccatcgagaagagcctggtgcagaacaactgcctgagccggcccaacatcttcctgtgcccagaaattgagcccaagctgctgggcaagctgaaggacatcatcaagaggcaccagggcaccgtgacagaggacaagaacaatgccagccacgtggtgtaccctgtgcccggcaacctggaggaggaggagtgggtgcggcctgtgatgaagagggacaagcaggtgctgctgcactggggctactacccagacagctatgacacctggatcccagccagcgagattgaggcctctgtggaggatgcccccaccccagagaagcccaggaaggtgcacgccaagtggatcctggacacagacaccttcaatgagtggatgaatgaagaagattatgaggtgaatgatgacaagaaccctgtgtccaggaggaagaagatcagcgccaagaccctgacagatgaggtgaacagcccagacagcgaccggcgggacaagaagggcggcaactacaagaagaggaagaggagccccagccccagccccaccccagaggccaagaagaagaatgccaagaagggccccagcaccccctacaccaagagcaagaggggccaccgggaggaggagcaggaggacctgaccaaggacatggatgagcccagccctgtgcccaacgtggaggaggtgaccctgcccaagacagtgaacaccaagaaggacagcgagagcgcccctgtgaagggcggcaccatgacagacctggatgagcaggaggatgagagcatggagaccaccgggaaggatgaagatgagaacagcacaggcaacaagggggagcagaccaagaacccagacctgcacgaggacaacgtgacagagcagacccaccacatcatcatccccagctatgctgcctggtttgactacaacagcgtgcacgccattgaaagaagagccctgcctgagttcttcaacgggaagaacaagagcaagaccccagagatctacctggcctacagaaacttcatgattgacacctaccgcctgaacccccaggagtacctgaccagcacagcctgcagaagaaacctggccggagatgtgtgtgccatcatgagggtgcacgccttcctggagcagtggggcctcatcaactaccaggtggatgctgagagccggcccacccccatgggccccccacccaccagccacttccacgtgctggccgacaccccatctggcctggtgcccctgcagcccaagaccccccagcagaccagcgccagccagcagatgctgaacttcccagacaagggcaaggagaagcccacagacatgcagaactttggcctgaggacagacatgtacaccaagaagaatgtgcccagcaagagcaaggccgccgccagcgccacccgggagtggacagagcaggagaccctgctgctgctggaggccctggagatgtacaaggatgactggaacaaggtgtctgagcacgtgggcagcaggacccaggatgagtgcatcctgcacttcctgcggctgcccatcgaggacccctacctggaggacagcgaggccagcctgggccccctggcctaccagcccatccccttcagccagagcggcaaccctgtgatgagcacagtggccttcctggcctctgtggtggacccccgggtggccagcgctgctgccaagagcgccctggaggagttcagcaagatgaaggaggaggtgcccacagccctggtggaggcccacgtgaggaaggtggaggaggccgccaaggtgacaggcaaggctgaccctgccttcggcctggagagcagcggcattgctggcaccaccagtgatgagcctgagagaattgaggagagcggaaatgatgaggcccgggtggagggccaggccacagatgagaagaaggagcccaaggagccccgggagggcggcggggccatcgaggaggaggccaaggagaagaccagcgaggcccccaagaaggatgaggagaagggcaaggagggggacagcgagaaggagagcgagaagagtgatggagaccccatcgtggaccctgagaaggagaaggagcccaaggagggccaggaggaggtgctgaaggaggtggtggagagcgagggggagaggaagaccaaggtggagcgggacattggagagggcaacctgagcacagctgctgctgctgccctggccgctgctgctgtgaaggccaagcacctggccgctgtggaggagaggaagatcaagagcctggtggccctgctggtggagacccagatgaagaagctggagatcaagctgcggcactttgaggagctggagaccatcatggaccgggagcgggaggccctggagtaccagaggcagcagctgctggccgaccggcaggccttccacatggagcagctgaagtatgcagagatgagggcccggcagcagcacttccagcagatgcaccagcagcagcagcagcccccaccagccctgcccccaggcagccagcccatccccccaactggagctgctggccccccagctgtgcacggcctggccgtggccccagcctctgtggtgcctgccccagctggcagcggggcccctcctggcagcctgggccccagcgagcagatcggccaggccggcagcacagctggcccccagcagcagcagcctgctggggccccccagcctggagctgtgcccccaggagtgcccccacctggcccccacggccccagccccttccccaaccagcagaccccacccagcatgatgcctggagctgtgcccggcagcggccaccctggggtggccggaaatgcccccctgggcctgcccttcggcatgcctcctcctcctcctcctccagcccccagcatcatccccttcggcagcctggccgacagcatcagcatcaacctgcctgccccacccaacctgcacggccaccaccaccacctgccctttgcccctggcaccctgcccccacccaacctgcctgtgtccatggccaaccccctgcaccccaacctgcctgccaccaccaccatgcccagcagcctgcccctgggccctggcctgggcagcgctgctgcccagagccctgccatcgtggccgctgtgcagggcaacctgctgcccagcgccagccccctgcctgaccccggcacccccctgcccccagaccccacagcccccagccctggcaccgtgacccctgtgcccccaccccagtag

SEQ ID NO: 172182 - DNA, 3393 bp, Artificial Sequence
  Description of Artificial Sequence: Synthetic coding sequence
atggctgtgaggaagaaggatggcggccccaacgtgaagtactatgaagctgctgacacagtgacccagtttgacaacgtgcggctgtggctgggcaagaactacaagaagtacatccaggccgagccccccaccaacaagagcctgagcagcctggtggtgcagctgctgcagttccaggaggaggtgtttgggaagcacgtgtccaatgcccccctgaccaagctgcccatcaagtgcttcctggacttcaaggccggcggcagcctgtgccacatcctggccgccgcctacaagttcaagagtgaccagggctggaggagatatgacttccagaaccccagcaggatggacagaaatgtggagatgttcatgaccatcgagaagagcctggtgcagaacaactgcctgagccggcccaacatcttcctgtgcccagaaattgagcccaagctgctgggcaagctgaaggacatcatcaagaggcaccagggcaccgtgacagaggacaagaacaatgccagccacgtggtgtaccctgtgcccggcaacctggaggaggaggagtgggtgcggcctgtgatgaagagggacaagcaggtgctgctgcactggggctactacccagacagctatgacacctggatcccagccagcgagattgaggcctctgtggaggatgcccccaccccagagaagcccaggaaggtgcacgccaagtggatcctggacacagacaccttcaatgagtggatgaatgaagaagattatgaggtgaatgatgacaagaaccctgtgtccaggaggaagaagatcagcgccaagaccctgacagatgaggtgaacagcccagacagcgaccggcgggacaagaagggcggcaactacaagaagaggaagaggagccccagccccagccccaccccagaggccaagaagaagaatgccaagaagggccccagcaccccctacaccaagagcaagaggggccaccgggaggaggagcaggaggacctgaccaaggacatggatgagcccagccctgtgcccaacgtggaggaggtgaccctgcccaagacagtgaacaccaagaaggacagcgagagcgcccctgtgaagggcggcaccatgacagacctggatgagcaggaggatgagagcatggagaccaccgggaaggatgaagatgagaacagcacaggcaacaagggggagcagaccaagaacccagacctgcacgaggacaacgtgacagagcagacccaccacatcatcatccccagctatgctgcctggtttgactacaacagcgtgcacgccattgaaagaagagccctgcctgagttcttcaacgggaagaacaagagcaagaccccagagatctacctggcctacagaaacttcatgattgacacctaccgcctgaacccccaggagtacctgaccagcacagcctgcagaagaaacctggccggagatgtgtgtgccatcatgagggtgcacgccttcctggagcagtggggcctcatcaactaccaggtggatgctgagagccggcccacccccatgggccccccacccaccagccacttccacgtgctggccgacaccccatctggcctggtgcccctgcagcccaagaccccccagggccggcaggtggatgctgacaccaaggccggcaggaagggcaaggagctggatgacctggtgcctgagacagccaagggcaagccagagctgcagaccagcgccagccagcagatgctgaacttcccagacaagggcaaggagaagcccacagacatgcagaactttggcctgaggacagacatgtacaccaagaagaatgtgcccagcaagagcaaggctgctgccagcgccacccgggagtggacagagcaggagaccctgctgctgctggaggccctggagatgtacaaggatgactggaacaaggtgtctgaacatgtgggcagcaggacccaggatgagtgcatcctgcacttcctgcggctgcccatcgaggacccctacctggaggacagcgaggccagcctgggccccctggcctaccagcccatccccttcagccagagcggcaaccctgtgatgagcacagtggccttcctggcctctgtggtggacccccgggtggccagcgctgctgccaagagcgccctggaggagttcagcaagatgaaggaggaggtgcccacagccctggtggaggcccacgtgaggaaggtggaggaggccgccaaggtgacaggcaaggctgaccctgccttcggcctggagagcagcggcattgctggcaccaccagtgatgagcctgagcgcatcgaggagagcggaaatgatgaggcccgggtggagggccaggccacagatgagaagaaggagcccaaggagccccgggagggcggcggggccatcgaggaggaggccaaggagaagaccagcgaggcccccaagaaggatgaggagaagggcaaggagggggacagcgagaaggagagcgagaagagtgatggagaccccatcgtggaccctgagaaggagaaggagcccaaggagggccaggaggaggtgctgaaggaggtggtggagagcgagggggagaggaagaccaaggtggagcgggacatcggggagggcaacctgagcacagctgctgctgctgccctggccgctgctgctgtgaaggccaagcacctggccgctgtggaggagaggaagatcaagagcctggtggccctgctggtggagacccagatgaagaagctggagatcaagctgcggcactttgaggagctggagaccatcatggaccgggagcgggaggccctggagtaccagaggcagcagctgctggccgaccggcaggccttccacatggagcagctgaagtatgcagagatgagggcccggcagcagcacttccagcagatgcaccagcagcagcagcagcccccaccagccctgcccccaggcagccagcccatcccccccaccggggctgctggccccccagctgtgcacggcctggccgtggccccagcctctgtggtgcctgccccagctggcagcggggcccctcctggcagcctgggccccagcgagcagatcggccaggccggcagcacagctggcccccagcagcagcagcctgctggggccccccagcccggggctgtgcccccaggagtgcccccacctggcccccacggccccagccccttccccaaccagcagaccccacccagcatgatgcctggagctgtgcccggcagcggccaccctggggtggccgaccccggcacccccctgcccccagaccccacagcccccagccctggcaccgtgacccctgtgcccccaccccagtag

SEQ ID NO: 172183 - DNA, 3459 bp, Artificial Sequence
  Description of Artificial Sequence: Synthetic coding sequence
atggctgtgaggaagaaggatggcggccccaacgtgaagtactatgaagctgctgacacagtgacccagtttgacaacgtgcggctgtggctgggcaagaactacaagaagtacatccaggccgagccccccaccaacaagagcctgagcagcctggtggtgcagctgctgcagttccaggaggaggtgtttgggaagcacgtgtccaatgcccccctgaccaagctgcccatcaagtgcttcctggacttcaaggccggcggcagcctgtgccacatcctggccgccgcctacaagttcaagagtgaccagggctggaggagatatgacttccagaaccccagcaggatggacagaaatgtggagatgttcatgaccatcgagaagagcctggtgcagaacaactgcctgagccggcccaacatcttcctgtgcccagaaattgagcccaagctgctgggcaagctgaaggacatcatcaagaggcaccagggcaccgtgacagaggacaagaacaatgccagccacgtggtgtaccctgtgcccggcaacctggaggaggaggagtgggtgcggcctgtgatgaagagggacaagcaggtgctgctgcactggggctactacccagacagctatgacacctggatcccagccagcgagattgaggcctctgtggaggatgcccccaccccagagaagcccaggaaggtgcacgccaagtggatcctggacacagacaccttcaatgagtggatgaatgaagaagattatgaggtgaatgatgacaagaaccctgtgtccaggaggaagaagatcagcgccaagaccctgacagatgaggtgaacagcccagacagcgaccggcgggacaagaagggcggcaactacaagaagaggaagaggagccccagccccagccccaccccagaggccaagaagaagaatgccaagaagggccccagcaccccctacaccaagagcaagaggggccaccgggaggaggagcaggaggacctgaccaaggacatggatgagcccagccctgtgcccaacgtggaggaggtgaccctgcccaagacagtgaacaccaagaaggacagcgagagcgcccctgtgaagggcggcaccatgacagacctggatgagcaggaggatgagagcatggagaccaccgggaaggatgaagatgagaacagcacaggcaacaagggggagcagaccaagaacccagacctgcacgaggacaacgtgacagagcagacccaccacatcatcatccccagctatgctgcctggtttgactacaacagcgtgcacgccattgaaagaagagccctgcctgagttcttcaacgggaagaacaagagcaagaccccagagatctacctggcctacagaaacttcatgattgacacctaccgcctgaacccccaggagtacctgaccagcacagcctgcagaagaaacctggccggagatgtgtgtgccatcatgagggtgcacgccttcctggagcagtggggcctcatcaactaccaggtggatgctgagagccggcccacccccatgggccccccacccaccagccacttccacgtgctggccgacaccccatctggcctggtgcccctgcagcccaagaccccccagggccggcaggtggatgctgacaccaaggccggcaggaagggcaaggagctggatgacctggtgcctgagacagccaagggcaagccagagctgcagaccagcgccagccagcagatgctgaacttcccagacaagggcaaggagaagcccacagacatgcagaactttggcctgaggacagacatgtacaccaagaagaatgtgcccagcaagagcaaggctgctgccagcgccacccgggagtggacagagcaggagaccctgctgctgctggaggccctggagatgtacaaggatgactggaacaaggtgtctgaacatgtgggcagcaggacccaggatgagtgcatcctgcacttcctgcggctgcccatcgaggacccctacctggaggacagcgaggccagcctgggccccctggcctaccagcccatccccttcagccagagcggcaaccctgtgatgagcacagtggccttcctggcctctgtggtggacccccgggtggccagcgctgctgccaagagcgccctggaggagttcagcaagatgaaggaggaggtgcccacagccctggtggaggcccacgtgaggaaggtggaggaggccgccaaggtgacaggcaaggctgaccctgccttcggcctggagagcagcggcattgctggcaccaccagtgatgagcctgagcgcatcgaggagagcggaaatgatgaggcccgggtggagggccaggccacagatgagaagaaggagcccaaggagccccgggagggcggcggggccatcgaggaggaggccaaggagaagaccagcgaggcccccaagaaggatgaggagaagggcaaggagggggacagcgagaaggagagcgagaagagtgatggagaccccatcgtggaccctgagaaggagaaggagcccaaggagggccaggaggaggtgctgaaggaggtggtggagagcgagggggagaggaagaccaaggtggagcgggacatcggggagggcaacctgagcacagctgctgctgctgccctggccgctgctgctgtgaaggccaagcacctggccgctgtggaggagaggaagatcaagagcctggtggccctgctggtggagacccagatgaagaagctggagatcaagctgcggcactttgaggagctggagaccatcatggaccgggagcgggaggccctggagtaccagaggcagcagctgctggccgaccggcaggccttccacatggagcagctgaagtatgcagagatgagggcccggcagcagcacttccagcagatgcaccagcagcagcagcagcccccaccagccctgcccccaggcagccagcccatcccccccaccggggctgctggccccccagctgtgcacggcctggccgtggccccagcctctgtggtgcctgccccagctggcagcggggcccctcctggcagcctgggccccagcgagcagatcggccaggccggcagcacagctggcccccagcagcagcagcctgctggggccccccagcccggggctgtgcccccaggagtgcccccacctggcccccacggccccagccccttccccaaccagcagaccccacccagcatgatgcctggagctgtgcccggcagcggccaccctggggtggccgcccagagccctgccatcgtggccgctgtgcagggcaacctgctgcccagcgccagccccctgcctgaccccggcacccccctgcccccagaccccacagcccccagccctggcaccgtgacccctgtgcccccaccccagtag

SEQ ID NO: 172184 - DNA, 1425 bp, Artificial Sequence
  Description of Artificial Sequence: Synthetic coding sequence
atggccgcccgggccggcttccagagcgtggcccccagcggcggggccggggccagcggcggggccggggctgctgctgccctgggccctgggggcaccccaggcccccctgtgaggatgggccctgcccctggccagggcctgtaccgcagccccatgcctggggccgcctaccccaggcctggcatgctgcccggcagcaggatgaccccccagggccccagcatgggccccccaggctatggaggcaaccccagcgtgcggcccggcctggcccagagcggcatggaccagagcaggaagaggcctgccccccagcagatccagcaggtgcagcagcaggccgtgcagaacagaaaccacaatgccaagaagaagaagatggctgacaagatcctgccccagaggatccgggagctggtgcctgagagccaggcctacatggacctgctggcctttgagaggaagctggaccagaccatcatgaggaagaggctggacatccaggaggccctgaagaggcccatcaagcagaagaggaagctgcgcatcttcatcagcaacaccttcaacccagccaagagtgatgctgaagatggagagggcaccgtggcctcctgggagctgcgggtggagggccgcctgctggaggacagcgccctgagcaaatatgatgccaccaagcagaagaggaagttcagcagcttcttcaagagcctggtgattgagctggacaaggacctgtatggccctgacaaccacctggtggagtggcacaggacagccaccacccaggagacagatggcttccaggtgaagaggcctggagatgtgaatgtgcgctgcaccgtgctgctgatgctggactaccagcccccccagttcaagctggacccccggctggcccggctgctgggcatccacacccagaccaggcctgtgatcatccaggccctgtggcagtacatcaagacccacaagctgcaggacccccatgagcgggagtttgtgatctgtgacaagtacctgcagcagatctttgagagccagaggatgaagttcagcgagatcccccagaggctgcacgccctgctgatgcctcctgagcccatcatcatcaaccacgtgatctctgtggaccccaatgaccagaagaagacagcctgctatgacattgatgtggaggtggatgacaccctgaagacccagatgaacagcttcctgctgagcacagccagccagcaggagatcgccaccctggacaacaagaccatgacagatgtggtgggcaaccctgaggaggagcggcgggcagagttctacttccagccctgggcccaggaggccgtgtgccgctacttctacagcaaggtgcagcagaggcggcaggagctggagcaggccctgggcatccggaacacctag

SEQ ID NO: 172185 - DNA, 1548 bp, Artificial Sequence
  Description of Artificial Sequence: Synthetic coding sequence
atggccgcccgggccggcttccagagcgtggcccccagcggcggggccggggccagcggcggggccggggctgctgctgccctgggccctgggggcaccccaggcccccctgtgaggatgggccctgcccctggccagggcctgtaccgcagccccatgcctggggccgcctaccccaggcctggcatgctgcccggcagcaggatgaccccccagggccccagcatgggccccccaggctatggaggcaaccccagcgtgcggcccggcctggcccagagcggcatggaccagagcaggaagaggcctgccccccagcagatccagcaggtgcagcagcaggccgtgcagaacagaaaccacaatgccaagaagaagaagatggctgacaagatcctgccccagaggatccgggagctggtgcctgagagccaggcctacatggacctgctggcctttgagaggaagctggaccagaccatcatgaggaagaggctggacatccaggaggccctgaagaggcccatcaagcagaagaggaagctgcgcatcttcatcagcaacaccttcaacccagccaagagtgatgctgaagatggagagggcaccgtggcctcctgggagctgcgggtggagggccgcctgctggaggacagcgccctgagcaaatatgatgccaccaagcagaagaggaagttcagcagcttcttcaagagcctggtgattgagctggacaaggacctgtatggccctgacaaccacctggtggagtggcacaggacagccaccacccaggagacagatggcttccaggtgaagaggcctggagatgtgaatgtgcgctgcaccgtgctgctgatgctggactaccagcccccccagttcaagctggacccccggctggcccggctgctgggcatccacacccagaccaggcctgtgatcatccaggccctgtggcagtacatcaagacccacaagctgcaggacccccatgagcgggagtttgtgatctgtgacaagtacctgcagcagatctttgagagccagaggatgaagttcagcgagatcccccagaggctgcacgccctgctgatgcctcctgagcccatcatcatcaaccacgtgatctctgtggaccccaatgaccagaagaagacagcctgctatgacattgatgtggaggtggatgacaccctgaagacccagatgaacagcttcctgctgagcacagccagccagcaggagatcgccaccctggacaacaagatccacgagaccatcgagaccatcaaccagctgaagacccagcgggagttcatgctgagctttgcccgggacccccagggcttcatcaatgactggctgcagagccagtgccgggacctgaagaccatgacagatgtggtgggcaaccctgaggaggagaggagagctgagttctacttccagccctgggcccaggaggccgtgtgccgctacttctacagcaaggtgcagcagaggcggcaggagctggagcaggccctgggcatccggaacacctag

SEQ ID NO: 172186 - DNA, 876 bp, Artificial Sequence
  Description of Artificial Sequence: Synthetic coding sequence
atgatgcccctgaacaagaggggcagcagcctgcccttcaagagcctggtgattgagctggacaaggacctgtatggccctgacaaccacctggtggagtggcacaggacagccaccacccaggagacagatggcttccaggtgaagaggcctggagatgtgaatgtgcgctgcaccgtgctgctgatgctggactaccagcccccccagttcaagctggacccccggctggcccggctgctgggcatccacacccagaccaggcctgtgatcatccaggccctgtggcagtacatcaagacccacaagctgcaggacccccatgagcgggagtttgtgatctgtgacaagtacctgcagcagatctttgagagccagaggatgaagttcagcgagatcccccagaggctgcacgccctgctgatgcctcctgagcccatcatcatcaaccacgtgatctctgtggaccccaatgaccagaagaagacagcctgctatgacattgatgtggaggtggatgacaccctgaagacccagatgaacagcttcctgctgagcacagccagccagcaggagatcgccaccctggacaacaagatccacgagaccatcgagaccatcaaccagctgaagacccagcgggagttcatgctgagctttgcccgggacccccagggcttcatcaatgactggctgcagagccagtgccgggacctgaagaccatgacagatgtggtgggcaaccctgaggaggagaggagagctgagttctacttccagccctgggcccaggaggccgtgtgccgctacttctacagcaaggtgcagcagaggcggcaggagctggagcaggccctgggcatccggaacacctag

SEQ ID NO: 172187 - DNA, 1362 bp, Artificial Sequence; identical to SEQ ID NO: 143216
  Description of Artificial Sequence: Synthetic coding sequence

SEQ ID NO: 172188 - DNA, 1452 bp, Artificial Sequence
  Description of Artificial Sequence: Synthetic coding sequence
atgggcagaagagtgggcgtggaggtgaccccccgctgggccccccagaagtgccagggcgcccggccccagaggcctggcatgagccctggcaacaggatgcccatggccggcctgcaggtgggccccccagctggcagcccctttggagctgctgcccccctgcggcccggcatgccacccaccatgatggaccccttcaggaagaggctgctggtgccccaggcccagccccccatgcctgcccagaggcggggcctgaagaggaggaagatggctgacaaggtgctgccccagaggatccgggagctggtgcctgagagccaggcctacatggacctgctggcctttgagaggaagctggaccagaccatcgccaggaagaggatggagatccaggaggccatcaagaagcccctgacccagaagaggaagctgcgcatctacatcagcaacaccttcagccccagcaaggccgagggggacagcgctggaacagctggcacccctgggggcaccccagctggggacaaggtggcctcctgggagctgcgggtggagggcaagctgctggatgaccccagcaagcagaagaggaagttcagcagcttcttcaagagcctggtgattgagctggacaaggagctgtatggccctgacaaccacctggtggagtggcacaggatgcccaccacccaggagacagatggcttccaggtgaagaggcctggggacctgaatgtgaagtgcaccctgctgctgatgctggaccaccagcccccccagtacaagctggacccccggctggcccggctgctgggcgtgcacacccagaccagggctgccatcatgcaggccctgtggctgtacatcaagcacaaccagctgcaggacggccacgagcgggagtacatcaactgcaaccgctacttccggcagatcttcagctgtggccgcctgcgcttcagcgagatccccatgaagctggccggcctgctgcagcacccagaccccatcgtcatcaaccacgtgatctctgtggaccccaatgaccagaagaagacagcctgctatgacattgatgtggaggtggatgaccccctgaaggcccagatgagcaacttcctggccagcaccaccaaccagcaggagatcgccagcctggatgtgaagatccacgagaccatcgagagcatcaaccagctgaagacccagagggacttcatgctgtccttcagcacagacccccaggacttcatccaggagtggctgcggagccagaggcgggacctgaagatcatcacagatgtgattggcaaccctgaggaggagaggagagctgccttctaccaccagccctgggcccaggaggccgtgggccgccacatctttgccaaggtgcagcagaggcggcaggagctggagcaggtgctgggcatccggctgacctag

SEQ ID NO: 172189 - DNA, 1596 bp, Artificial Sequence
  Description of Artificial Sequence: Synthetic coding sequence
atgagcggccgcggggccggcggcttccccctgccccccctgagccctgggggcggcgctgtggccgccgccctgggcgcccctcctcctcctgctggccctggcatgctgcccggccctgccctgcggggccctggccctgctgggggcgtgggcggccctggagctgctgccttccggcccatgggccctgctggccctgctgcccagtaccagaggcctggcatgagccctggcaacaggatgcccatggccggcctgcaggtgggccccccagctggcagcccctttggagctgctgcccccctgcggcccggcatgccacccaccatgatggaccccttcaggaagaggctgctggtgccccaggcccagccccccatgcctgcccagaggcggggcctgaagaggaggaagatggctgacaaggtgctgccccagaggatccgggagctggtgcctgagagccaggcctacatggacctgctggcctttgagaggaagctggaccagaccatcgccaggaagaggatggagatccaggaggccatcaagaagcccctgacccagaagaggaagctgcgcatctacatcagcaacaccttcagccccagcaaggccgagggggacagcgctggaacagctggcacccctgggggcaccccagctggggacaaggtggcctcctgggagctgcgggtggagggcaagctgctggatgaccccagcaagcagaagaggaagttcagcagcttcttcaagagcctggtgattgagctggacaaggagctgtatggccctgacaaccacctggtggagtggcacaggatgcccaccacccaggagacagatggcttccaggtgaagaggcctggggacctgaatgtgaagtgcaccctgctgctgatgctggaccaccagcccccccagtacaagctggacccccggctggcccggctgctgggcgtgcacacccagaccagggctgccatcatgcaggccctgtggctgtacatcaagcacaaccagctgcaggacggccacgagcgggagtacatcaactgcaaccgctacttccggcagatcttcagctgtggccgcctgcgcttcagcgagatccccatgaagctggccggcctgctgcagcacccagaccccatcgtcatcaaccacgtgatctctgtggaccccaatgaccagaagaagacagcctgctatgacattgatgtggaggtggatgaccccctgaaggcccagatgagcaacttcctggccagcaccaccaaccagcaggagatcgccagcctggatgtgaagatccacgagaccatcgagagcatcaaccagctgaagacccagagggacttcatgctgtccttcagcacagacccccaggacttcatccaggagtggctgcggagccagaggcgggacctgaagatcatcacagatgtgattggcaaccctgaggaggagaggagagctgccttctaccaccagccctgggcccaggaggccgtgggccgccacatctttgccaaggtgcagcagaggcggcaggagctggagcaggtgctgggcatccggctgacctag

SEQ ID NO: 172190 - DNA, 1485 bp, Artificial Sequence
  Description of Artificial Sequence: Synthetic coding sequence
atgagcggccgcggggccggcggcttccccctgccccccctgagccctgggggcggggccgccttccggcccatgggccctgctggccctgctgcccagtaccagaggcctggcatgagccctggcaacaggatgcccatggccggcctgcaggtgggccccccagctggcagcccctttggagctgctgcccccctgcggcccggcatgccacccaccatgatggaccccttcaggaagaggctgctggtgccccaggcccagccccccatgcctgcccagaggcggggcctgaagaggaggaagatggctgacaaggtgctgccccagaggatccgggagctggtgcctgagagccaggcctacatggacctgctggcctttgagaggaagctggaccagaccatcgccaggaagaggatggagatccaggaggccatcaagaagcccctgacccagaagaggaagctgcgcatctacatcagcaacaccttcagccccagcaaggccgagggggacagcgctggaacagctggcaccccaggcggcaccccagctggggacaaggtggcctcctgggagctgcgggtggagggcaagctgctggatgaccccagcaagcagaagaggaagttcagcagcttcttcaagagcctggtgattgagctggacaaggagctgtatggccctgacaaccacctggtggagtggcacaggatgcccaccacccaggagacagatggcttccaggtgaagaggcctggggacctgaatgtgaagtgcaccctgctgctgatgctggaccaccagcccccccagtacaagctggacccccggctggcccggctgctgggcgtgcacacccagacccgggccgccatcatgcaggccctgtggctgtacatcaagcacaaccagctgcaggacggccacgagcgggagtacatcaactgcaaccgctacttccggcagatcttcagctgtggccgcctgcgcttcagcgagatccccatgaagctggccggcctgctgcagcacccagaccccatcgtcatcaaccacgtgatctctgtggaccccaatgaccagaagaagacagcctgctatgacattgatgtggaggtggatgaccccctgaaggcccagatgagcaacttcctggccagcaccaccaaccagcaggagatcgccagcctggatgtgaagatccacgagaccatcgagagcatcaaccagctgaagacccagagggacttcatgctgtccttcagcacagacccccaggacttcatccaggagtggctgcggagccagaggcgggacctgaagatcatcacagatgtgattggcaaccctgaggaggagcggcgggccgccttctaccaccagccctgggcccaggaggccgtgggccgccacatctttgccaaggtgcagcagaggcggcaggagctggagcaggtgctgggcatccggctgacctag

SEQ ID NO: 172191 - DNA, 1452 bp, Artificial Sequence
  Description of Artificial Sequence: Synthetic coding sequence
atggctgctgatgaggtggccggcggggccaggaaggccaccaagagcaagctgtttgagttcctggtgcacggcgtgcggcccggcatgcccagcggggccaggatgccccaccagggcgcccccatgggccccccaggcagcccctacatgggcagccctgctgtgcggcccggcctggccccagctggcatggagcccgccaggaagagagctgcccctcctcctggccagagccaggcccagagccagggccagcctgtgcccacagccccagcccggagccgcagcgccaagaggaggaagatggctgacaagatcctgccccagaggatccgggagctggtgcctgagagccaggcctacatggacctgctggcctttgagaggaagctggaccagaccatcatgaggaagagggtggacatccaggaggccctgaagaggcccatgaagcagaagaggaagctgcggctgtacatcagcaacaccttcaacccagccaagccagatgctgaagattctgatggcagcatcgcctcctgggagctgcgggtggagggcaagctgctggatgaccccagcaagcagaagaggaagttcagcagcttcttcaagagcctggtgattgagctggacaaggacctgtatggccctgacaaccacctggtggagtggcacaggacccccaccacccaggagacagatggcttccaggtgaagaggcctggggacctgtctgtgcgctgcaccctgctgctgatgctggactaccagcccccccagttcaagctggacccccggctggcccggctgctgggcctgcacacccagagccgcagcgccatcgtgcaggccctgtggcagtatgtgaagaccaaccggctgcaggacagccatgacaaggagtacatcaacggggacaagtacttccagcagatctttgactgcccccggctgaagttcagcgagatcccccagaggctgacagccctgctgctgcccccagaccccatcgtcatcaaccacgtgatctctgtggaccccagcgaccagaagaagacagcctgctatgacattgatgtggaggtggaggagcccctgaagggccagatgagcagcttcctgctgagcacagccaaccagcaggagatcagcgccctggacagcaagatccacgagaccatcgagagcatcaaccagctgaagatccagagggacttcatgctgtccttcagccgggaccccaagggctacgtgcaggacctgctgcggagccagagccgggacctgaaggtgatgacagatgtggccggcaaccctgaggaggagaggagagctgagttctaccaccagccctggagccaggaggccgtgagccgctacttctactgcaagatccagcagaggcggcaggagctggagcagagcctggtggtgaggaacacctag

SEQ ID NO: 172192 - DNA, 1308 bp, Artificial Sequence
  Description of Artificial Sequence: Synthetic coding sequence
atgaccccaggcctgcagcacccccccaccgtggtgcagaggcctggcatgcccagcggggccaggatgccccaccagggcgcccccatgggccccccaggcagcccctacatgggcagccctgctgccccagcccggagccgcagcgccaagaggaggaagatggctgacaagatcctgccccagaggatccgggagctggtgcctgagagccaggcctacatggacctgctggcctttgagaggaagctggaccagaccatcatgaggaagagggtggacatccaggaggccctgaagaggcccatgaagcagaagaggaagctgcggctgtacatcagcaacaccttcaacccagccaagccagatgctgaagattctgatggcagcatcgcctcctgggagctgcgggtggagggcaagctgctggatgaccccagcaagcagaagaggaagttcagcagcttcttcaagagcctggtgattgagctggacaaggacctgtatggccctgacaaccacctggtggagtggcacaggacccccaccacccaggagacagatggcttccaggtgaagaggcctggggacctgtctgtgcgctgcaccctgctgctgatgctggactaccagcccccccagttcaagctggacccccggctggcccggctgctgggcctgcacacccagagccgcagcgccatcgtgcaggccctgtggcagtatgtgaagaccaaccggctgcaggacagccatgacaaggagtacatcaacggggacaagtacttccagcagatctttgactgcccccggctgaagttcagcgagatcccccagaggctgacagccctgctgctgcccccagaccccatcgtcatcaaccacgtgatctctgtggaccccagcgaccagaagaagacagcctgctatgacattgatgtggaggtggaggagcccctgaagggccagatgagcagcttcctgctgagcacagccaaccagcaggagatcagcgccctggacagcaagatccacgagaccatcgagagcatcaaccagctgaagatccagagggacttcatgctgtccttcagccgggaccccaagggctacgtgcaggacctgctgcggagccagagccgggacctgaaggtgatgacagatgtggccggcaaccctgaggaggagaggagagctgagttctaccaccagccctggagccaggaggccgtgagccgctacttctactgcaagatccagcagaggcggcaggagctggagcagagcctggtggtgaggaacacctag

SEQ ID NO: 172193 - DNA, 1413 bp, Artificial Sequence
  Description of Artificial Sequence: Synthetic coding sequence
atgaccccaggcctgcagcacccccccaccgtggtgcagaggcctggcatgcccagcggggccaggatgccccaccagggcgcccccatgggccccccaggcagcccctacatgggcagccctgctgtgcggcccggcctggccccagctggcatggagcccgccaggaagagagctgcccctcctcctggccagagccaggcccagagccagggccagcctgtgcccacagccccagcccggagccgcagcgccaagaggaggaagatggctgacaagatcctgccccagaggatccgggagctggtgcctgagagccaggcctacatggacctgctggcctttgagaggaagctggaccagaccatcatgaggaagagggtggacatccaggaggccctgaagaggcccatgaagcagaagaggaagctgcggctgtacatcagcaacaccttcaacccagccaagccagatgctgaggacagtgatggcagcatcgcctcctgggagctgcgggtggagggcaagctgctggatgaccccagcaagcagaagaggaagttcagcagcttcttcaagagcctggtgattgagctggacaaggacctgtatggccctgacaaccacctggtggagtggcacaggacccccaccacccaggagacagatggcttccaggtgaagaggcctggggacctgtctgtgcgctgcaccctgctgctgatgctggactaccagcccccccagttcaagctggacccccggctggcccggctgctgggcctgcacacccagagccgcagcgccatcgtgcaggccctgtggcagtatgtgaagaccaaccggctgcaggacagccatgacaaggagtacatcaatggagacaagtacttccagcagatctttgactgcccccggctgaagttcagcgagatcccccagaggctgacagccctgctgctgcccccagaccccatcgtcatcaaccacgtgatctctgtggaccccagcgaccagaagaagacagcctgctatgacattgatgtggaggtggaggagcccctgaagggccagatgagcagcttcctgctgagcacagccaaccagcaggagatcagcgccctggacagcaagatccacgagaccatcgagagcatcaaccagctgaagatccagagggacttcatgctgtccttcagccgggaccccaagggctacgtgcaggacctgctgcggagccagagccgggacctgaaggtgatgacagatgtggccggcaaccctgaggaggagcggcgggcagagttctaccaccagccctggagccaggaggccgtgagccgctacttctactgcaagatccagcagaggcggcaggagctggagcagagcctggtggtgaggaacacctag

SEQ ID NO: 172194 - DNA, 1413 bp, Artificial Sequence; identical to SEQ ID NO: 172193
  Description of Artificial Sequence: Synthetic coding sequence

SEQ ID NO: 172195 - DNA, 420 bp, Artificial Sequence
  Description of Artificial Sequence: Synthetic coding sequence
atgaccccaggcctgcagcacccccccaccgtggtgcagaggcctggcatgcccagcggggccaggatgccccaccagggcgcccccatgggccccccaggcagcccctacatgggcagccctgctgtgcggcccggcctggccccagctggcatggagcccgccaggaagagagctgcccctcctcctggccagagccaggcccagagccagggccagcctgtgcccacagccccagcccggagccgcagcgccaagaggaggaagatggctgacaagatcctgccccagaggatccgggagctggtgcctgagagccaggcctacatggacctgctggcctttgagaggaagctggaccagaccatcatgaggaagagggtggacatccaggaggccctgaagaggcccatgaagtag

SEQ ID NO: 172196 - DNA, 3081 bp, Artificial Sequence
  Description of Artificial Sequence: Synthetic coding sequence
atgaacctcttcaacctggaccgcttccgctttgagaagaggaacaagattgaggaggcccctgaggccaccccccagcccagccagcccggccccagcagccccatcagcctgtctgctgaggaggagaatgctgagggggaggtgtcccgggccaacaccccagacagcgacatcacagagaagacagaggacagctctgtgcctgagaccccagacaatgaaaggaaggccagcatctcctacttcaagaaccagaggggcatccagtacatcgacctgagcagtgacagtgaagatgtggtgagccccaactgcagcaacacagtgcaggagaagaccttcaacaaggacaccgtcatcatcgtgtctgagcccagtgaagatgaggagagccagggcctgcccaccatggccaggagaaatgatgacatcagcgagctggaggacctgtctgagctggaggacctgaaggatgccaagctgcagaccctgaaggagctgttcccccagaggagtgacaatgacctgctgaagctgattgagagcaccagcaccatggatggagccatcgctgctgccctgctgatgtttggagatgctgggggcggccccaggaagaggaagctgagcagcagcagcgagccctatgaagaagatgagttcaatgatgaccagagcatcaagaagacccggctggaccatggagaggagagcaatgaatctgctgagagcagcagcaactgggagaagcaggagagcatcgtgctgaagctgcagaaggagttccccaactttgacaagcaggagctgcgggaggtgctgaaggagcacgagtggatgtacacagaggccctggagagcctgaaggtgtttgctgaggaccaggacatgcagtatgtgtcccagagcgaggtgcccaacgggaaggaggtgagcagccgcagccagaactaccccaagaatgccaccaagaccaagctgaagcagaagttctccatgaaggcccagaatggcttcaacaagaagaggaagaagaatgtgttcaaccccaagagggtggtggaggacagtgaatatgacagcggcagtgatgtgggcagcagcctggatgaggactacagcagcggggaggaggtgatggaggatggctacaagggcaagatcctgcacttcctgcaggatgccagcatcggggagctgaccctcatcccccagtgcagccagaagaaggcccagaagatcacagagctgcggcccttcaacagctgggaggccctcttcaccaagatgagcaagaccaacggcctgtctgaagatctcatctggcactgcaagaccctcatccaggagagagatgtggtgatccggctgatgaacaagtgtgaggacatcagcaacaagctgaccaagcaggtgaccatgctgactggaaatggaggcggctggaacatcgagcagcccagcatcctgaaccagagcctgagcctgaagccctaccagaaggtgggcctgaactggctggccctggtgcacaagcacggcctgaatggcatcctggctgatgagatgggcctgggcaagaccatccaggccatcgccttcctggcctacctgtaccaggagggcaacaacggcccccacctgattgtggtgcctgccagcaccatcgacaactggctgcgggaggtgaacctgtggtgccccaccctgaaggtgctgtgctactacggcagccaggaggagaggaagcagatccgcttcaacatccacagccgctatgaggactacaacgtcatcgtgaccacctacaactgtgccatcagcagcagtgatgacaggagcctcttccggcggctgaagctgaactatgccatctttgatgagggccacatgctgaagaacatgggcagcatccgctaccagcacctgatgaccatcaatgccaacaaccggctgctgctgaccggcacccctgtgcagaacaacctgctggagctgatgagcctgctgaactttgtgatgccccacatgttcagcagcagcaccagcgagatccggaggatgttcagcagcaagaccaagtctgcagatgagcagagcatctatgagaaggagcgcatcgcccacgccaagcagatcatcaagcccttcatcctgcggcgggtgaaggaggaggtgctgaagcagctgccccccaagaaggaccgcatcgagctgtgtgccatgtctgagaagcaggagcagctgtacctgggcctcttcaaccggctgaagaagagcatcaacaacctggagaagaacacagagatgtgcaatgtgatgatgcagctgaggaagatggccaaccaccccctgctgcaccggcagtactacacagctgagaagctgaaggagatgagccagctgatgctgaaggagcccacccactgtgaggccaacccagacctgatctttgaggacatggaggtgatgacagactttgagctgcacgtgctgtgcaagcagtaccgccacatcaacaacttccagctggacatggacctgatcctggacagcggcaagttccgggtgctgggctgcatcctgtctgagctgaagcagaagggggacagagtggtgctcttcagccagttcaccatgatgctggacatcctggaggtgctgctgaagcaccaccagcaccgctacctgcggctggatggcaagacccagatcagcgagcgcatccacctgattgatgagttcaacacagacatggacatctttgtgttcctgctgagcaccaaggccggcggcctgggcatcaacctgaccagcgccaacgtggtgatcctgcatgacatcgactgcaacccctacaatgacaagcaggccgaggaccgctgccaccgggtgggccagaccaaggaggtgctggtgatcaagctgatcagccagggcaccatcgaggagagcatgctgaagatcaaccagcagaagctgaagctggagcaggacatgaccaccgtggatgaaggagatgagggctccatgcctgctgacatcgccaccctgctgaagacctccatgggcctgtag

SEQ ID NO: 172197 - DNA, 3087 bp, Artificial Sequence
  Description of Artificial Sequence: Synthetic coding sequence
atgaacctcttcaacctggaccgcttccgctttgagaagaggaacaagattgaggaggcccctgaggccaccccccagcccagccagcccggccccagcagccccatcagcctgtctgctgaggaggagaatgctgagggggaggtgtcccgggccaacaccccagacagcgacatcacagagaagacagaggacagctctgtgcctgagaccccagacaatgaaaggaaggccagcatctcctacttcaagaaccagaggggcatccagtacatcgacctgagcagtgacagtgaagatgtggtgagccccaactgcagcaacacagtgcaggagaagaccttcaacaaggacaccgtcatcatcgtgtctgagcccagtgaagatgaggagagccagggcctgcccaccatggccaggagaaatgatgacatcagcgagctggaggacctgtctgagctggaggacctgaaggatgccaagctgcagaccctgaaggagctgttcccccagaggagtgacaatgacctgctgaagctgattgagagcaccagcaccatggatggagccatcgctgctgccctgctgatgtttggagatgctgggggcggccccaggaagaggaagctgagcagcagcagcgagccctatgaagaagatgagttcaatgatgaccagagcatcaagaagacccggctggaccatggagaggagagcaatgaatctgctgagagcagcagcaactgggagaagcaggagagcatcgtgctgaagctgcagaaggagttccccaactttgacaagcaggagctgcgggaggtgctgaaggagcacgagtggatgtacacagaggccctggagagcctgaaggtgtttgctgaggaccaggacatgcagtatgtgtcccagagcgaggtgcccaacgggaaggaggtgagcagccgcagccagaactaccccaagaatgccaccaagaccaagctgaagcagaagttctccatgaaggcccagaatggcttcaacaagaagaggaagaagaatgtgttcaaccccaagagggtggtggaggacagtgaatatgacagcggcagtgatgtgggcagcagcctggatgaggactacagcagcggggaggaggtgatggaggatggctacaagggcaagatcctgcacttcctgcaggatgccagcatcggggagctgaccctcatcccccagtgcagccagaagaaggcccagaagatcacagagctgcggcccttcaacagctgggaggccctcttcaccaagatgagcaagaccaacggcctgtctgaagatctcatctggcactgcaagaccctcatccaggagagagatgtggtgatccggctgatgaacaagtgtgaggacatcagcaacaagctgaccaagcaggtgaccatgctgactggaaatggaggcggctggaacatcgagcagcccagcatcctgaaccagagcctgagcctgaagccctaccagaaggtgggcctgaactggctggccctggtgcacaagcacggcctgaatggcatcctggctgatgagatgggcctgggcaagaccatccaggccatcgccttcctggcctacctgtaccaggagggcaacaacggcccccacctgattgtggtgcctgccagcaccatcgacaactggctgcgggaggtgaacctgtggtgccccaccctgaaggtgctgtgctactacggcagccaggaggagaggaagcagatccgcttcaacatccacagccgctatgaggactacaacgtcatcgtgaccacctacaactgtgccatcagcagcagtgatgacaggagcctcttccggcggctgaagctgaactatgccatctttgatgagggccacatgctgaagaacatgggcagcatccgctaccagcacctgatgaccatcaatgccaacaaccggctgctgctgaccggcacccctgtgcagaacaacctgctggagctgatgagcctgctgaactttgtgatgccccacatgttcagcagcagcaccagcgagatccggaggatgttcagcagcaagaccaagtctgcagatgagcagagcatctatgagaaggagcgcatcgcccacgccaagcagatcatcaagcccttcatcctgcggcgggtgaaggaggaggtgctgaagcagctgccccccaagaaggaccgcatcgagctgtgtgccatgtctgagaagcaggagcagctgtacctgggcctcttcaaccggctgaagaagagcatcaacaacctggtgacagagaagaacacagagatgtgcaatgtgatgatgcagctgaggaagatggccaaccaccccctgctgcaccggcagtactacacagctgagaagctgaaggagatgagccagctgatgctgaaggagcccacccactgtgaggccaacccagacctgatctttgaggacatggaggtgatgacagactttgagctgcacgtgctgtgcaagcagtaccgccacatcaacaacttccagctggacatggacctgatcctggacagcggcaagttccgggtgctgggctgcatcctgtctgagctgaagcagaagggggacagagtggtgctcttcagccagttcaccatgatgctggacatcctggaggtgctgctgaagcaccaccagcaccgctacctgcggctggatggcaagacccagatcagcgagcgcatccacctgattgatgagttcaacacagacatggacatctttgtgttcctgctgagcaccaaggccggcggcctgggcatcaacctgaccagcgccaacgtggtgatcctgcatgacatcgactgcaacccctacaatgacaagcaggccgaggaccgctgccaccgggtgggccagaccaaggaggtgctggtgatcaagctgatcagccagggcaccatcgaggagagcatgctgaagatcaaccagcagaagctgaagctggagcaggacatgaccaccgtggatgaaggagatgagggctccatgcctgctgacatcgccaccctgctgaagacctccatgggcctgtag

SEQ ID NO: 172198 - DNA, 3087 bp, Artificial Sequence; identical to SEQ ID NO: 172197
  Description of Artificial Sequence: Synthetic coding sequence

SEQ ID NO: 172199 - DNA, 957 bp, Artificial Sequence
  Description of Artificial Sequence: Synthetic coding sequence
atgaacctcttcaacctggaccgcttccgctttgagaagaggaacaagattgaggaggcccctgaggccaccccccagcccagccagcccggccccagcagccccatcagcctgtctgctgaggaggagaatgctgagggggaggtgtcccgggccaacaccccagacagcgacatcacagagaagacagaggacagctctgtgcctgagaccccagacaatgaaaggaaggccagcatctcctacttcaagaaccagaggggcatccagtacatcgacctgagcagtgacagtgaagatgtggtgagccccaactgcagcaacacagtgcaggagaagaccttcaacaaggacaccgtcatcatcgtgtctgagcccagtgaagatgaggagagccagggcctgcccaccatggccaggagaaatgatgacatcagcgagctggaggacctgtctgagctggaggacctgaaggatgccaagctgcagaccctgaaggagctgttcccccagaggagtgacaatgacctgctgaagctgattgagagcaccagcaccatggatggagccatcgctgctgccctgctgatgtttggagatgctgggggcggccccaggaagaggaagctgagcagcagcagcgagccctatgaagaagatgagttcaatgatgaccagagcatcaagaagacccggctggaccatggagaggagagcaatgaatctgctgagagcagcagcaactgggagaagcaggagagcatcgtgctgaagctgcagaaggagttccccaactttgacaagcaggagctgcgggaggtgctgaaggagcacgagtggatgtacacagaggccctggagagcctgaaggtgtttgctgaggaccaggacatgcagtatgtgtcccagagcgaggtgcccaacgggaagaagaaggcccagaagaagaagaagtag

SEQ ID NO: 172200 - DNA, 732 bp, Artificial Sequence
  Description of Artificial Sequence: Synthetic coding sequence
atggccgccatcgccgccagcgaggtgctggtggacagcgctgaggagggcagcctggccgctgctgctgagctggccgcccagaagcgggagcagaggctgaggaagttccgggagctgcacctgatgagaaatgaggccaggaagctgaaccaccaggaggtggtggaggaggacaagaggctgaagctgcctgccaactgggaggccaagaaggcccggctggagtgggagctgaaggaggaggagaagaagaaggaatgtgccgcccggggagaagattatgagaaggtgaagctgctggagatctctgcagaagatgctgagcgctgggagaggaagaagaagaggaagaacccagacctgggcttcagtgactatgctgctgcccagctgcggcagtaccaccggctgaccaagcagatcaagccagacatggagacctatgagcggctgcgggagaagcacggggaggagttcttccccaccagcaacagcctgctgcacggcacccacgtgcccagcacagaggagattgacaggatggtgattgacctggagaagcagatcgagaagagggacaagtacagcagaagaagaccctacaatgatgatgctgacatcgactacatcaatgaaagaaatgccaagttcaacaagaaggccgagcgcttctacggcaagtacacagctgagatcaagcagaacctggagcggggcacagctgtgtag

SEQ ID NO: 172201 - DNA, 606 bp, Artificial Sequence
  Description of Artificial Sequence: Synthetic coding sequence
atggccgccatcgccgccagcgaggtgctggtggacagcgctgaggagggcagcctggccgctgctgctgagctggccgcccagaagcgggagcagaggctgaggaagttccgggagctgcacctgatgagagaatgtgccgcccggggagaagattatgagaaggtgaagctgctggagatctctgcagaagatgctgagcgctgggagaggaagaagaagaggaagaacccagacctgggcttcagtgactatgctgctgcccagctgcggcagtaccaccggctgaccaagcagatcaagccagacatggagacctatgagcggctgcgggagaagcacggggaggagttcttccccaccagcaacagcctgctgcacggcacccacgtgcccagcacagaggagattgacaggatggtgattgacctggagaagcagatcgagaagagggacaagtacagcagaagaagaccctacaatgatgatgctgacatcgactacatcaatgaaagaaatgccaagttcaacaagaaggccgagcgcttctacggcaagtacacagctgagatcaagcagaacctggagcggggcacagctgtgtag

SEQ ID NO: 172202 - DNA, 777 bp, Artificial Sequence
  Description of Artificial Sequence: Synthetic coding sequence
atggatggcatcatcgagcagaagtccatgctggtgcacagcaagatcagtgatgctgggaagagaaatggcctcatcaacaccaggaacctgatggccgagagcagagatggcctggtgtctgtgtacccagccccccagtaccagagccaccgggtgggcgccagcacagtgcctgccagcctggacagcagccgctctgagcccatgcagcagctgctggaccccaacaccctgcagcagagcgtggagagccgctaccggcccaacatcatcctgtacagcgagggcgtgctgcgctcctggggagatggagtggccgctgactgctgtgagaccaccttcattgaagatagaagccccaccaaggacagcctggagtacccagatggcaagttcatcgacctgtctgcagatgacatcaagatccacaccctgtcctatgatgtggaggaggaggaggagttccaggagctggagagtgactacagcagtgacacagaaagtgaggacaacttcctgatgatgccaccccgggaccacctgggcctgtctgtgttctccatgctgtgctgcttctggcccctgggcattgctgccttctacctgagccatgagaccaacaaggctgtggccaagggggacctgcaccaggccagcaccagcagccggcgggccctcttcctggccgtgctgagcatcaccatcggcaccggggtgtatgtgggcgtggccgtggccctgattgcctacctgagcaagaacaaccacctgtag

SEQ ID NO: 172203 - DNA, 717 bp, Artificial Sequence
  Description of Artificial Sequence: Synthetic coding sequence
atggagagcctgtctgagctgcagaaccccctgctgcccaggagccctgcccacctgcacggcccctacccctacccagagaccccacccagctggagctgccaggagaagctgtacagctacctgctgggcggggccggccctgctggggcccaccagctgctggaccccggcagcctgcagctggccgtggaggcctggtaccggcccagctgcctgctgggccgggacaaggtgaaggagccccgggccggcagctgtgagaccagcttcacagaagatcgggagccccaggagggccccccagagcagcccaccggccctggccaggccgcagaaaatgtgaccatccagacagtgtcctatggagtgcaggaggagctgcgggaccaggaggatgaccaggaggaggaggagagtgatgccaccagcacagaaagtgaaagtgaggacaacttcctgaccctgcccccccgggaccacctgggcctgaccctcttctccatgctgtgctgcttctggcccctgggcattgctgccttctacttcagccagggcaccagcaaggccatcagcaaaggagacttccggctggccagcaccaccagccggcgggccctcttcctggccaccctggccatcgctgtgggcgccggcctgtatgtggccgtggtggtggccctggccgcctacatgagccagaatggacatggatag

SEQ ID NO: 172204 - DNA, 717 bp, Artificial Sequence; identical to SEQ ID NO: 172203
  Description of Artificial Sequence: Synthetic coding sequence

SEQ ID NO: 172205 - DNA, 243 bp, Artificial Sequence
  Description of Artificial Sequence: Synthetic coding sequence
atggagagcctgtctgagctgcagaaccccctgctgcccaggagccctgcccacctgcacggcccctacccctacccagagaccccacccagctggagctgccaggagaagctgtacagctacctgctgggcggggccggccctgctggggcccaccagctgctggaccccggcagcctgcagctggccgtggaggcctggtaccggcccagctgcctgctgggccgggacaaggtgaagtag

SEQ ID NO: 172206 - DNA, 2118 bp, Artificial Sequence
  Description of Artificial Sequence: Synthetic coding sequence
atgaactacctgcggcggcggctgagtgacagcaacttcatggccaacctgcccaacggctacatgacagacctgcagaggccccagcccccacctcctcctcctggggcccacagccctggggccaccccaggccctggaacagccacagctgagaggagcagtggagtggccccagctgccagccctgctgcccccagccctggcagcagcggcggcggcggcttcttcagcagcctgagcaatgctgtgaagcagaccacagctgctgctgctgccaccttcagcgagcaggtgggcggcggcagcggcggggccggccggggcggggccgccagccgggtgctgctggtgattgatgagccccacacagactgggccaagtacttcaagggcaagaagatccacggggagattgacatcaaggtggagcaggccgagttcagtgacctgaacctggtggcccacgccaacggcggcttctctgtggacatggaggtgctgagaaatggagtgaaggtggtgcgcagcctgaagccagactttgtgctgatccggcagcacgccttctccatggccagaaatggagactaccgcagcctggtgattggcctgcagtatgccggcatccccagcgtgaacagcctgcacagcgtgtacaacttctgtgacaagccctgggtgtttgcccagatggtgcggctgcacaagaagctgggcacagaggagttccccctgattgaccagaccttctaccccaaccacaaggagatgctgagcagcaccacctaccctgtggtggtgaagatgggccacgcccacagcggcatgggcaaggtgaaggtggacaaccagcacgacttccaggacatcgcctctgtggtggccctgaccaagacctacgccacagctgagcccttcattgatgccaagtatgatgtgcgggtgcagaagattggccagaactacaaggcctacatgaggacctctgtgtctggcaactggaagaccaacacaggcagcgccatgctggagcagatcgccatgtctgaccgctacaagctgtgggtggacacctgcagcgagatctttggaggcctggacatctgtgctgtggaggccctgcacggcaaggatggccgggaccacatcatcgaggtggtgggcagctccatgcccctgattggagaccaccaggatgaggacaagcagctgattgtggagctggtggtgaacaagatggcccaggccctgccccggcagaggcagagagatgccagccctggccggggcagccacggccagacccccagccctggggccctgcccctgggccggcagaccagccagcagcctgctggccccccagcccagcagaggcccccaccccagggcggccccccccagcccggccctggcccccagaggcagggcccccccctgcagcagaggcccccaccccagggccagcagcacctgagcggcctgggccccccagctggcagccccctgccccagaggctgcccagccccaccagcgccccccagcagcctgccagccaggccgccccacccacccagggccagggccggcagagcaggcctgtggccggcggccctggggcccctcctgctgcccggcccccagccagccccagcccccagaggcaggccggccccccccaggccacccggcagacctctgtgtctggccctgccccacccaaggccagcggggcccctcctgggggccagcagaggcagggccccccccagaagcccccaggccctgctggccccacccggcaggccagccaggccggccctgtgcccaggactggaccacccaccacccagcagccccggcccagcggccctggccctgctggccggcccaagccccagctggcccagaagcccagccaggatgtgcccccaccagccacagctgctgctgggggccccccccacccccagctgaacaagagccagagcctgaccaatgccttcaacctgcctgagcccgccccaccccggcccagcctgagccaggatgaggtgaaggccgagaccatccgcagcctgaggaagagctttgccagcctcttcagtgactag

SEQ ID NO: 172207 - DNA, 2010 bp, Artificial Sequence
  Description of Artificial Sequence: Synthetic coding sequence
atgaactacctgcggcggcggctgagtgacagcaacttcatggccaacctgcccaacggctacatgacagacctgcagaggccccagcccccacctcctcctcctggggcccacagccctggggccaccccaggccctggaacagccacagctgagaggagcagtggagtggccccagctgccagccctgctgcccccagccctggcagcagcggcggcggcggcttcttcagcagcctgagcaatgctgtgaagcagaccacagctgctgctgctgccaccttcagcgagcaggtgggcggcggcagcggcggggccggccggggcggggccgccagccgggtgctgctggtgattgatgagccccacacagactgggccaagtacttcaagggcaagaagatccacggggagattgacatcaaggtggagcaggccgagttcagtgacctgaacctggtggcccacgccaacggcggcttctctgtggacatggaggtgctgagaaatggagtgaaggtggtgcgcagcctgaagccagactttgtgctgatccggcagcacgccttctccatggccagaaatggagactaccgcagcctggtgattggcctgcagtatgccggcatccccagcgtgaacagcctgcacagcgtgtacaacttctgtgacaagccctgggtgtttgcccagatggtgcggctgcacaagaagctgggcacagaggagttccccctgattgaccagaccttctaccccaaccacaaggagatgctgagcagcaccacctaccctgtggtggtgaagatgggccacgcccacagcggcatgggcaaggtgaaggtggacaaccagcacgacttccaggacatcgcctctgtggtggccctgaccaagacctacgccacagctgagcccttcattgatgccaagtatgatgtgcgggtgcagaagattggccagaactacaaggcctacatgaggacctctgtgtctggcaactggaagaccaacacaggcagcgccatgctggagcagatcgccatgtctgaccgctacaagctgtgggtggacacctgcagcgagatctttggaggcctggacatctgtgctgtggaggccctgcacggcaaggatggccgggaccacatcatcgaggtggtgggcagctccatgcccctgattggagaccaccaggatgaggacaagcagctgattgtggagctggtggtgaacaagatggcccaggccctgccccggcagaggcagagagatgccagccctggccggggcagccacggccagacccccagccctggggccctgcccctgggccggcagaccagccagcagcctgctggccccccagcccagcagaggcccccaccccagggcggccccccccagcccggccctggcccccagaggcagggcccccccctgcagcagaggcccccaccccagggccagcagcacctgagcggcctgggccccccagctggcagccccctgccccagaggctgcccagccccaccagcgccccccagcagcctgccagccaggccgccccacccacccagggccagggccggcagagcaggcctgtggccggcggccctggggcccctcctgctgcccggcccccagccagccccagcccccagaggcaggccggccccccccaggccacccggcagacctctgtgtctggccctgccccacccaaggccagcggggcccctcctgggggccagcagaggcagggccccccccagaagcccccaggccctgctggccccacccggcaggccagccaggccggccctgtgcccaggactggaccacccaccacccagcagccccggcccagcggccctggccctgctggccggcccaagccccagctggcccagaagcccagccaggatgtgcccccaccagccacagctgctgctgggggccccccccacccccagctgaaggccagccctgcccaggcccagccctag

SEQ ID NO: 172208 - DNA, 1743 bp, Artificial Sequence
  Description of Artificial Sequence: Synthetic coding sequence
atgaacttcctgcggcggcggctgagtgacagcagcttcatggccaacctgcccaacggctacatgacagacctgcagaggccagacagcagcaccagcagccctgccagccctgccatggagcggcggcacccccagcccctggccgccagcttcagcagccctggcagcagcctcttcagcagcctgagcagcgccatgaagcaggccccccaggccaccagcggcctgatggagcccccaggccccagcacccccatcgtgcagaggccccgcatcctgctggtgattgatgatgcccacacagactggagcaagtacttccacggcaagaaggtgaatggagaaattgagatccgggtggagcaggccgagttcagcgagctgaacctggccgcctacgtgactggaggctgcatggtggacatgcaggtggtgagaaatggcaccaaggtggtgagccgctccttcaagccagacttcatcctggtgcggcagcacgcctacagcatggccctgggggaggactaccgcagcctggtgattggcctgcagtatggaggcctgcctgctgtgaacagcctgtacagcgtgtacaacttctgcagcaagccctgggtgttcagccagctgatcaagatcttccacagcctgggccctgagaagttccccctggtggagcagaccttcttccccaaccacaagcccatggtgacagccccccacttccctgtggtggtgaagctgggccacgcccacgccggcatgggcaagatcaaggtggagaaccagctggacttccaggacatcacctctgtggtggccatggccaagacctacgccaccacagaggccttcatcgacagcaaatatgacatccgcatccagaagattggcagcaactacaaggcctacatgaggaccagcatcagcggcaactggaaggccaacacaggcagcgccatgctggagcaggtggccatgacagagcgctaccgcctgtgggtggacagctgcagcgagatgtttggaggcctggacatctgtgctgtgaaggctgtgcacagcaaggatggccgggactacatcatcgaggtgatggacagctccatgcccctcatcggggagcacgtggaggaggaccggcagctgatggctgacctggtggtgtccaagatgagccagctgcccatgcctgggggcacagcccccagccccctgcggccctgggccccccagatcaagagcgccaagagccctggccaggcccagctgggcccccagctgggccagccccagccccggcccccaccccagggcggcccccggcaggcccagagcccccagccccagaggagcggcagccccagccagcagaggctgagcccccagggccagcagcccctgagcccccagagcggcagcccccagcagcagaggagccctggcagcccccagctgagccgggccagcagcggcagcagccccaaccaggccagcaagccaggggccaccctggccagccagccccggccccctgtgcagggccgcagcaccagccagcagggcgaggagagcaagaagccagccccaccccacccccacctgaacaagagccagagcctgaccaacagcctgagcaccagtgacaccagccagaggggcacccccagtgaagatgaggccaaggccgagaccatccggaacctgaggaagagctttgccagcctcttcagtgactag

SEQ ID NO: 172209 - DNA, 1743 bp, Artificial Sequence; identical to SEQ ID NO: 172208
  Description of Artificial Sequence: Synthetic coding sequence

SEQ ID NO: 172210 - DNA, 1335 bp, Artificial Sequence
  Description of Artificial Sequence: Synthetic coding sequence
atgaacttcctgcggcggcggctgagtgacagcagcttcatggccaacctgcccaacggctacatgacagacctgcagaggccagacagcagcaccagcagccctgccagccctgccatggagcggcggcacccccagcccctggccgccagcttcagcagccctggcagcagcctcttcagcagcctgagcagcgccatgaagcaggccccccaggccaccagcggcctgatggagcccccaggccccagcacccccatcgtgcagaggccccgcatcctgctggtgattgatgatgcccacacagactggagcaagtacttccacggcaagaaggtgaatggagaaattgagatccgggtggagcaggccgagttcagcgagctgaacctggccgcctacgtgactggaggctgcatggtggacatgcaggtggtgagaaatggcaccaaggtggtgagccgctccttcaagccagacttcatcctggtgcggcagcacgcctacagcatggccctgggggaggactaccgcagcctggtgattggcctgcagtatggaggcctgcctgctgtgaacagcctgtacagcgtgtacaacttctgcagcaagccctgggtgttcagccagctgatcaagatcttccacagcctgggccctgagaagttccccctggtggagcagaccttcttccccaaccacaagcccatggtgacagccccccacttccctgtggtggtgaagctgggccacgcccacgccggcatgggcaagatcaaggtggagaaccagctggacttccaggacatcacctctgtggtggccatggccaagacctacgccaccacagaggccttcatcgacagcaaatatgacatccgcatccagaagattggcagcaactacaaggcctacatgaggaccagcatcagcggcaactggaaggccaacacaggcagcgccatgctggagcaggtggccatgacagagcgctaccgcctgtgggtggacagctgcagcgagatgtttggaggcctggacatctgtgctgtgaaggctgtgcacagcaaggatggccgggactacatcatcgaggtgatggacagctccatgcccctcatcggggagcacgtggaggaggaccggcagctgatggctgacctggtggtgtccaagatgagccagctgcccatgcctgggggcacagcccccagccccctgcggccctgggccccccagatcaagagcgccaagagccctggccaggcccagctgggcccccagctgggccagccccagccccggcccccaccccaggtgtccttcagcccctag

SEQ ID NO: 172211 - DNA, 342 bp, Artificial Sequence
  Description of Artificial Sequence: Synthetic coding sequence
atgaacttcctgcggcggcggctgagtgacagcagcttcatggccaacctgcccaacggctacatgacagacctgcagaggccagacagcagcaccagcagccctgccagccctgccatggagcggcggcacccccagcccctggccgccagcttcagcagccctggcagcagcctcttcagcagcctgagcagcgccatgaagcaggccccccaggccaccagcggcctgatggagcccccaggccccagcacccccatcgtgcagaggccccgcatcctgctggtgattgatgatgcccacacagactggagcaagtacttccacggcaagaaggtgtag

SEQ ID NO: 172212 - DNA, 372 bp, Artificial Sequence
  Description of Artificial Sequence: Synthetic coding sequence
atgaacttcctgcggcggcggctgagtgacagcagcttcatggccaacctgcccaacggctacatgacagacctgcagaggccagacagcagcaccagcagccctgccagccctgccatggagcggcggcacccccagcccctggccgccagcttcagcagccctggcagcagcctcttcagcagcctgagcagcgccatgaagcaggccccccaggccaccagcggcctgatggagcccccaggccccagcacccccatcgtgcagaggccccgcatcctgctggtgattgatgatgcccacacagactggagcaagtacttccacggcaagaaggtgaatggagaaattgagatccgggtggagcagtag

SEQ ID NO: 172213 - DNA, 561 bp, Artificial Sequence
  Description of Artificial Sequence: Synthetic coding sequence
atggacagctccatgcccctcatcggggagcacgtggaggaggaccggcagctgatggctgacctggtggtgtccaagatgagccagctgcccatgcctgggggcacagcccccagccccctgcggccctgggccccccagatcaagagcgccaagagccctggccaggcccagctgggcccccagctgggccagccccagccccggcccccaccccagggcggcccccggcaggcccagagcccccagcagcagaggagccctggcagcccccagctgagccgggccagcagcggcagcagccccaaccaggccagcaagccaggggccaccctggccagccagccccggccccctgtgcagggccgcagcaccagccagcagggcgaggagagcaagaagccagccccaccccacccccacctgaacaagagccagagcctgaccaacagcctgagcaccagtgacaccagccagaggggcacccccagtgaagatgaggccaaggccgagaccatccggaacctgaggaagagctttgccagcctcttcagtgactag

SEQ ID NO: 172214 - DNA, 1212 bp, Artificial Sequence
  Description of Artificial Sequence: Synthetic coding sequence
atgagccacaggaagttcagcgcccccaggcatggcagcctgggcttcctgcccaggaagaggagcagccgccaccggggcaaggtgaagagcttccccaaggatgaccccagcaagcctgtgcacctgacagccttcctgggctacaaggccggcatgacccacatcgtgcgggaggtggacaggcctggcagcaaggtgaacaagaaggaggtggtggaggccgtgaccatcgtggagaccccacccatggtggtggtgggcatcgtgggctacgtggagaccccccggggcctgcggaccttcaagacagtgtttgctgagcacatcagtgatgagtgcaagaggcgcttctacaagaactggcacaagagcaagaagaaggccttcaccaagtactgcaagaagtggcaggatgaagatggcaagaagcagctggagaaggacttcagctccatgaagaagtactgccaggtgatccgggtgattgcccacacccagatgaggctgctgcccctgcggcagaagaaggcccacctgatggagatccaggtgaatggaggcaccgtggccgagaagctggactgggcccgggagcggctggagcagcaggtgcctgtgaaccaggtgtttggccaggatgagatgattgatgtgattggagtgaccaagggcaagggctacaagggcgtgaccagccgctggcacaccaagaagctgcccaggaagacccaccggggcctgaggaaggtggcctgcatcggggcctggcacccagcccgggtggccttctctgtggcccgggccggccagaagggctaccaccacaggacagagatcaacaagaagatctacaagattggccagggctacctgatcaaggatggcaagctgatcaagaacaatgccagcacagattatgacctgagtgacaagagcatcaaccccctgggcggctttgtgcactatggagaggtgaccaatgactttgtgatgctgaagggctgtgtggtgggcaccaagaagagggtgctgaccctgaggaagagcctgctggtgcagaccaagagaagagccctggagaagattgacctgaagttcatcgacaccaccagcaagtttggccacggccgcttccagaccatggaggagaagaaggccttcatgggccccctgaagaaggacagaattgccaaggaggagggcgcctag

SEQ ID NO: 172215 - DNA, 576 bp, Artificial Sequence
  Description of Artificial Sequence: Synthetic coding sequence
atggagggcggggcctacggggccggcaaggccggcggggcctttgacccctacaccctggtgcggcagccccacaccatcctgcgggtggtgtcctggctgttcagcatcgtggtgtttggcagcatcgtgaatgaaggctacctgaacagcgccagcgagggggaggagttctgcatctacaacagaaaccccaatgcctgcagctatggagtggccgtgggcgtgctggccttcctgacctgcctgctgtacctggccctggatgtgtacttcccccagatcagctctgtgaaggacaggaagaaggctgtgctgagtgacattggagtgtctgccttctgggccttcctgtggtttgtgggcttctgctacctggccaaccagtggcaggtgtccaagcccaaggacaaccccctgaatgaaggaacagatgctgcccgggccgccatcgccttctccttcttcagcatcttcacctggagcctgacagctgccctggccgtgcggcgcttcaaggacctgtccttccaggaggagtacagcaccctcttccctgccagcgcccagccctag

SEQ ID NO: 172216 - DNA, 702 bp, Artificial Sequence
  Description of Artificial Sequence: Synthetic coding sequence
atggagggcggggcctacggggccggcaaggccggcggggcctttgacccctacaccctggtgcggcagccccacaccatcctgcgggtggtgtcctggctgttcagcatcgtggtgtttggcagcatcgtgaatgaaggctacctgaacagcgccagcgagggggaggagttctgcatctacaacagaaaccccaatgcctgcagctatggagtggccgtgggcgtgctggccttcctgacctgcctgctgtacctggccctggatgtgtacttcccccagatcagctctgtgaaggacaggaagaaggctgtgctgagtgacattggagtgtctgccttctgggccttcctgtggtttgtgggcttctgctacctggccaaccagtggcaggtgtccaagcccaaggacaaccccctgaatgaaggaacagatgctgcccgggccgccatcgccttctccttcttcagcatcttcacctgggccggccaggccgtgctggccttccagcgctaccagatcggggctgacagcgccctcttcagccaggactacatggaccccagccaggacagctccatgccctatgccccctacgtggagcccactggaccagaccctgctggcatgggcggcacctaccagcagcctgccaacacctttgacacagagccccagggctaccagagccagggctactag

SEQ ID NO: 172217 - DNA, 579 bp, Artificial Sequence
  Description of Artificial Sequence: Synthetic coding sequence
atgctgaccctggagtttggcatcctggagtttgaccccagctggattggctcctggacccagaggtcctgggtgtcctggaggagcaggcctggctgtgagctgttcagcatcgtggtgtttggcagcatcgtgaatgaaggctacctgaacagcgccagcgagggggaggagttctgcatctacaacagaaaccccaatgcctgcagctatggagtggccgtgggcgtgctggccttcctgacctgcctgctgtacctggccctggatgtgtacttcccccagatcagctctgtgaaggacaggaagaaggctgtgctgagtgacatcggcgtgtctgccttctgggccttcctgtggtttgtgggcttctgctacctggccaaccagtggcaggtgtccaagcccaaggacaaccccctgaatgaaggaacagatgctgcccgggccgccatcgccttctccttcttcagcatcttcacctggagcctgacagctgccctggccgtgcggcgcttcaaggacctgtccttccaggaggagtacagcaccctcttccctgccagcgcccagccctag

SEQ ID NO: 172218 - DNA, 510 bp, Artificial Sequence
  Description of Artificial Sequence: Synthetic coding sequence
atggagggcggggcctacggggccggcaaggccggcggggcctttgacccctacaccctggtgcggcagccccacaccatcctgcgggtggtgtcctggctgttcagcatcgtggtgtttggcagcatcgtgaatgaaggctacctgaacagcgccagcgagggggaggagttctgcatctacaacagaaaccccaatgcctgcagctatggagtggccgtgggcgtgctggccttcctgacctgcctgctgtacctggccctggatgtgtacttcccccagatcagctctgtgaaggacaggaagaaggctgtgctgagtgacattggagtgtctgccttctgggccttcctgtggtttgtgggcttctgctacctggccaaccagtggcaggtgtccaagcccaaggacaaccccctgaatgaaggaacagatgctgcccgggccgccatcgccttctccttcttcagcatcttcacctggaggtctggggccaccagccccccatag

SEQ ID NO: 172219 - DNA, 297 bp, Artificial Sequence
  Description of Artificial Sequence: Synthetic coding sequence
atggccagcggggccggcggctcctggggccgcagccccccccagagcgctgtgcccaccccctgggtgaccttcctgcagcccctgtcctgggccgtgcccccagccccaccccagcccggccgggtgaaggaggacctgctggagctgatgatgctgcagaatgcccagatgcaccagctgctgctgagccggctggtggccggggccctgcagcccaggcctgccagcccctgcccccaggagagctgtgcccccacccccaccccccagtgccaccgggactgtggctgctag

SEQ ID NO: 172220 - DNA, 690 bp, Artificial Sequence
  Description of Artificial Sequence: Synthetic coding sequence
atggagggcgccagctttggagctggccgggccggggccgccctggaccctgtgtcctttgcccggcggccccagaccctgctgcgggtggcctcctgggtgttcagcattgctgtgtttggccccatcgtgaatgaaggctacgtgaacacagattctggccctgagctgcgctgtgtgttcaatggaaatgctggggcctgccgcttcggcgtggccctgggcctgggcgccttcctggcctgtgccgccttcctgctgctggatgtgcgcttccagcagatcagctctgtgcgggacagaagaagagctgtgctgctggacctgggcttcagcggcctgtggagcttcctgtggtttgtgggcttctgcttcctgaccaaccagtggcagaggacagcccctggccctgccaccacccaggccggagatgctgcccgggccgccatcgccttctccttcttcagcatcctgtcctgggtggccctgactgtgaaggccctgcagcgcttccggctgggcacagacatgagcctgtttgccacagagcagctgagcactggagccagccaggcctacccaggctaccctgtgggcagcggcgtggagggcacagagacctaccagagcccccccttcacagagaccctggacaccagccccaagggctaccaggtgcctgcctactag

SEQ ID NO: 172221 - DNA, 438 bp, Artificial Sequence
  Description of Artificial Sequence: Synthetic coding sequence
atggagggcgccagctttggagctggccgggccggggccgccctggaccctgtgtcctttgcccggcggccccagaccctgctgcgggtggcctcctgggtgttcagcattgctgtgtttggccccatcgtgaatgaaggctacgtgaacacagattctggccctgagctgcgctgtgtgttcaatggaaatgctggggcctgccgcttcggcgtggccctgggcctgggcgccttcctggcctgtgccgccttcctgctgctggatgtgcgcttccagcagagcggcggccggggcaagaccccacccagcccccaggactggggctcctggcccctcttccccagccacgtgcctgtgggcagtgactgcctggtgtctgtgatggtggtgcggcctgtgcgcagccacagccccctgagcctgaccggctgctag

SEQ ID NO: 172222 - DNA, 705 bp, Artificial Sequence
  Description of Artificial Sequence: Synthetic coding sequence
atgcacatccccaagagcctgcaggagctggccaacagcgaggccgtgcagttcctgcggcggcccaagaccatcaccagggtgtttgaaggagtcttcagcctcatcgtgttcagcagcctgctgacagatggctaccagaacaagatggagagcccccagctgcactgcatcctgaacagcaacagcgtggcctgcagctttgctgtgggcgccggcttcctggccttcctgagctgcctggccttcctggtgctggacacccaggagaccagaattgctggcacccgcttcaagacagccttccagctgctggacttcatcctggccgtgctgtgggccgtggtgtggttcatgggcttctgcttcctggccaaccagtggcagcacagcccccccaaggagttcctgctgggcagcagcagcgcccaggccgccatcgccttcaccttcttcagcatcctggtgtggatcttccaggcctacctggccttccaggacctgagaaatgatgcccctgtgccctacaagcgcttcctggatgaaggaggcatggtgctgaccaccctgcccctgcccagcgccaacagccctgtgaacatgcccaccaccggccccaacagcctgtcctatgccagcagcgccctgagcccctgcctgacagcccccaagagcccccggctggccatgatgccagacaactag

SEQ ID NO: 172223 - DNA, 4722 bp, Artificial Sequence
  Description of Artificial Sequence: Synthetic coding sequence
atggccttcagcaagggcttccgcatctaccacaagctggaccccccacccttcagcctgattgtggagaccaggcacaaggaggagtgcctgatgtttgaaagtggagctgtggccgtgctgagcagcgctgagaaggaggccatcaagggcacctacagcaaggtgctggatgcctacggcctgctgggcgtgctgcggctgaacctgggggacaccatgctgcactacctggtgctggtgacaggctgcatgtctgtgggcaagatccaggagagcgaggtgttccgggtgaccagcacagagttcatcagcctgagaattgacagcagtgatgaagatcgcatcagcgaggtgaggaaggtgctgaacagcggcaacttctactttgcctggagcgccagcggcatcagcctggacctgagcctgaatgcccaccgctccatgcaggagcagaccacagacaaccgcttcttctggaaccagagcctgcacctgcacctgaagcactatggagtgaactgtgatgactggctgctgcggctgatgtgtggcggcgtggagatccgcaccatctatgctgcccacaagcaggccaaggcctgcctgatcagccggctgagctgtgagcgggccggcacccgcttcaacgtgcggggcaccaatgatgatggccacgtggccaactttgtggagacagagcaggtggtgtacctggatgacagcgtgtcctccttcatccagatccggggctctgtgcccctcttctgggagcagcccggcctgcaggtgggcagccaccgggtgaggatgagccggggctttgaggccaatgccccagcctttgacagacacttccgcaccctgaagaacctgtatggcaagcagatcatcgtgaacctgctgggcagcaaggagggggagcacatgctgagcaaggccttccagagccacctgaaggccagcgagcacgccgctgacatccagatggtgaactttgactaccaccagatggtgaagggcggcaaggccgagaagctgcacagcgtgctgaagccccaggtgcagaagttcctggactatggcttcttctacttcaatggaagtgaggtgcagcgctgccagagcggcaccgtgaggaccaactgcctggactgcctggacaggaccaacagcgtgcaggccttcctgggcctggagatgctggccaagcagctggaggccctgggcctggccgagaagccccagctggtgacccgcttccaggaggtgttccgctccatgtggagcgtgaatggagacagcatcagcaagatctatgccggcactggagccctggagggcaaggccaagctgaaggatggagcccggtctgtgaccaggaccatccagaacaacttctttgacagcagcaagcaggaggccattgatgtgctgctgctgggcaacaccctgaacagcgacctggccgacaaggcccgggccctgctgaccaccggcagcctgcgggtgtctgagcagaccctgcagagcgccagcagcaaggtgctgaagtccatgtgtgagaacttctacaagtacagcaagcccaagaagatccgggtgtgtgtgggcacctggaatgtgaatggaggcaagcagttccgcagcatcgccttcaagaaccagaccctgacagactggctgctggatgcccccaagctggccggcatccaggagttccaggacaagaggagcaagcccacagacatctttgccatcggctttgaggagatggtggagctgaatgccggcaacatcgtgtctgccagcaccaccaaccagaagctgtgggccgtggagctgcagaagaccatcagccgggacaacaagtatgtgctgctggccagcgagcagctggtgggcgtgtgcctgtttgtgttcatccggccccagcacgcccccttcatcagagatgtggccgtggacacagtgaagacaggcatgggcggggccaccggcaacaagggagctgtggccatccgcatgctgttccacaccaccagcctgtgctttgtgtgcagccactttgctgctggccagagccaggtgaaggagagaaatgaagacttcattgaaattgccaggaagctgtccttccccatgggccgcatgctgttcagccatgactatgtgttctggtgtggggacttcaactacagaattgacctgcccaatgaggaggtgaaggagctgatccggcagcagaactgggacagcctgattgctggggaccagctgatcaaccagaagaatgccggccaggtgttccggggcttcctggagggcaaggtgacctttgcccccacctacaagtatgacctcttcagtgatgattatgacaccagcgagaagtgcaggaccccagcctggacagacagagtgctgtggaggaggaggaagtggccctttgacagatctgctgaggacctggacctgctgaatgccagcttccaggatgagagcaagatcctgtacacctggaccccaggcaccctgctgcactacggccgggcagagctgaagaccagtgaccacaggcctgtggtggccctgattgacatcgacatctttgaggtggaggccgaggagcggcagaacatctacaaggaggtgattgctgtgcagggccccccagatggcaccgtgctggtgtccatcaagagcagcctgcctgagaacaacttctttgatgatgccctgattgatgagctgctgcagcagtttgccagctttggagaggtgatcctgatccgctttgtggaggacaagatgtgggtgaccttcctggagggcagcagcgccctgaatgtgctgagcctgaatggcaaggagctgctgaacagaaccatcaccatcgccctgaagagcccagactggatcaagaacctggaggaggagatgagcctggagaagatcagcatcgccctgcccagcagcaccagcagcaccctgctgggagaagatgctgaggtggccgctgactttgacatggagggagatgtggatgactacagcgctgaggtggaggagctgctgccccagcacctgcagcccagcagcagcagcggcctgggcaccagccccagcagcagccccaggaccagcccctgccagagccccaccatcagcgagggccctgtgcccagcctgcccatccggcccagccgggcccccagcaggaccccaggcccccccagcgcccagagcagccccattgatgcccagcctgccacccccctgccccagaaggaccctgcccagcccctggagcccaagaggcctcctccacccaggcctgtggccccacccaccaggcctgccccaccccagaggcctcctccacccagcggggcccggagccctgcccccaccaggaaggagtttggaggcattggagccccacccagccctggggtggcccggcgggagatggaggcccccaagagccctggcaccaccaggaaggacaacatcggccgcagccagcccagcccccaggccggcctggccggccctggccctgctggctacagcacagcccggcccaccatccccccccgggccggggtcatcagcgccccccagagccacgcccgggccagcgctggccgcctgaccccagagagccagagcaagaccagcgagaccagcaagggcagcaccttcctgcctgagcccctgaagccccaggccgccttccccccccagagcagcctgcccccaccagcccagaggctgcaggagcccctggtgcctgtggccgcccccatgccccagagcggcccccagcccaacctggagaccccaccccagcccccacccaggagccgcagcagccacagcctgcccagcgaggccagcagccagccccaggtgaagaccaacggcatcagtgatggcaagcgggagagccccctgaagattgacccctttgaggacctgtccttcaacctgctggccgtgtccaaggcccagctgtctgtgcagaccagccctgtgcccaccccagaccccaagaggctcatccagctgcccagcgccacccagagcaatgtgctgagctctgtgtcctgcatgcccaccatgccacccatcccagcccggagccagagccaggagaacatgaggagcagccccaaccccttcatcaccggcctgaccaggaccaaccccttcagtgacagaacagctgcccctggcaaccccttccgggccaagtctgaggagagcgaggccacctcctggttcagcaaggaggagcctgtgaccatcagccccttccccagcctgcagcccctgggccacaacaagagccgggccagcagcagcctggatggcttcaaggacagctttgacctgcagggccagagcaccctgaagatcagcaaccccaagggctgggtgacctttgaggaggaggaggactttggagtgaagggcaagagcaagagcgcctgcagcgacctgctgggcaaccagcccagcagcttcagcggcagcaacctgaccctgaatgatgactggaacaagggcaccaacgtgtccttctgtgtgctgcccagccggcggcccccacctcctcctgtgcccctgctgcccccaggcaccagcccccctgtggaccccttcaccaccctggccagcaaggccagccccaccctggacttcacagaaagatag

SEQ ID NO: 172224 - DNA, 3888 bp, Artificial Sequence
  Description of Artificial Sequence: Synthetic coding sequence
atggccttcagcaagggcttccgcatctaccacaagctggaccccccacccttcagcctgattgtggagaccaggcacaaggaggagtgcctgatgtttgaaagtggagctgtggccgtgctgagcagcgctgagaaggaggccatcaagggcacctacagcaaggtgctggatgcctacggcctgctgggcgtgctgcggctgaacctgggggacaccatgctgcactacctggtgctggtgacaggctgcatgtctgtgggcaagatccaggagagcgaggtgttccgggtgaccagcacagagttcatcagcctgagaattgacagcagtgatgaagatcgcatcagcgaggtgaggaaggtgctgaacagcggcaacttctactttgcctggagcgccagcggcatcagcctggacctgagcctgaatgcccaccgctccatgcaggagcagaccacagacaaccgcttcttctggaaccagagcctgcacctgcacctgaagcactatggagtgaactgtgatgactggctgctgcggctgatgtgtggcggcgtggagatccgcaccatctatgctgcccacaagcaggccaaggcctgcctgatcagccggctgagctgtgagcgggccggcacccgcttcaacgtgcggggcaccaatgatgatggccacgtggccaactttgtggagacagagcaggtggtgtacctggatgacagcgtgtcctccttcatccagatccggggctctgtgcccctcttctgggagcagcccggcctgcaggtgggcagccaccgggtgaggatgagccggggctttgaggccaatgccccagcctttgacagacacttccgcaccctgaagaacctgtatggcaagcagatcatcgtgaacctgctgggcagcaaggagggggagcacatgctgagcaaggccttccagagccacctgaaggccagcgagcacgccgctgacatccagatggtgaactttgactaccaccagatggtgaagggcggcaaggccgagaagctgcacagcgtgctgaagccccaggtgcagaagttcctggactatggcttcttctacttcaatggaagtgaggtgcagcgctgccagagcggcaccgtgaggaccaactgcctggactgcctggacaggaccaacagcgtgcaggccttcctgggcctggagatgctggccaagcagctggaggccctgggcctggccgagaagccccagctggtgacccgcttccaggaggtgttccgctccatgtggagcgtgaatggagacagcatcagcaagatctatgccggcactggagccctggagggcaaggccaagctgaaggatggagcccggtctgtgaccaggaccatccagaacaacttctttgacagcagcaagcaggaggccattgatgtgctgctgctgggcaacaccctgaacagcgacctggccgacaaggcccgggccctgctgaccaccggcagcctgcgggtgtctgagcagaccctgcagagcgccagcagcaaggtgctgaagtccatgtgtgagaacttctacaagtacagcaagcccaagaagatccgggtgtgtgtgggcacctggaatgtgaatggaggcaagcagttccgcagcatcgccttcaagaaccagaccctgacagactggctgctggatgcccccaagctggccggcatccaggagttccaggacaagaggagcaagcccacagacatctttgccatcggctttgaggagatggtggagctgaatgccggcaacatcgtgtctgccagcaccaccaaccagaagctgtgggccgtggagctgcagaagaccatcagccgggacaacaagtatgtgctgctggccagcgagcagctggtgggcgtgtgcctgtttgtgttcatccggccccagcacgcccccttcatcagagatgtggccgtggacacagtgaagacaggcatgggcggggccaccggcaacaagggagctgtggccatccgcatgctgttccacaccaccagcctgtgctttgtgtgcagccactttgctgctggccagagccaggtgaaggagagaaatgaagacttcattgaaattgccaggaagctgtccttccccatgggccgcatgctgttcagccatgactatgtgttctggtgtggggacttcaactacagaattgacctgcccaatgaggaggtgaaggagctgatccggcagcagaactgggacagcctgattgctggggaccagctgatcaaccagaagaatgccggccaggtgttccggggcttcctggagggcaaggtgacctttgcccccacctacaagtatgacctcttcagtgatgattatgacaccagcgagaagtgcaggaccccagcctggacagacagagtgctgtggaggaggaggaagtggccctttgacagatctgctgaggacctggacctgctgaatgccagcttccaggatgagagcaagatcctgtacacctggaccccaggcaccctgctgcactacggccgggcagagctgaagaccagtgaccacaggcctgtggtggccctgattgacatcgacatctttgaggtggaggccgaggagcggcagaacatctacaaggaggtgattgctgtgcagggccccccagatggcaccgtgctggtgtccatcaagagcagcctgcctgagaacaacttctttgatgatgccctgattgatgagctgctgcagcagtttgccagctttggagaggtgatcctgatccgctttgtggaggacaagatgtgggtgaccttcctggagggcagcagcgccctgaatgtgctgagcctgaatggcaaggagctgctgaacagaaccatcaccatcgccctgaagagcccagactggatcaagaacctggaggaggagatgagcctggagaagatcagcatcgccctgcccagcagcaccagcagcaccctgctgggagaagatgctgaggtggccgctgactttgacatggagggagatgtggatgactacagcgctgaggtggaggagctgctgccccagcacctgcagcccagcagcagcagcggcctgggcaccagccccagcagcagccccaggaccagcccctgccagagccccaccatcagcgagggccctgtgcccagcctgcccatccggcccagccgggcccccagcaggaccccaggcccccccagcgcccagagcagccccattgatgcccagcctgccacccccctgccccagaaggaccctgcccagcccctggagcccaagaggcctcctccacccaggcctgtggccccacccaccaggcctgccccaccccagaggcctcctccacccagcggggcccggagccctgcccccaccaggaaggagtttggagcccccaagagccctggcaccaccaggaaggacaacatcggccgcagccagcccagcccccaggccggcctggccggccctggccctgctggctacagcacagcccggcccaccatccccccccgggccggggtcatcagcgccccccagagccacgcccgggccagcgctggccgcctgaccccagagagccagagcaagaccagcgagaccagcaagggcagcaccttcctgcctgagcccctgaagccccaggccgccttccccccccagagcagcctgcccccaccagcccagaggctgcaggagcccctggtgcctgtggccgcccccatgccccagagcggcccccagcccaacctggagaccccaccccagcccccacccaggagccgcagcagccacagcctgcccagcgaggccagcagccagccccagcaggagcagcccagcggctag

SEQ ID NO: 172225 - DNA, 4581 bp, Artificial Sequence
  Description of Artificial Sequence: Synthetic coding sequence
atggccttcagcaagggcttccgcatctaccacaagctggaccccccacccttcagcctgattgtggagaccaggcacaaggaggagtgcctgatgtttgaaagtggagctgtggccgtgctgagcagcgctgagaaggaggccatcaagggcacctacagcaaggtgctggatgcctacggcctgctgggcgtgctgcggctgaacctgggggacaccatgctgcactacctggtgctggtgacaggctgcatgtctgtgggcaagatccaggagagcgaggtgttccgggtgaccagcacagagttcatcagcctgagaattgacagcagtgatgaagatcgcatcagcgaggtgaggaaggtgctgaacagcggcaacttctactttgcctggagcgccagcggcatcagcctggacctgagcctgaatgcccaccgctccatgcaggagcagaccacagacaaccgcttcttctggaaccagagcctgcacctgcacctgaagcactatggagtgaactgtgatgactggctgctgcggctgatgtgtggcggcgtggagatccgcaccatctatgctgcccacaagcaggccaaggcctgcctgatcagccggctgagctgtgagcgggccggcacccgcttcaacgtgcggggcaccaatgatgatggccacgtggccaactttgtggagacagagcaggtggtgtacctggatgacagcgtgtcctccttcatccagatccggggctctgtgcccctcttctgggagcagcccggcctgcaggtgggcagccaccgggtgaggatgagccggggctttgaggccaatgccccagcctttgacagacacttccgcaccctgaagaacctgtatggcaagcagatcatcgtgaacctgctgggcagcaaggagggggagcacatgctgagcaaggccttccagagccacctgaaggccagcgagcacgccgctgacatccagatggtgaactttgactaccaccagatggtgaagggcggcaaggccgagaagctgcacagcgtgctgaagccccaggtgcagaagttcctggactatggcttcttctacttcaatggaagtgaggtgcagcgctgccagagcggcaccgtgaggaccaactgcctggactgcctggacaggaccaacagcgtgcaggccttcctgggcctggagatgctggccaagcagctggaggccctgggcctggccgagaagccccagctggtgacccgcttccaggaggtgttccgctccatgtggagcgtgaatggagacagcatcagcaagatctatgccggcactggagccctggagggcaaggccaaggccggcaagctgaaggatggagcccggtctgtgaccaggaccatccagaacaacttctttgacagcagcaagcaggaggccattgatgtgctgctgctgggcaacaccctgaacagcgacctggccgacaaggcccgggccctgctgaccaccggcagcctgcgggccagcagcaaggtgctgaagtccatgtgtgagaacttctacaagtacagcaagcccaagaagatccgggtgtgtgtgggcacctggaatgtgaatggaggcaagcagttccgcagcatcgccttcaagaaccagaccctgacagactggctgctggatgcccccaagctggccggcatccaggagttccaggacaagaggagcaagcccacagacatctttgccatcggctttgaggagatggtggagctgaatgccggcaacatcgtgtctgccagcaccaccaaccagaagctgtgggccgtggagctgcagaagaccatcagccgggacaacaagtatgtgctgctggccagcgagcagctggtgggcgtgtgcctgtttgtgttcatccggccccagcacgcccccttcatcagagatgtggccgtggacacagtgaagacaggcatgggcggggccactggaaacaagggagctgtggccatccgcatgctgttccacaccaccagcctgtgctttgtgtgcagccactttgctgctggccagagccaggtgaaggagagaaatgaagacttcatcgagatcgccaggaagctgtccttccccatgggccgcatgctgttcagccatgactatgtgttctggtgtggggacttcaactacagaattgacctgcccaatgaggaggtgaaggagctgatccggcagcagaactgggacagcctgattgctggggaccagctgatcaaccagaagaatgccggccaggtgttccggggcttcctggagggcaaggtgacctttgcccccacctacaagtatgacctcttcagtgatgattatgacaccagcgagaagtgcaggaccccagcctggacagacagagtgctgtggaggaggaggaagtggccctttgacagatctgctgaggacctggacctgctgaatgccagcttccaggatgagagcaagatcctgtacacctggaccccaggcaccctgctgcactacggccgggcagagctgaagaccagtgaccacaggcctgtggtggccctgattgatattgacatctttgaggtggaggccgaggagcggcagaacatctacaaggaggtgattgctgtgcagggccccccagatggcaccgtgctggtgtccatcaagagcagcctgcctgagaacaacttctttgatgatgccctgattgatgagctgctgcagcagtttgccagctttggagaggtgatcctgatccgctttgtggaggacaagatgtgggtgaccttcctggagggcagcagcgccctgaatgtgctgagcctgaatggcaaggagctgctgaacagaaccatcaccatcgccctgaagagcccagactggatcaagaacctggaggaggagatgagcctggagaagatcagcatcgccctgcccagcagcaccagcagcaccctgctgggggaggatgctgaggtggccgctgactttgacatggagggagatgtggatgactacagcgctgaggtggaggagctgctgccccagcacctgcagcccagcagcagcagcggcctgggcaccagccccagcagcagccccaggaccagcccctgccagagccccaccatcagcgagggccctgtgcccagcctgcccatccggcccagccgggcccccagcaggaccccaggccccccatctgcccagagcagccccattgatgcccagcctgccacccccctgccccagaaggaccctgcccagcccctggagcccaagaggcctcctccacccaggcctgtggccccacccaccaggcctgccccaccccagaggcctcctcctccttctggccgcagccagcccagcccccaggccggcctggccggccctggccctgctggctacagcacagcccggcccaccatcccccccagggctggggtcatcagcgccccccagagccacgcccgggccagcgctggccgcctgaccccagagagccagagcaagaccagcgagaccagcaagggcagcaccttcctgcctgagcccctgaagccccaggccgccttccccccccagagcagcctgcccccaccagcccagaggctgcaggagcccctggtgcctgtggccgcccccatgccccagagcggcccccagcccaacctggagaccccaccccagcccccacccaggagccgcagcagccacagcctgcccagcgaggccagcagccagccccaggtgaagaccaacggcatcagtgatggcaagcgggagagccccctgaagattgacccctttgaggacctgtccttcaacctgctggccgtgtccaaggcccagctgtctgtgcagaccagccctgtgcccaccccagaccccaagaggctcatccagctgcccagcgccacccagagcaatgtgctgagctctgtgtcctgcatgcccaccatgccacccatcccagcccggagccagagccaggagaacatgaggagcagccccaaccccttcatcaccggcctgaccaggaccaaccccttcagtgacagaacagctgcccctggcaaccccttccgggccaagtctgaggagagcgaggccacctcctggttcagcaaggaggagcctgtgaccatcagccccttccccagcctgcagcccctgggccacaacaagagccgggccagcagcagcctggatggcttcaaggacagctttgacctgcagggccagagcaccctgaagatcagcaaccccaagggctgggtgacctttgaggaggaggaggactttggagtgaagggcaagagcaagagcgcctgcagcgacctgctgggcaaccagcccagcagcttcagcggcagcaacctgaccctgaatgatgactggaacaagggcaccaacgtgtccttctgtgtgctgcccagcagaagacctcctcctcctcctgtgcccctgctgcccccaggcaccagcccccctgtggaccccttcaccaccctggccagcaaggccagccccaccctggacttcacagagaggtag

SEQ ID NO: 172226 - DNA, 4053 bp, Artificial Sequence
  Description of Artificial Sequence: Synthetic coding sequence
atgaggaagcgctgggcctgctggagcggcagtgatgcccctgggggctgcggcggcggctgcggcagaagaagaagaagaagcaggaggaagagagctgccagcgaggagaggaggatggccttcagcaagggcttccgcatctaccacaagctggaccccccacccttcagcctcatcgtggagaccaggcacaaggaggagtgcctgatgtttgagagcggggctgtggccgtgctgagcagcgctgagaaggaggccatcaagggcacctacagcaaggtgctggatgcctacggcctgctgggcgtgctgcggctgaacctgggggacaccatgctgcactacctggtgctggtgacaggctgcatgtctgtgggcaagatccaggagagcgaggtgttccgggtgaccagcacagagttcatcagcctgagaattgacagcagtgatgaggaccgcatcagcgaggtgaggaaggtgctgaacagcggcaacttctactttgcctggagcgccagcggcatcagcctggacctgagcctgaatgcccaccgctccatgcaggagcagaccacagacaaccgcttcttctggaaccagagcctgcacctgcacctgaagcactacggcgtgaactgtgatgactggctgctgcggctgatgtgtggcggcgtggagatccgcaccatctatgctgcccacaagcaggccaaggcctgcctgatcagccggctgagctgtgaaagagctggcacccgcttcaacgtgcggggcaccaatgatgatggccacgtggccaactttgtggagacagagcaggtggtgtacctggatgattctgtgagcagcttcatccagatccggggctctgtgcccctcttctgggagcagcccggcctgcaggtgggcagccaccgggtgaggatgagccggggctttgaggccaatgccccagcctttgacagacacttccgcaccctgaagaacctgtatggcaagcagatcatcgtgaacctgctgggcagcaaggagggggagcacatgctgagcaaggccttccagagccacctgaaggccagcgagcacgccgctgacatccagatggtgaactttgactaccaccagatggtgaagggcggcaaggccgagaagctgcacagcgtgctgaagccccaggtgcagaagttcctggactatggcttcttctacttcaacggcagcgaggtgcagcgctgccagagcggcaccgtgaggaccaactgcctggactgcctggacaggaccaacagcgtgcaggccttcctgggcctggagatgctggccaagcagctggaggccctgggcctggccgagaagccccagctggtgacccgcttccaggaggtgttccgctccatgtggagcgtgaatggagacagcatcagcaagatctatgccggcaccggggccctggagggcaaggccaagctgaaggatggagcccggtctgtgaccaggaccatccagaacaacttctttgacagcagcaagcaggaggccattgatgtgctgctgctgggcaacaccctgaacagcgacctggccgacaaggcccgggccctgctgaccaccggcagcctgcgggtgtctgagcagaccctgcagagcgccagcagcaaggtgctgaagtccatgtgtgagaacttctacaagtacagcaagcccaagaagatccgggtgtgtgtgggcacctggaatgtgaatggaggcaagcagttccgcagcatcgccttcaagaaccagaccctgacagactggctgctggatgcccccaagctggccggcatccaggagttccaggacaagaggagcaagcccacagacatctttgccatcggctttgaggagatggtggagctgaatgccggcaacatcgtgtctgccagcaccaccaaccagaagctgtgggccgtggagctgcagaagaccatcagccgggacaacaagtatgtgctgctggccagcgagcagctggtgggcgtgtgcctgtttgtgttcatccggccccagcacgcccccttcatcagagatgtggccgtggacacagtgaagacaggcatgggcggggccactggaaacaagggagctgtggccatccgcatgctgttccacaccaccagcctgtgctttgtgtgcagccactttgctgctggccagagccaggtgaaggagagaaatgaagacttcatcgagatcgccaggaagctgtccttccccatgggccgcatgctgttcagccatgactatgtgttctggtgtggggacttcaactacagaattgacctgcccaatgaggaggtgaaggagctgatccggcagcagaactgggacagcctgattgctggggaccagctgatcaaccagaagaatgccggccaggtgttccggggcttcctggagggcaaggtgacctttgcccccacctacaagtatgacctcttcagtgatgattatgacaccagcgagaagtgcaggaccccagcctggacagacagagtgctgtggaggaggaggaagtggccctttgacagatctgctgaggacctggacctgctgaatgccagcttccaggatgagagcaagatcctgtacacctggaccccaggcaccctgctgcactacggccgggcagagctgaagaccagtgaccacaggcctgtggtggccctgattgatattgacatctttgaggtggaggccgaggagcggcagaacatctacaaggaggtgattgctgtgcagggccccccagatggcaccgtgctggtgtccatcaagagcagcctgcctgagaacaacttctttgatgatgccctgattgatgagctgctgcagcagtttgccagctttggagaggtgatcctgatccgctttgtggaggacaagatgtgggtgaccttcctggagggcagcagcgccctgaatgtgctgagcctgaatggcaaggagctgctgaacagaaccatcaccatcgccctgaagagcccagactggatcaagaacctggaggaggagatgagcctggagaagatcagcatcgccctgcccagcagcaccagcagcaccctgctgggggaggatgctgaggtggccgctgactttgacatggagggagatgtggatgactacagcgctgaggtggaggagctgctgccccagcacctgcagcccagcagcagcagcggcctgggcaccagccccagcagcagccccaggaccagcccctgccagagccccaccatcagcgagggccctgtgcccagcctgcccatccggcccagccgggcccccagcaggaccccaggccccccatctgcccagagcagccccattgatgcccagcctgccacccccctgccccagaaggaccctgcccagcccctggagcccaagaggcctcctccacccaggcctgtggccccacccaccaggcctgccccaccccagaggcctcctcctccttctggggcccggagccctgcccccaccaggaaggagtttggaggcatcggggccccacccagccctggggtggcccggcgggagatggaggcccccaagagccctggcaccaccaggaaggacaacatcggccgcagccagcccagcccccaggccggcctggccggccctggccctgctggctacagcacagcccggcccaccatcccccccagggctggggtcatcagcgccccccagagccacgcccgggccagcgctggccgcctgaccccagagagccagagcaagaccagcgagaccagcaagggcagcaccttcctgcctgagcccctgaagccccaggccgccttccccccccagagcagcctgcccccaccagcccagaggctgcaggagcccctggtgcctgtggccgcccccatgccccagagcggcccccagcccaacctggagaccccaccccagcccccacccaggagccgcagcagccacagcctgcccagcgaggccagcagccagccccagcaggagcagcccagcggctag

SEQ ID NO: 172227 - DNA, 4839 bp, Artificial Sequence
  Description of Artificial Sequence: Synthetic coding sequence
atgaggaagcgctgggcctgctggagcggcagtgatgcccctgggggctgcggcggcggctgcggcagaagaagaagaagaagcaggaggaagagagctgccagcgaggagaggaggatggccttcagcaagggcttccgcatctaccacaagctggaccccccacccttcagcctcatcgtggagaccaggcacaaggaggagtgcctgatgtttgagagcggggctgtggccgtgctgagcagcgctgagaaggaggccatcaagggcacctacagcaaggtgctggatgcctacggcctgctgggcgtgctgcggctgaacctgggggacaccatgctgcactacctggtgctggtgacaggctgcatgtctgtgggcaagatccaggagagcgaggtgttccgggtgaccagcacagagttcatcagcctgagaattgacagcagtgatgaggaccgcatcagcgaggtgaggaaggtgctgaacagcggcaacttctactttgcctggagcgccagcggcatcagcctggacctgagcctgaatgcccaccgctccatgcaggagcagaccacagacaaccgcttcttctggaaccagagcctgcacctgcacctgaagcactacggcgtgaactgtgatgactggctgctgcggctgatgtgtggcggcgtggagatccgcaccatctatgctgcccacaagcaggccaaggcctgcctgatcagccggctgagctgtgaaagagctggcacccgcttcaacgtgcggggcaccaatgatgatggccacgtggccaactttgtggagacagagcaggtggtgtacctggatgattctgtgagcagcttcatccagatccggggctctgtgcccctcttctgggagcagcccggcctgcaggtgggcagccaccgggtgaggatgagccggggctttgaggccaatgccccagcctttgacagacacttccgcaccctgaagaacctgtatggcaagcagatcatcgtgaacctgctgggcagcaaggagggggagcacatgctgagcaaggccttccagagccacctgaaggccagcgagcacgccgctgacatccagatggtgaactttgactaccaccagatggtgaagggcggcaaggccgagaagctgcacagcgtgctgaagccccaggtgcagaagttcctggactatggcttcttctacttcaacggcagcgaggtgcagcgctgccagagcggcaccgtgaggaccaactgcctggactgcctggacaggaccaacagcgtgcaggccttcctgggcctggagatgctggccaagcagctggaggccctgggcctggccgagaagccccagctggtgacccgcttccaggaggtgttccgctccatgtggagcgtgaatggagacagcatcagcaagatctatgccggcaccggggccctggagggcaaggccaagctgaaggatggagcccggtctgtgaccaggaccatccagaacaacttctttgacagcagcaagcaggaggccattgatgtgctgctgctgggcaacaccctgaacagcgacctggccgacaaggcccgggccctgctgaccaccggcagcctgcgggtgtctgagcagaccctgcagagcgccagcagcaaggtgctgaagtccatgtgtgagaacttctacaagtacagcaagcccaagaagatccgggtgtgtgtgggcacctggaatgtgaatggaggcaagcagttccgcagcatcgccttcaagaaccagaccctgacagactggctgctggatgcccccaagctggccggcatccaggagttccaggacaagaggagcaagcccacagacatctttgccatcggctttgaggagatggtggagctgaatgccggcaacatcgtgtctgccagcaccaccaaccagaagctgtgggccgtggagctgcagaagaccatcagccgggacaacaagtatgtgctgctggccagcgagcagctggtgggcgtgtgcctgtttgtgttcatccggccccagcacgcccccttcatcagagatgtggccgtggacacagtgaagacaggcatgggcggggccactggaaacaagggagctgtggccatccgcatgctgttccacaccaccagcctgtgctttgtgtgcagccactttgctgctggccagagccaggtgaaggagagaaatgaagacttcatcgagatcgccaggaagctgtccttccccatgggccgcatgctgttcagccatgactatgtgttctggtgtggggacttcaactacagaattgacctgcccaatgaggaggtgaaggagctgatccggcagcagaactgggacagcctgattgctggggaccagctgatcaaccagaagaatgccggccaggtgttccggggcttcctggagggcaaggtgacctttgcccccacctacaagtatgacctcttcagtgatgattatgacaccagcgagaagtgcaggaccccagcctggacagacagagtgctgtggaggaggaggaagtggccctttgacagatctgctgaggacctggacctgctgaatgccagcttccaggatgagagcaagatcctgtacacctggaccccaggcaccctgctgcactacggccgggcagagctgaagaccagtgaccacaggcctgtggtggccctgattgatattgacatctttgaggtggaggccgaggagcggcagaacatctacaaggaggtgattgctgtgcagggccccccagatggcaccgtgctggtgtccatcaagagcagcctgcctgagaacaacttctttgatgatgccctgattgatgagctgctgcagcagtttgccagctttggagaggtgatcctgatccgctttgtggaggacaagatgtgggtgaccttcctggagggcagcagcgccctgaatgtgctgagcctgaatggcaaggagctgctgaacagaaccatcaccatcgccctgaagagcccagactggatcaagaacctggaggaggagatgagcctggagaagatcagcatcgccctgcccagcagcaccagcagcaccctgctgggggaggatgctgaggtggccgctgactttgacatggagggagatgtggatgactacagcgctgaggtggaggagctgctgccccagcacctgcagcccagcagcagcagcggcctgggcaccagccccagcagcagccccaggaccagcccctgccagagccccaccatcagcgagggccctgtgcccagcctgcccatccggcccagccgggcccccagcaggaccccaggccccccatctgcccagagcagccccattgatgcccagcctgccacccccctgccccagaaggaccctgcccagcccctggagcccaagaggcctcctccacccaggcctgtggccccacccaccaggcctgccccaccccagaggcctcctcctccttctggggcccggagccctgcccccaccaggaaggagtttggaggcatcggggccccacccagccctggggtggcccggcgggagatggaggcccccaagagccctggcaccaccaggaaggacaacatcggccgcagccagcccagcccccaggccggcctggccggccctggccctgctggctacagcacagcccggcccaccatcccccccagggctggggtcatcagcgccccccagagccacgcccgggccagcgctggccgcctgaccccagagagccagagcaagaccagcgagaccagcaagggcagcaccttcctgcctgagcccctgaagccccaggccgccttccccccccagagcagcctgcccccaccagcccagaggctgcaggagcccctggtgcctgtggccgcccccatgccccagagcggcccccagcccaacctggagaccccaccccagcccccacccaggagccgcagcagccacagcctgcccagcgaggccagcagccagccccaggtgaagaccaacggcatcagtgatggcaagcgggagagccccctgaagattgacccctttgaggacctgtccttcaacctgctggccgtgtccaaggcccagctgtctgtgcagaccagccctgtgcccaccccagaccccaagaggctcatccagctgcccagcgccacccagagcaatgtgctgagctctgtgtcctgcatgcccaccatgccacccatcccagcccggagccagagccaggagaacatgaggagcagccccaaccccttcatcaccggcctgaccaggaccaaccccttcagtgacagaacagctgcccctggcaaccccttccgggccaagtctgaggagagcgaggccacctcctggttcagcaaggaggagcctgtgaccatcagccccttccccagcctgcagcccctgggccacaacaagagccgggccagcagcagcctggatggcttcaaggacagctttgacctgcagggccagagcaccctgaagatcagcaaccccaagggctgggtgacctttgaggaggaggaggactttggagtgaagggcaagagcaagagcgcctgcagcgacctgctgggcaaccagcccagcagcttcagcggcagcaacctgaccctgaatgatgactggaacaagggcaccaacgtgtccttctgtgtgctgcccagcagaagacctcctcctcctcctgtgcccctgctgcccccaggcaccagcccccctgtggaccccttcaccaccctggccagcaaggccagccccaccctggacttcacagagaggtag

SEQ ID NO: 172228 - DNA, 4491 bp, Artificial Sequence
  Description of Artificial Sequence: Synthetic coding sequence
atggccctgagcaagggcctgcggctgctgggccgcctgggcgctgagggggactgcagcgtgctgctggaggcccggggcagagatgactgcctgctgtttgaggccggcaccgtggccaccctggcccctgaggagaaggaggtgatcaagggccagtatggcaagctgacagatgcctacggctgcctgggggagctgcggctgaagagcggcggcaccagcctgtccttcctggtgctggtgacaggctgcacctctgtgggccgcatcccagatgctgagatctacaagatcacagccacagacttctaccccctgcaggaggaggccaaggaggaggagcggctcatcgccctgaagaagatcctgagcagcggggtcttctacttctcctggcccaatgatggcagcagatttgacctgactgtgaggacccagaagcagggagatgacagcagcgagtggggcaacagcttcttctggaaccagctgctgcacgtgcccctgcggcagcaccaggtgtcctgctgtgactggctgctgaagatcatctgtggggtggtgaccatcagaacagtgtatgccagccacaagcaggccaaggcctgcctggtgtcccgggtgtcctgtgagaggacaggcacccgcttccacacccggggcgtgaatgatgatggccacgtgagcaactttgtggagacagagcagatgatctacatggatgatggagtgtcctcctttgtgcagatccggggctctgtgcccctcttctgggagcagcccggcctgcaggtgggcagccaccacctgcggctgcaccggggcctggaggccaatgccccagcctttgacagacacatggtgctgctgaaggagcagtatggccagcaggtggtggtgaacctgctgggcagccggggcggggaggaggtgctgaacagagccttcaagaagctgctgtgggccagctgccacgccggggacacccccatgatcaactttgacttccaccagtttgccaagggcggcaagctggagaagctggagaccctgctgcggccccagctgaagctgcactgggaggactttgatgtgttcaccaagggagaaaatgtgagcccccgcttccagaagggcaccctgaggatgaactgcctggactgcctggacaggaccaacacagtgcagagcttcatcgccctggaggtgctgcacctgcagctgaagaccctgggcctgagcagcaagcccatcgtggacagatttgtggagagcttcaaggccatgtggagcctgaatggccacagcctgagcaaggtgttcaccggcagccgggccctggagggcaaggccaaggtgggcaagctgaaggatggagcccgctccatgagcaggaccatccagagcaacttctttgatggagtgaagcaggaggccatcaagctgctgctggtgggagatgtgtatggagaggaggtggccgacaagggcggcatgctgctggacagcacagccctgctggtgaccccccgcatcctgaaggccatgacagagcggcagagcgagttcaccaacttcaagaggatccgcatcgccatgggcacctggaatgtgaatggaggcaagcagttccgcagcaatgtgctgaggacagctgagctgacagactggctgctggacagcccccagctgagcggggccacagacagccaggatgacagcagccctgctgacatctttgctgtgggctttgaggagatggtggagctgtctgctggcaacatcgtgaatgccagcaccaccaacaagaagatgtggggcgagcagctgcagaaggccatcagccgcagccaccgctacatcctgctgaccagcgcccagctggtgggcgtgtgcctgtacatctttgtgcggccctaccacgtgcccttcatcagagatgtggccatcgacacagtgaagacaggcatgggcggcaaggccggcaacaagggagctgtgggcatccgcttccagttccacagcaccagcttctgcttcatctgcagccacctgacagctggccagagccaggtgaaggagagaaatgaagactacaaggagatcacccagaagctgtgcttccccatgggcagaaatgtgttcagccatgactatgtgttctggtgtggggacttcaactacagaattgacctgacctatgaggaggtgttctactttgtgaagaggcaggactggaagaagctgctggagtttgaccagctgcagctgcagaagagcagcggcaagatcttcaaggacttccacgagggcgccatcaactttggccccacctacaagtatgatgtgggcagcgctgcctatgacaccagtgacaagtgcaggaccccagcctggacagacagagtgctgtggtggaggaagaagcacccctttgacaagacagctggggagctgaacctgctggacagcgacctggatgtggacaccaaggtgcgccacacctggagccctggggccctgcagtactacggccgggcagagctgcaggccagtgaccacaggcctgtgctggccatcgtggaggtggaggtgcaggaggtggatgtgggcgcccgggagagggtcttccaggaggtgtcctccttccagggccccctggatgccaccgtggtggtgaacctgcagagccccaccctggaggagaagaatgagttccctgaggacctgaggacagagctgatgcagaccctgggcagctatggcaccatcgtgctggtgcgcatcaaccagggccagatgctggtgacctttgctgacagccacagcgccctgtctgtgctggatgtggatggcatgaaggtgaagggccgggctgtgaagatccggcccaagaccaaggactggctgaagggcctgcgggaggagatcatcaggaagagggacagcatggcccctgtgagccccacagccaacagctgcctgctggaggagaactttgacttcaccagcctggactatgagagcgagggggacatcctggaggatgatgaggactacctggtggatgagttcaaccagcccggggtgtctgacagcgagctgggcggagatgacctgagtgatgtgcccggccccacagccctggccccacccagcaagagccctgccctgaccaagaagaagcagcaccccacctacaaggatgatgctgacctggtggagctgaagcgggagctggaggccgtgggggagttccgccacaggagccccagccgcagcctgtctgtgcccaaccggccccggcccccccagcccccccagaggcctcctccacccaccggcctgatggtgaagaagagcgccagtgatgccagcatcagcagcggcacccacggccagtacagcatcctgcagacagcccggctgctgcccggggccccccagcagccccccaaggccaggacaggcatcagcaagccctacaacgtgaagcagatcaagaccaccaatgcccaggaggccgaggccgccatccgctgcctgctggaggcccggggcggggccagcgaggaggccctgtctgctgtggccccccgggacctggaggccagcagcgagcctgagcccaccccaggagctgccaagccagagaccccccaggccccacccctgctgccccggcggcccccaccccgggtgcctgccatcaagaagcccaccctgcggaggacaggcaagcccctgagccctgaggagcagtttgagcagcagacagtgcacttcaccatcggccccccagagacctctgtggaggcccctcctgtggtgacagccccccgggtgccccctgtgcccaagcccaggaccttccagcccgggaaggctgctgagcggcccagccacaggaagccagccagtgatgaggcccctcctggagctggggcctctgtgcccccacccctggaggccccacccctggtgcccaaggtgccccccaggaggaagaagagcgccccagctgccttccacctgcaggtgctgcagagcaacagccagctgctgcagggcctgacctacaacagcagtgacagccccagcggccaccccccagctgctggcaccgtcttcccccagggcgacttcctgagcaccagcagcgccaccagcccagacagtgatggcaccaaggccatgaagccagaggccgcccccctgctgggggactaccaggaccccttctggaacctgctgcaccaccccaagctgctgaacaacacctggctgagcaagagcagtgaccccctggacagcggcaccaggagccccaagagggaccccattgatcctgtgtctgctggggccagcgctgccaaggccgagctgcccccagaccacgagcacaagaccctgggccactgggtgaccatcagtgaccaggagaagaggacagccctgcaggtgtttgaccccctggccaagacctag

SEQ ID NO: 172229 - DNA, 1746 bp, Artificial Sequence
  Description of Artificial Sequence: Synthetic coding sequence
atgcagaccctgggcagctatggcaccatcgtgctggtgcgcatcaaccagggccagatgctggtgacctttgctgacagccacagcgccctgtctgtgctggatgtggatggcatgaaggtgaagggccgggctgtgaagatccggcccaagaccaaggactggctgaagggcctgcgggaggagatcatcaggaagagggacagcatggcccctgtgagccccacagccaacagctgcctgctggaggagaactttgacttcaccagcctggactatgaaagtgaaggagacatcctggaggatgatgaggactacctggtggatgagttcaaccagcccggggtgtctgattctgagctgggcggagatgacctgagtgatgtgcccggccccacagccctggccccacccagcaagagccctgccctgaccaagaagaagcagcaccccacctacaaggatgatgctgacctggtggagctgaagcgggagctggaggccgtgggggagttccgccacaggagccccagccgcagcctgtctgtgcccaaccggcccaggcctccccagcccccccagaggcctcctccacccaccggcctgatggtgaagaagagcgccagtgatgccagcatcagcagcggcacccacggccagtacagcatcctgcagacagcccggctgctgcccggggccccccagcagccccccaaggccaggacaggcatcagcaagccctacaacgtgaagcagatcaagaccaccaatgcccaggaggccgaggccgccatccgctgcctgctggaggcccggggcggggccagcgaggaggccctgtctgctgtggccccccgggacctggaggccagcagcgagcctgagcccacccctggggccgccaagccagagaccccccaggccccacccctgctgccccggcggcccccaccccgggtgcctgccatcaagaagcccaccctgcggaggacaggcaagcccctgagccctgaggagcagtttgagcagcagacagtgcacttcaccatcggccccccagagacctctgtggaggcccctcctgtggtgacagccccccgggtgccccctgtgcccaagcccaggaccttccagcccgggaaggctgctgagcggcccagccacaggaagccagccagtgatgaggcccctcctggggccggggcctctgtgcccccacccctggaggccccacccctggtgcccaaggtgccccccaggaggaagaagagcgccccagctgccttccacctgcaggtgctgcagagcaacagccagctgctgcagggcctgacctacaacagcagtgacagccccagcggccaccccccagctgctggcaccgtcttcccccagggcgacttcctgagcaccagcagcgccaccagcccagacagtgatggcaccaaggccatgaagccagaggccgcccccctgctgggggactaccaggaccccttctggaacctgctgcaccaccccaagctgctgaacaacacctggctgagcaagagcagtgaccccctggacagcggcaccaggagccccaagagggaccccatcgaccctgtgtctgctggggccagcgctgccaaggccgagctgcccccagaccacgagcacaagaccctgggccactgggtgaccatcagtgaccaggagaagaggacagccctgcaggtgtttgaccccctggccaagacctag

SEQ ID NO: 172230 - DNA, 411 bp, Artificial Sequence
  Description of Artificial Sequence: Synthetic coding sequence
tgaggaagagatgactgcctgctgtttgaagctggcaccgtggccaccctggcccctgaggagaaggaggtgatcaagggccagtatggcaagctgacagatgcctacggctgcctgggggagctgcggctgaagagcggcggcaccagcctgtccttcctggtgctggtgacaggctgcacctctgtgggccgcatcccagatgctgagatctacaagatcacagccacagacttctaccccctgcaggaggaggccaaggaggaggagcggctgattgccctgaagaagatcctgagcagtggagtcttctacttctcctggcccaatgatggcagcagatttgacctgactgtgaggacccagaagcagggagatgacagcagcgagtggggcaacagcttcttctag

SEQ ID NO: 172231 - DNA, 3867 bp, Artificial Sequence
  Description of Artificial Sequence: Synthetic coding sequence
atggccctgagcaagggcctgcggctgctgggccgcctgggcgctgagggggactgcagcgtgctgctggaggcccggggcagagatgactgcctgctgtttgaggccggcaccgtggccaccctggcccctgaggagaaggaggtgatcaagggccagtatggcaagctgacagatgcctacggctgcctgggggagctgcggctgaagagcggcggcaccagcctgtccttcctggtgctggtgacaggctgcacctctgtgggccgcatcccagatgctgagatctacaagatcacagccacagacttctaccccctgcaggaggaggccaaggaggaggagcggctcatcgccctgaagaagatcctgagcagcggggtcttctacttctcctggcccaatgatggcagcagatttgacctgactgtgaggacccagaagcagggagatgacagcagcgagtggggcaacagcttcttctggaaccagctgctgcacgtgcccctgcggcagcaccaggtgtcctgctgtgactggctgctgaagatcatctgtggggtggtgaccatcagaacagtgtatgccagccacaagcaggccaaggcctgcctggtgtcccgggtgtcctgtgagaggacaggcacccgcttccacacccggggcgtgaatgatgatggccacgtgagcaactttgtggagacagagcagatgatctacatggatgatggagtgtcctcctttgtgcagatccggggctctgtgcccctcttctgggagcagcccggcctgcaggtgggcagccaccacctgcggctgcaccggggcctggaggccaatgccccagcctttgacagacacatggtgctgctgaaggagcagtatggccagcaggtggtggtgaacctgctgggcagccggggcggggaggaggtgctgaacagagccttcaagaagctgctgtgggccagctgccacgccggggacacccccatgatcaactttgacttccaccagtttgccaagggcggcaagctggagaagctggagaccctgctgcggccccagctgaagctgcactgggaggactttgatgtgttcaccaagggagaaaatgtgagcccccgcttccagaagggcaccctgaggatgaactgcctggactgcctggacaggaccaacacagtgcagagcttcatcgccctggaggtgctgcacctgcagctgaagaccctgggcctgagcagcaagcccatcgtggacagatttgtggagagcttcaaggccatgtggagcctgaatggccacagcctgagcaaggtgttcaccggcagccgggccctggagggcaaggccaaggtgggcaagctgaaggatggagcccgctccatgagcaggaccatccagagcaacttctttgatggagtgaagcaggaggccatcaagctgctgctggtgggagatgtgtatggagaggaggtggccgacaagggcggcatgctgctggacagcacagccctgctggtgaccccccgcatcctgaaggccatgacagagcggcagagcgagttcaccaacttcaagaggatccgcatcgccatgggcacctggaatgtgaatggaggcaagcagttccgcagcaatgtgctgaggacagctgagctgacagactggctgctggacagcccccagctgagcggggccacagacagccaggatgacagcagccctgctgacatctttgctgtgggctttgaggagatggtggagctgtctgctggcaacatcgtgaatgccagcaccaccaacaagaagatgtggggcgagcagctgcagaaggccatcagccgcagccaccgctacatcctgctgaccagcgcccagctggtgggcgtgtgcctgtacatctttgtgcggccctaccacgtgcccttcatcagagatgtggccatcgacacagtgaagacaggcatgggcggcaaggccggcaacaagggagctgtgggcatccgcttccagttccacagcaccagcttctgcttcatctgcagccacctgacagctggccagagccaggtgaaggagagaaatgaagactacaaggagatcacccagaagctgtgcttccccatgggcagaaatgtgttcagccatgactatgtgttctggtgtggggacttcaactacagaattgacctgacctatgaggaggtgttctactttgtgaagaggcaggactggaagaagctgctggagtttgaccagctgcagctgcagaagagcagcggcaagatcttcaaggacttccacgagggcgccatcaactttggccccacctacaagtatgatgtgggcagcgctgcctatgacaccagtgacaagtgcaggaccccagcctggacagacagagtgctgtggtggaggaagaagcacccctttgacaagacagctggggagctgaacctgctggacagcgacctggatgtggacaccaaggtgcgccacacctggagccctggggccctgcagtactacggccgggcagagctgcaggccagtgaccacaggcctgtgctggccatcgtggaggtggaggtgcaggaggtggatgtgggcgcccgggagagggtcttccaggaggtgtcctccttccagggccccctggatgccaccgtggtggtgaacctgcagagccccaccctggaggagaagaatgagttccctgaggacctgaggacagagctgatgcagaccctgggcagctatggcaccatcgtgctggtgcgcatcaaccagggccagatgctggtgacctttgctgacagccacagcgccctgtctgtgctggatgtggatggcatgaaggtgaagggccgggctgtgaagatccggcccaagaccaaggactggctgaagggcctgcgggaggagatcatcaggaagagggacagcatggcccctgtgagccccacagccaacagctgcctgctggaggagaactttgacttcaccagcctggactatgagagcgagggggacatcctggaggatgatgaggactacctggtggatgagttcaaccagcccggggtgtctgacagcgagctgggcggagatgacctgagtgatgtgcccggccccacagccctggccccacccagcaagagccctgccctgaccaagaagaagcagcaccccacctacaaggatgatgctgacctggtggagctgaagcgggagctggaggccgtgggggagttccgccacaggagccccagccgcagcctgtctgtgcccaaccggccccggcccccccagcccccccagaggcctcctccacccaccggcctgatggtgaagaagagcgccagtgatgccagcatcagcagcggcacccacggccagtacagcatcctgcagacagcccggctgctgcccggggccccccagcagccccccaaggccaggacaggcatcagcaagccctacaacgtgaagcagatcaagaccaccaatgcccaggaggccgaggccgccatccgctgcctgctggaggcccggggcggggccagcgaggaggccctgtctgctgtggccccccgggacctggaggccagcagcgagcctgagcccaccccaggagctgccaagccagagaccccccaggccccacccctgctgccccggcggcccccaccccgggtgcctgccatcaagaagcccaccctgcggaggacaggcaagatcgtgttctgcagccgcagccaggccagccagccctgcctgctgctgcagagacatgaatttgtgaggacagtggccgcccagaggctggcctctgtggacaccagcggcagctctgtgtag

SEQ ID NO: 172232 - DNA, 4356 bp, Artificial Sequence
  Description of Artificial Sequence: Synthetic coding sequence
atggccctgagcaagggcctgcggctgctgggccgcctgggcgctgagggggactgcagcgtgctgctggaggcccggggcagagatgactgcctgctgtttgaggccggcaccgtggccaccctggcccctgaggagaaggaggtgatcaagggccagtatggcaagctgacagatgcctacggctgcctgggggagctgcggctgaagagcggcggcaccagcctgtccttcctggtgctggtgacaggctgcacctctgtgggccgcatcccagatgctgagatctacaagatcacagccacagacttctaccccctgcaggaggaggccaaggaggaggagcggctcatcgccctgaagaagatcctgagcagcggggtcttctacttctcctggcccaatgatggcagcagatttgacctgactgtgaggacccagaagcagggagatgacagcagcgagtggggcaacagcttcttctggaaccagctgctgcacgtgcccctgcggcagcaccaggtgtcctgctgtgactggctgctgaagatcatctgtggggtggtgaccatcagaacagtgtatgccagccacaagcaggccaaggcctgcctggtgtcccgggtgtcctgtgagaggacaggcacccgcttccacacccggggcgtgaatgatgatggccacgtgagcaactttgtggagacagagcagatgatctacatggatgatggagtgtcctcctttgtgcagatccggggctctgtgcccctcttctgggagcagcccggcctgcaggtgggcagccaccacctgcggctgcaccggggcctggaggccaatgccccagcctttgacagacacatggtgctgctgaaggagcagtatggccagcaggtggtggtgaacctgctgggcagccggggcggggaggaggtgctgaacagagccttcaagaagctgctgtgggccagctgccacgccggggacacccccatgatcaactttgacttccaccagtttgccaagggcggcaagctggagaagctggagaccctgctgcggccccagctgaagctgcactgggaggactttgatgtgttcaccaagggagaaaatgtgagcccccgcttccagaagggcaccctgaggatgaactgcctggactgcctggacaggaccaacacagtgcagagcttcatcgccctggaggtgctgcacctgcagctgaagaccctgggcctgagcagcaagcccatcgtggacagatttgtggagagcttcaaggccatgtggagcctgaatggccacagcctgagcaaggtgttcaccggcagccgggccctggagggcaaggccaaggtgggcaagctgaaggatggagcccgctccatgagcaggaccatccagagcaacttctttgatggagtgaagcaggaggccatcaagctgctgctggtgggagatgtgtatggagaggaggtggccgacaagggcggcatgctgctggacagcacagccctgctggtgaccccccgcatcctgaaggccatgacagagcggcagagcgagttcaccaacttcaagaggatccgcatcgccatgggcacctggaatgtgaatggaggcaagcagttccgcagcaatgtgctgaggacagctgagctgacagactggctgctggacagcccccagctgagcggggccacagacagccaggatgacagcagccctgctgacatctttgctgtgggctttgaggagatggtggagctgtctgctggcaacatcgtgaatgccagcaccaccaacaagaagatgtggggcgagcagctgcagaaggccatcagccgcagccaccgctacatcctgctgaccagcgcccagctggtgggcgtgtgcctgtacatctttgtgcggccctaccacgtgcccttcatcagagatgtggccatcgacacagtgaagacaggcatgggcggcaaggccggcaacaagggagctgtgggcatccgcttccagttccacagcaccagcttctgcttcatctgcagccacctgacagctggccagagccaggtgaaggagagaaatgaagactacaaggagatcacccagaagctgtgcttccccatgggcagaaatgtgttcagccatgactatgtgttctggtgtggggacttcaactacagaattgacctgacctatgaggaggtgttctactttgtgaagaggcaggactggaagaagctgctggagtttgaccagctgcagctgcagaagagcagcggcaagatcttcaaggacttccacgagggcgccatcaactttggccccacctacaagtatgatgtgggcagcgctgcctatgacaccagtgacaagtgcaggaccccagcctggacagacagagtgctgtggtggaggaagaagcacccctttgacaagacagctggggagctgaacctgctggacagcgacctggatgtggacaccaaggtgcgccacacctggagccctggggccctgcagtactacggccgggcagagctgcaggccagtgaccacaggcctgtgctggccatcgtggaggtggaggtgcaggaggtggatgtgggcgcccgggagagggtcttccaggaggtgtcctccttccagggccccctggatgccaccgtggtggtgaacctgcagagccccaccctggaggagaagaatgagttccctgaggacctgaggacagagctgatgcagaccctgggcagctatggcaccatcgtgctggtgcgcatcaaccagggccagatgctggtgacctttgctgacagccacagcgccctgtctgtgctggatgtggatggcatgaaggtgaagggccgggctgtgaagatccggcccaagaccaaggactggctgaagggcctgcgggaggagatcatcaggaagagggacagcatggcccctgtgagccccacagccaacagctgcctgctggaggagaactttgacttcaccagcctggactatgagagcgagggggacatcctggaggatgatgaggactacctggtggatgagttcaaccagcccggggtgtctgacagcgagctgggcggagatgacctgagtgatgtgcccggccccacagccctggccccacccagcaagagccctgccctgaccaagaagaagcagcaccccacctacaaggccggcctgatggtgaagaagagcgccagtgatgccagcatcagcagcggcacccacggccagtacagcatcctgcagacagcccggctgctgcccggggccccccagcagccccccaaggccaggacaggcatcagcaagccctacaacgtgaagcagatcaagaccaccaatgcccaggaggccgaggccgccatccgctgcctgctggaggcccggggcggggccagcgaggaggccctgtctgctgtggccccccgggacctggaggccagcagcgagcctgagcccacccctggggccgccaagccagagaccccccaggccccacccctgctgccccggcggcccccaccccgggtgcctgccatcaagaagcccaccctgcggaggacaggcaagcccctgagccctgaggagcagtttgagcagcagacagtgcacttcaccatcggccccccagagacctctgtggaggcccctcctgtggtgacagccccccgggtgccccctgtgcccaagcccaggaccttccagcccgggaaggctgctgagcggcccagccacaggaagccagccagtgatgaggcccctcctggggccggggcctctgtgcccccacccctggaggccccacccctggtgcccaaggtgccccccaggaggaagaagagcgccccagctgccttccacctgcaggtgctgcagagcaacagccagctgctgcagggcctgacctacaacagcagtgacagccccagcggccaccccccagctgctggcaccgtcttcccccagggcgacttcctgagcaccagcagcgccaccagcccagacagtgatggcaccaaggccatgaagccagaggccgcccccctgctgggggactaccaggaccccttctggaacctgctgcaccaccccaagctgctgaacaacacctggctgagcaagagcagtgaccccctggacagcggcaccaggagccccaagagggaccccatcgaccctgtgtctgctggggccagcgctgccaaggccgagctgcccccagaccacgagcacaagaccctgggccactgggtgaccatcagtgaccaggagaagaggacagccctgcaggtgtttgaccccctggccaagacctag

SEQ ID NO: 172233 - DNA, 279 bp, Artificial Sequence
  Description of Artificial Sequence: Synthetic coding sequence
atgttcctgtatgccagcggccctgcccccccagctggcacctgccgctggggcggccagggcggcaccagcctgtccttcctggtgctggtgacaggctgcacctctgtgggccgcatcccagatgctgagatctacaagatcacagccacagacttctaccccctgcaggaggaggccaaggaggaggagcggctgattgccctgaagaagatcctgagcagtggagtcttctacttctcctggcccaatgatggcagcagatttgacctgacctag

SEQ ID NO: 172234 - DNA, 1551 bp, Artificial Sequence
  Description of Artificial Sequence: Synthetic coding sequence
atgttcctgtatgccagcggccctgcccccccagctggcacctgccgctggggcggccagggcggcaccagcctgtccttcctggtgctggtgacaggctgcacctctgtgggccgcatcccagatgctgagatctacaagatcacagccacagacttctaccccctgcaggaggaggccaaggaggaggagcggctgattgccctgaagaagatcctgagcagtggagtcttctacttctcctggcccaatgatggcagcagatttgacctgactgtgaggacccagaagcagggagatgacagcagcgagtggggcaacagcttcttctggaaccagctgctgcacgtgcccctgcggcagcaccaggtgtcctgctgtgactggctgctgaagatcatctgtggggtggtgaccatcagaacagtgtatgccagccacaagcaggccaaggcctgcctggtgtcccgggtgtcctgtgagaggacaggcacccgcttccacacccggggcgtgaatgatgatggccacgtgagcaactttgtggagacagagcagatgatctacatggatgatggagtgagcagctttgtgcagatccggggctctgtgcccctcttctgggagcagcccggcctgcaggtgggcagccaccacctgcggctgcaccggggcctggaggccaatgccccagcctttgacagacacatggtgctgctgaaggagcagtatggccagcaggtggtggtgaacctgctgggcagcagaggaggagaggaggtgctgaacagagccttcaagtttgccaagggcggcaagctggagaagctggagaccctgctgcggccccagctgaagctgcactgggaggactttgatgtgttcaccaagggagaaaatgtgagcccccgcttccagaagggcaccctgaggatgaactgcctggactgcctggacaggaccaacacagtgcagagcttcatcgccctggaggtgctgcacctgcagctgaagaccctgggcctgagcagcaagcccatcgtggacagatttgtggagagcttcaaggccatgtggagcctgaatggccacagcctgagcaaggtgttcaccggcagccgggccctggagggcaaggccaaggtgggcaagctgaaggatggagcccgctccatgagcaggaccatccagagcaacttctttgatggagtgaagcaggaggccatcaagctgctgctggtgggagatgtgtatggagaggaggtggccgacaagggcggcatgctgctggacagcacagccctgctggtgaccccccgcatcctgaaggccatgacagagcggcagagcgagttcaccaacttcaagaggatccgcatcgccatgggcacctggaatgtgaatggaggcaagcagttccgcagcaatgtgctgaggacagctgagctgacagactggctgctggacagcccccagctgagcggggccacagacagccagggcgagggcagtgactttggaggagacaagatccagctgcacctgacctag

SEQ ID NO: 172235 - DNA, 438 bp, Artificial Sequence
  Description of Artificial Sequence: Synthetic coding sequence
atgaatggccgggtggactacctggtgacagaggaggagatcaacctgacccggggccccagcggcctgggcttcaacatcgtgggcggcacagaccagcagtatgtgtccaatgacagcggcatctacgtgagccgcatcaaggaaaatggagctgctgccctggatggccgcctgcaggagggggacaagatcctgtctgtgaatggccaggacctgaagaacctgctgcaccaggatgctgtggacctcttcagaaatgccggctatgctgtgtccctgcgggtgcagcaccggctgcaggtgcagaatggccccatcggccacagaggagagggggaccccagcggcatccccatcttcatggtgctggtgcctgtgtttgccctgaccatggtggccgcctgggccttcatgagataccggcagcagctgtag

SEQ ID NO: 172236 - DNA, 957 bp, Artificial Sequence
  Description of Artificial Sequence: Synthetic coding sequence
atggccggccgcagcctgaccagcaaggccgagcccacagctggagctgtggacagagctgagaaggccggcggccaggacaccagcagccagaagattgaggacctgatggagatggtgcagaagctgcagaaggtgggcagcctggagccccgggtggaggtgctgatcaaccgcatcaatgaggtgcagcaggccaagaagaaggccaacaaggacctgggggaggcccggaccatctgtgaggccctgcagaaggagctggacagcctgcacggggagaaggtgcacctgaaggagatcctgagcaagaagcaggagaccctgcgcatcctgcggctgcactgccaggagaaggagagcgaggcccacaggaagcacaccatgctgcaggagtgcaaggagcgcatcagcgccctgaacctgcagatcgaggaggagaagaacaagcagaggcagctgcggctggcctttgaggagcagctggaggacctgatgggccagcacaaggacctgtgggacttccacatgcctgagcggctggccaaggagatctgtgccctggacagcagcaaggagcagctgctgaaggaggagaagctggtgaaggccaccctggaggatgtgaagcaccagctgtgcagcctgtgtggggctgagggccccagcaccctggatgagggcctcttcctgcggagccaggaggccgccgccaccgtgcagctgttccaggaggagcacaggaaggccgaggagctgctggccgctgctgcccagaggcaccagcagctgcagcagaagtgccagcagcagcagcagaagaggcagaggctgaaggaggagctggagaagcacggcatgcaggtgcctgcccaggcccagagcacccaggaggaggaggccggccctggagatgtggccccccggcccggccggcctgtgacctggtggagctag

SEQ ID NO: 172237 - DNA, 1056 bp, Artificial Sequence
  Description of Artificial Sequence: Synthetic coding sequence
atggccggccgcagcctgaccagcaaggccgagcccacagctggagctgtggacagagctgagaaggccggcggccaggacaccagcagccagaagattgaggacctgatggagatggtgcagaagctgcagaaggtgggcagcctggagccccgggtggaggtgctgatcaaccgcatcaatgaggtgcagcaggccaagaagaaggccaacaaggacctgggggaggcccggaccatctgtgaggccctgcagaaggagctggacagcctgcacggggagaaggtgcacctgaaggagatcctgagcaagaagcaggagaccctgcgcatcctgcggctgcactgccaggagaaggagagcgaggcccacaggaagcacaccatgctgcaggagtgcaaggagcgcatcagcgccctgaacctgcagatcgaggaggagaagaacaagcagaggcagctgcggctggcctttgaggagcagctggaggacctgatgggccagcacaaggacctgtgggacttccacatgcctgagcggctggccaaggagatctgtgccctggacagcagcaaggagcagctgctgaaggaggagaagctggtgaaggccaccctggaggatgtgaagcaccagctgtgcagcctgtgtggggctgagggccccagcaccctggatgagggcctcttcctgcggagccaggaggccgccgccaccgtgcagctgttccaggaggagcacaggaaggccgaggagctgctggccgctgctgcccagaggcaccagcagctgcagcagaagtgccagcagcagcagcagaagaggcagaggctgaaggaggagctggagaagcacggcatgcaggtgcctgcccaggcccagagcacccaggaggaggaggccggccctggagatgtggccagccccaagcccctgaagggggagaggcctggagctgcccaccaggccggcccagatgtgctgattggccaggaggacaccctgcacccagacctgagcccccggggcttccaggagatcaaggagctgttctag

SEQ ID NO: 172238 - DNA, 849 bp, Artificial Sequence
  Description of Artificial Sequence: Synthetic coding sequence
atggagatggtgcagaagctgcagaaggtgggcagcctggagccccgggtggaggtgctgatcaaccgcatcaatgaggtgcagcaggccaagaagaaggccaacaaggacctgggggaggcccggaccatctgtgaggccctgcagaaggagctggacagcctgcacggggagaaggtgcacctgaaggagatcctgagcaagaagcaggagaccctgcgcatcctgcggctgcactgccaggagaaggagagcgaggcccacaggaagcacaccatgctgcaggagtgcaaggagcgcatcagcgccctgaacctgcagatcgaggaggagaagaacaagcagaggcagctgcggctggcctttgaggagcagctggaggacctgatgggccagcacaaggacctgtgggacttccacatgcctgagcggctggccaaggagatctgtgccctggacagcagcaaggagcagctgctgaaggaggagaagctggtgaaggccaccctggaggatgtgaagcaccagctgtgcagcctgtgtggggctgagggccccagcaccctggatgagggcctcttcctgcggagccaggaggccgccgccaccgtgcagctgttccaggaggagcacaggaaggccgaggagctgctggccgctgctgcccagaggcaccagcagctgcagcagaagtgccagcagcagcagcagaagaggcagaggctgaaggaggagctggagaagcacggcatgcaggtgcctgcccaggcccagagcacccaggaggaggaggccggccctggagatgtggccccccggcccggccggcctgtgacctggtggagctag

SEQ ID NO: 172239 - DNA, 849 bp, Artificial Sequence; identical to SEQ ID NO: 172238
  Description of Artificial Sequence: Synthetic coding sequence

SEQ ID NO: 172240 - DNA, 657 bp, Artificial Sequence
  Description of Artificial Sequence: Synthetic coding sequence
atggagcggcagggcgtggatgtgccccacgtgaagtgcaaggaccaggagccccagcccctgggggagagcaaggagcacccccgctgggaggagaactgtgaggaggaggccggcggcggccctgccagcgccagctgccagctgactgtgctggagggcaagagcggcctgtacttcagcagcctggacagcagcattgacatcctgcagaagagggcccaggagctgattgagaacatcaacaagagccggcagaaggaccacgccctgatgaccaacttcaggaacagcctgaagaccaaggtgtctgacctgacagagaagctggaggagcgcatctaccagatctacaatgaccacaacaagatcatccaggagaagctgcaggagttcacccagaagatggccaagatcagccacctggagacagagctgaagcaggtgtgccacagcgtggagaccgtgtacaaggacctgtgcctgcagcctgagcagagcctgcggctgcgctggggccctgaccacagccggggcaagagcccccccaggcctggcaacagccagcccccagatgtgtttgtgtcctctgtggccgagaccaccagccaggccacagccagcgaggtgcagaccaacagagatggagaatgttag

SEQ ID NO: 172241 - DNA, 2931 bp, Artificial Sequence
  Description of Artificial Sequence: Synthetic coding sequence
atggagaagcagaagccctttgccctgtttgtgccccccaggagcagcagcagccaggtgtctgctgtgaagccccagaccctgggcggggacagcaccttcttcaagagcttcaacaagtgcacagaagatgactttgagttcccctttgccaagaccaacctgagcaagaatggagagaacatcgacagcgaccctgccctgcagaaggtgaacttcctgcctgtgctggagcaggtgggcaacagcgactgccactaccaggagggcctgaaggacagcgacctggagaacagcgagggcctgagccgggtgtacagcaagctgtacaaggaggccgagaagatcaagaagtggaaggtgtccacagaagctgagctgcggcagaaggagagcaagctgcaggagaacaggaagatcatcgaggcccagaggaaggccatccaggagctgcagtttggaaatgagaaggtgtccctgaagctggaggagggcatccaggagaacaaggacctgatcaaggaaaataatgccaccaggcacctgtgcaacctgctgaaggagacctgtgcccggtctgctgagaagaccaagaagtatgaatatgaaagagaggagacccggcaggtgtacatggacctgaacaacaacatcgagaagatgatcacagcctttgaggagctgcgggtgcaggccgagaacagccggctggagatgcacttcaagctgaaggaggactatgagaagatccagcacctggagcaggagtacaagaaggagatcaatgacaaggagaagcaggtgtccctgctgctgatccagatcacagagaaggagaacaagatgaaggacctgaccttcctgctggaggagagccgggacaaggtgaaccagctggaggagaagaccaagctgcagagcgagaacctgaagcagagcattgagaagcagcaccacctgaccaaggagctggaggacatcaaggtgtccctgcagaggtctgtgtccacccagaaggccctggaggaggacctgcagatcgccaccaagaccatctgccagctgacagaggagaaggagacccagatggaggagagcaacaaggcccgggccgcccacagctttgtggtgacagaatttgagaccaccgtgtgcagcctggaggagctgctgaggacagagcagcagaggctggagaagaatgaagaccagctgaagatcctgaccatggagctgcagaagaagagcagcgagctggaggagatgaccaagctgaccaacaacaaggaggtggagctggaggagctgaagaaggtgctgggggagaaggagaccctgctgtatgagaacaagcagtttgagaagattgctgaggagctgaagggcacagagcaggagctgattggcctgctgcaggcccgggagaaggaggtgcatgacctggagatccagctgacagccatcaccaccagcgagcagtactacagcaaggaggtgaaggacctgaagacagagctggagaatgagaagctgaagaacacagagctgaccagccactgcaacaagctgagcctggagaacaaggagctgacccaggagaccagtgacatgaccctggagctgaagaaccagcaggaggacatcaacaacaacaagaagcaggaggagaggatgctgaagcagatcgagaacctgcaggagacagagacccagctgagaaatgagctggagtatgtgcgggaggagctgaagcagaagagagatgaggtgaagtgcaagctggacaagtctgaggagaactgcaacaacctgaggaagcaggtggagaacaagaacaagtacatcgaggagctgcagcaggagaacaaggccctgaagaagaagggcacagctgagagcaagcagctgaatgtgtatgagatcaaggtgaacaagctggagctggagctggagagcgccaagcagaagtttggagagatcacagacacctaccagaaggagattgaggacaagaagatcagcgaggagaacctgctggaggaggtggagaaggccaaggtgattgctgatgaggccgtgaagctgcagaaggagattgacaagcgctgccagcacaagattgctgagatggtggccctgatggagaagcacaagcaccagtatgacaagatcatcgaggagcgggacagcgagctgggcctgtacaagagcaaggagcaggagcagagcagcctgcgggccagcctggagattgagctgagcaacctgaaggccgagctgctgtctgtgaagaagcagctggagattgagcgggaggagaaggagaagctgaagcgggaggccaaggaaaatacagccaccctgaaggagaagaaggacaagaagacccagaccttcctgctggagaccccagagatctactggaagctggacagcaaggctgtgcccagccagacagtgtccaggaacttcacctctgtggaccacggcatcagcaaggacaagagggactacctgtggaccagcgccaagaacaccctgagcacccccctgcccaaggcctacacagtgaagacccccaccaagcccaagctgcagcagcgggagaacctgaacatccccatcgaggagagcaagaagaagaggaagatggcctttgaatttgacatcaacagcgacagcagcgagaccacagacctgctgtccatggtgtctgaggaggagaccctgaagaccctgtacagaaacaacaaccccccagccagccacctgtgtgtgaagacccccaagaaggcccccagcagcctgaccaccccaggcagcaccctgaagtttggagccatcaggaagatgagagaagatcgctgggccgtgattgccaagatggacaggaagaagaagctgaaggaggccgagaagctgtttgtgtag

SEQ ID NO: 172242 - DNA, 2931 bp, Artificial Sequence; identical to SEQ ID NO: 172241
  Description of Artificial Sequence: Synthetic coding sequence

SEQ ID NO: 172243 - DNA, 2379 bp, Artificial Sequence
  Description of Artificial Sequence: Synthetic coding sequence
atggagaagcagaagccctttgccctgtttgtgccccccaggagcagcagcagccaggtgtctgctgtgaagccccagaccctgggcggggacagcaccttcttcaagagcttcaacaagtgcacagaagatgactttgagttcccctttgccaagaccaacctgagcaagaatggagagaacatcgacagcgaccctgccctgcagaaggtgaacttcctgcctgtgctggagcaggtgggcaacagcgactgccactaccaggagggcctgaaggacagcgacctggagaacagcgagggcctgagccgggtgtacagcaagctgtacaaggaggccgagaagatcaagaagtggaaggtgtccacagaagctgagctgcggcagaaggagagcaagctgcaggagaacaggaagatcatcgaggcccagaggaaggccatccaggagctgcagtttggaaatgagaaggtgtccctgaagctggaggagggcatccaggagaacaaggacctgatcaaggaaaataatgccaccaggcacctgtgcaacctgctgaaggagacctgtgcccggtctgctgagaagaccaagaagtatgaatatgaaagagaggagacccggcaggtgtacatggacctgaacaacaacatcgagaagatgatcacagcctttgaggagctgcgggtgcaggccgagaacagccggctggagatgcacttcaagctgaaggaggactatgagaagatccagcacctggagcaggagtacaagaaggagatcaatgacaaggagaagcaggtgtccctgctgctgatccagatcacagagaaggagaacaagatgaaggacctgaccttcctgctggaggagagccgggacaaggtgaaccagctggaggagaagaccaagctgcagagcgagaacctgaagcagagcattgagaagcagcaccacctgaccaaggagctggaggacatcaaggtgtccctgcagaggtctgtgtccacccagaaggccctggaggaggacctgcagatcgccaccaagaccatctgccagctgacagaggagaaggagacccagatggaggagagcaacaaggcccgggccgcccacagctttgtggtgacagaatttgagaccaccgtgtgcagcctggaggagctgctgaggacagagcagcagaggctggagaagaatgaagaccagctgaagatcctgaccatggagctgcagaagaagagcagcgagctggaggagatgaccaagctgaccaacaacaaggaggtggagctggaggagctgaagaaggtgctgggggagaaggagaccctgctgtatgagaacaagcagtttgagaagattgctgaggagctgaagggcacagagcaggagctgattggcctgctgcaggcccgggagaaggaggtgcatgacctggagatccagctgacagccatcaccaccagcgagcagtactacagcaaggaggtgaaggacctgaagacagagctggagaatgagaagctgaagaacacagagctgaccagccactgcaacaagctgagcctggagaacaaggagctgacccaggagaccagtgacatgaccctggagctgaagaaccagcaggaggacatcaacaacaacaagaagcaggaggagaggatgctgaagcagatcgagaacctgcaggagacagagacccagctgagaaatgagctggagtatgtgcgggaggagctgaagcagaagagagatgaggtgaagtgcaagctggacaagtctgaggagaactgcaacaacctgaggaagcaggtggagaacaagaacaagtacatcgaggagctgcagcaggagaacaaggccctgaagaagaagggcacagctgagagcaagcagctgaatgtgtatgagatcaaggtgaacaagctggagctggagctggagagcgccaagcagaagtttggagagatcacagacacctaccagaaggagattgaggacaagaagatcagcgaggagaacctgctggaggaggtggagaaggccaaggtgattgctgatgaggccgtgaagctgcagaaggagattgacaagcgctgccagcacaagattgctgagatggtggccctgatggagaagcacaagcaccagtatgacaagatcatcgaggagcgggacagcgagctgggcctgtacaagagcaaggagcaggagcagagcagcctgcgggccagcctggagattgagctgagcaacctgaaggccgagctgctgtctgtgaagaagcagctggagattgagcgggaggagaaggagaagctgaagcgggaggccaaggaaaatacagccaccctgaaggagaagaagtag

SEQ ID NO: 172244 - DNA, 2388 bp, Artificial Sequence
  Description of Artificial Sequence: Synthetic coding sequence
atggagaagcagaagccctttgccctgtttgtgccccccaggagcagcagcagccaggtgtctgctgtgaagccccagaccctgggcggggacagcaccttcttcaagagcttcaacaagtgcacagaagatgactttgagttcccctttgccaagaccaacctgagcaagaatggagagaacatcgacagcgaccctgccctgcagaaggtgaacttcctgcctgtgctggagcaggtgggcaacagcgactgccactaccaggagggcctgaaggacagcgacctggagaacagcgagggcctgagccgggtgtacagcaagctgtacaaggaggccgagaagatcaagaagtggaaggtgtccacagaagctgagctgcggcagaaggagagcaagctgcaggagaacaggaagatcatcgaggcccagaggaaggccatccaggagctgcagtttggaaatgagaaggtgtccctgaagctggaggagggcatccaggagaacaaggacctgatcaaggaaaataatgccaccaggcacctgtgcaacctgctgaaggagacctgtgcccggtctgctgagaagaccaagaagtatgaatatgaaagagaggagacccggcaggtgtacatggacctgaacaacaacatcgagaagatgatcacagcctttgaggagctgcgggtgcaggccgagaacagccggctggagatgcacttcaagctgaaggaggactatgagaagatccagcacctggagcaggagtacaagaaggagatcaatgacaaggagaagcaggtgtccctgctgctgatccagatcacagagaaggagaacaagatgaaggacctgaccttcctgctggaggagagccgggacaaggtgaaccagctggaggagaagaccaagctgcagagcgagaacctgaagcagagcattgagaagcagcaccacctgaccaaggagctggaggacatcaaggtgtccctgcagaggtctgtgtccacccagaaggccctggaggaggacctgcagatcgccaccaagaccatctgccagctgacagaggagaaggagacccagatggaggagagcaacaaggcccgggccgcccacagctttgtggtgacagaatttgagaccaccgtgtgcagcctggaggagctgctgaggacagagcagcagaggctggagaagaatgaagaccagctgaagatcctgaccatggagctgcagaagaagagcagcgagctggaggagatgaccaagctgaccaacaacaaggaggtggagctggaggagctgaagaaggtgctgggggagaaggagaccctgctgtatgagaacaagcagtttgagaagattgctgaggagctgaagggcacagagcaggagctgattggcctgctgcaggcccgggagaaggaggtgcatgacctggagatccagctgacagccatcaccaccagcgagcagtactacagcaaggaggtgaaggacctgaagacagagctggagaatgagaagctgaagaacacagagctgaccagccactgcaacaagctgagcctggagaacaaggagctgacccaggagaccagtgacatgaccctggagctgaagaaccagcaggaggacatcaacaacaacaagaagcaggaggagaggatgctgaagcagatcgagaacctgcaggagacagagacccagctgagaaatgagctggagtatgtgcgggaggagctgaagcagaagagagatgaggtgaagtgcaagctggacaagtctgaggagaactgcaacaacctgaggaagcaggtggagaacaagaacaagtacatcgaggagctgcagcaggagaacaaggccctgaagaagaagggcacagctgagagcaagcagctgaatgtgtatgagatcaaggtgaacaagctggagctggagctggagagcgccaagcagaagtttggagagatcacagacacctaccagaaggagattgaggacaagaagatcagcgaggagaacctgctggaggaggtggagaaggccaaggtgattgctgatgaggccgtgaagctgcagaaggagattgacaagcgctgccagcacaagattgctgagatggtggccctgatggagaagcacaagcaccagtatgacaagatcatcgaggagcgggacagcgagctgggcctgtacaagagcaaggagcaggagcagagcagcctgcgggccagcctggagattgagctgagcaacctgaaggccgagctgctgtctgtgaagaagcagctggagattgagcgggaggagaaggagaagctgaagcgggaggccaaggaaaatacagccaccctgaaggagaagaaggacaagaagtag

SEQ ID NO: 172245 - DNA, 4593 bp, Artificial Sequence
  Description of Artificial Sequence: Synthetic coding sequence
atgcccatccggccagacctgcagcagctggagaagtgcattgatgatgccctgaggaagaatgacttcaagcccctgaagaccctgctgcagattgacatctgtgaagatgtgaagatcaagtgcagcaagcagttcttccacaaggtggacaacctgatctgccgggagctgaacaaggaggacatccacaacgtgtctgccatcctggtgtctgtgggccgctgtgggaagaacatctctgtgctgggccaggccggcctgctgaccatgatcaagcagggcctcatccagaagatggtggcctggtttgagaagagcaaggacatcatccagagccagggcaacagcaaggatgaagctgtgctgaacatgattgaggacctggtggacctgctgctggtgattcatgatgtgtctgatgagggcaagaagcaggtggtggagagctttgtgccccgcatctgcagcctggtgattgacagccgggtgaacatctgcatccagcaggagatcatcaagaagatgaatgccatgctggacaagatgccccaggatgccaggaagatcctgagcaaccaggagatgctgatcctgatgagctccatgggagagcgcatcctggatgctggggactatgacctgcaggtgggcatcgtggaggccctgtgcaggatgaccacagagaagcagaggcaggagctggcccaccagtggttctccatggacttcatcgccaaggccttcaagaggatcaaggacagcgagtttgaaacagactgccgcatcttcctgaacctggtgaatggcatgctgggggacaagagaagagtcttcaccttcccctgcctgagcgccttcctggacaagtatgagctgcagatccccagtgatgagaagctggaggagttctggattgacttcaacctgggcagccagaccctgtccttctacatcgccggggacaatgatgaccaccagtgggaggccgtgacagtgcctgaggagaaggtgcagatctacagcattgaggtgcgggagagcaagaagctgctgaccatcatcctgaagaacacagtgaagatcagcaagcgggagggcaaggagctgctgctgtactttgatgccagcctggagatcaccaacgtgacccagaagatctttggagccaccaagcaccgggagagcatcaggaagcagggcatctctgtggccaagaccagcctgcacatcctgtttgatgccagcggcagccagatcctggtgcctgagagccagatcagccctgtgggggaggagctggtgtccctgaaggagaagagcaagagccccaaggagtttgccaagcccagcaagtacatcaagaacagcgacaagggcaacagaaacaacagccagctggagaagaccacccccagcaagaggaagatgtctgaggcctccatgattgtgtctggagctgaccgctacaccatgaggagccctgtgctcttcagcaacaccagcatcccccccaggagaagacgcatcaagccacccctgcagatgaccagcagcgctgagaagcccagcgtgtcccagaccagcgagaacagagtggacaatgctgccagcctgaagagccgcagcagcgagggccgccacagaagagacaacatcgacaagcacatcaagacagccaagtgtgtggagaacacagagaacaagaatgtggagttccccaaccagaacttcagcgagctgcaggatgtgatcccagacagccaggccgctgagaagagggaccacaccatcctgcccggggtgctggacaacatctgtggcaacaagatccacagcaagtgggcctgctggacccctgtgaccaacatcgagctgtgcaacaaccagagggccagcaccagcagcggggacaccctgaaccaggacatcgtcatcaacaagaagctgaccaagcagaagagcagcagcagcatcagtgaccacaacagcgagggcaccgggaaggtgaagtacaagaaggagcagacagaccacatcaagattgacaaggccgaggtggaggtgtgcaagaagcacaaccagcagcagaaccaccccaagtacagcggccagaagaacacagaaaatgccaagcagagcgactggcctgtggagagcgagaccaccttcaagtctgtgctgctgaacaagaccatcgaggagagcctcatctacaggaagaagtacatcctgagcaaggatgtgaacacagccacctgtgacaagaaccccagcgccagcaagaatgtgcagagccacaggaaggccgagaaggagctgaccagcgagctgaacagctgggacagcaagcagaagaagatgagggagaagagcaagggcaaggagttcaccaacgtggccgagagcctcatcagccagatcaacaagcgctacaagaccaaggatgacatcaagagcaccaggaagctgaaggagagcctcatcaacagcggcttcagcaacaagcctgtggtgcagctgagcaaggagaaggtgcagaagaagagctacaggaagctgaagaccacctttgtgaatgtgaccagcgagtgccctgtgaatgatgtgtacaacttcaacctgaatggagcagatgaccccatcatcaagctgggcatccaggagttccaggccacagccaaggaggcctgtgccgacaggagcatccggctggtgggccccagaaatcatgatgagctgaagagctctgtgaagaccaaggacaagaagatcatcaccaaccaccagaagaagaacctcttcagtgacacagaaacagagtaccgctgtgatgacagcaagacagacatctcctggctgcgggagcccaagagcaagccccagctgattgactacagcaggaacaagaatgtgaagaaccacaagagcggcaagagccgcagcagcctggagaagggccagcccagcagcaagatgacccccagcaagaacatcaccaagaagatggacaagaccatccctgagggccgcatccggctgcccaggaaggccaccaagaccaagaagaactacaaggacctgagcaacagcgagagtgaatgtgagcaggagttcagccacagcttcaaggagaacatccctgtgaaggaggagaacatccacagcaggatgaagacagtgaagctgcccaagaagcagcagaaggtgttctgtgccgagacagagaaggagctgagcaagcagtggaagaacagcagcctgctgaaggatgccatccgggacaactgcctggacctgagccccaggagcctgagcggcagccccagcagcattgaggtgacccgctgcatcgagaagatcacagagaaggacttcacccaggactatgactgcatcaccaagagcatcagcccctaccccaagaccagcagcctggagagcctgaacagcaacagcggcgtgggcggcaccatcaagagccccaagaacaatgagaagaacttcctgtgtgccagcgagagctgcagccccatcccccggcccctcttcctgcccaggcacacccccaccaagagcaacaccatcgtgaacaggaagaagatcagcagcctggtgctgacccaggagacccagaacagcaacagctacagtgatgtgagcagctacagcagcgaggagcgcttcatggagattgagagcccccacatcaatgaaaactacatccagagcaagcgggaggagagccacctggccagcagcctgagcaagagcagcgagggccgggagaagacctggtttgacatgccctgtgatgccacccacgtgtctggccccacccagcacctgagcaggaagaggatctacatcgaggacaacctgagcaacagcaatgaggtggagatggaggagaagggggagcggcgggccaacctgctgcccaagaagctgtgcaagattgaagatgctgaccaccacatccacaagatgtctgagagcgtgagcagcctgagcaccaatgacttcagcatcccctgggagacctggcagaatgaatttgctggcatcgagatgacctatgagacctatgagcggctgaacagcgagttcaagagaagaaacaacatccgccacaagatgctgagctacttcaccacccagagctggaagacagcccagcagcacctgcggaccatgaaccaccagagccaggacagccgcatcaagaagctggacaagttccagttcatcatcatcgaggagctggagaactttgagaaggacagccagagcctgaaggacctggagaaggagtttgtggacttctgggagaagatcttccagaagttcagcgcctaccagaagtctgagcagcagaggctgcacctgctgaagaccagcctggccaagtctgtgttctgcaacacagacagcgaggagaccgtcttcaccagcgagatgtgcctgatgaaggaggacatgaaggtgctgcaggaccggctgctgaaggacatgctggaggaggagctgctgaatgtgcggcgggagctgatgtctgtgttcatgagccatgaaagaaatgccaacgtgtag

SEQ ID NO: 172246 - DNA, 4593 bp, Artificial Sequence; identical to SEQ ID NO: 172245
  Description of Artificial Sequence: Synthetic coding sequence

SEQ ID NO: 172247 - DNA, 3072 bp, Artificial Sequence
  Description of Artificial Sequence: Synthetic coding sequence
atgcccatccggccagacctgcagcagctggagaagtgcattgatgatgccctgaggaagaatgacttcaagcccctgaagaccctgctgcagattgacatctgtgaagatgtgaagatcaagtgcagcaagcagttcttccacaaggtggacaacctgatctgccgggagctgaacaaggaggacatccacaacgtgtctgccatcctggtgtctgtgggccgctgtgggaagaacatctctgtgctgggccaggccggcctgctgaccatgatcaagcagggcctcatccagaagatggtggcctggtttgagaagagcaaggacatcatccagagccagggcaacagcaaggatgaagctgtgctgaacatgattgaggacctggtggacctgctgctggtgattcatgatgtgtctgatgagggcaagaagcaggtggtggagagctttgtgccccgcatctgcagcctggtgattgacagccgggtgaacatctgcatccagcaggagatcatcaagaagatgaatgccatgctggacaagatgccccaggatgccaggaagatcctgagcaaccaggagatgctgatcctgatgagctccatgggagagcgcatcctggatgctggggactatgacctgcaggtgggcatcgtggaggccctgtgcaggatgaccacagagaagcagaggcaggagctggcccaccagtggttctccatggacttcatcgccaaggccttcaagaggatcaaggacagcgagtttgaaacagactgccgcatcttcctgaacctggtgaatggcatgctgggggacaagagaagagtcttcaccttcccctgcctgagcgccttcctggacaagtatgagctgcagatccccagtgatgagaagctggaggagttctggattgacttcaacctgggcagccagaccctgtccttctacatcgccggggacaatgatgaccaccagtgggaggccgtgacagtgcctgaggagaaggtgcagatctacagcattgaggtgcgggagagcaagaagctgctgaccatcatcctgaagaacacagtgaagatcagcaagcgggagggcaaggagctgctgctgtactttgatgccagcctggagatcaccaacgtgacccagaagatctttggagccaccaagcaccgggagagcatcaggaagcagggcatctctgtggccaagaccagcctgcacatcctgtttgatgccagcggcagccagatcctggtgcctgagagccagatcagccctgtgggggaggagctggtgtccctgaaggagaagagcaagagccccaaggagtttgccaagcccagcaagtacatcaagaacagcgacaagggcaacagaaacaacagccagctggagaagaccacccccagcaagaggaagatgtctgaggcctccatgattgtgtctggagctgaccgctacaccatgaggagccctgtgctcttcagcaacaccagcatcccccccaggagaagacgcatcaagccacccctgcagatgaccagcagcgctgagaagcccagcgtgtcccagaccagcgagaacagagtggacaatgctgccagcctgaagagccgcagcagcgagggccgccacagaagagacaacatcgacaagcacatcaagacagccaagtgtgtggagaacacagagaacaagaatgtggagttccccaaccagaacttcagcgagctgcaggatgtgatcccagacagccaggccgctgagaagagggaccacaccatcctgcccggggtgctggacaacatctgtggcaacaagatccacagcaagtgggcctgctggacccctgtgaccaacatcgagctgtgcaacaaccagagggccagcaccagcagcggggacaccctgaaccaggacatcgtcatcaacaagaagctgaccaagcagaagagcagcagcagcatcagtgaccacaacagcgagggcaccgggaaggtgaagtacaagaaggagcagacagaccacatcaagattgacaaggccgaggtggaggtgtgcaagaagcacaaccagcagcagaaccaccccaagtacagcggccagaagaacacagaaaatgccaagcagagcgactggcctgtggagagcgagaccaccttcaagtctgtgctgctgaacaagaccatcgaggagagcctcatctacaggaagaagtacatcctgagcaaggatgtgaacacagccacctgtgacaagaaccccagcgccagcaagaatgtgcagagccacaggaaggccgagaaggagctgaccagcgagctgaacagctgggacagcaagcagaagaagatgagggagaagagcaagggcaaggagttcaccaacgtggccgagagcctcatcagccagatcaacaagcgctacaagaccaaggatgacatcaagagcaccaggaagctgaaggagagcctcatcaacagcggcttcagcaacaagcctgtggtgcagctgagcaaggagaaggtgcagaagaagagctacaggaagctgaagaccacctttgtgaatgtgaccagcgagtgccctgtgaatgatgtgtacaacttcaacctgaatggagcagatgaccccatcatcaagctgggcatccaggagttccaggccacagccaaggaggcctgtgccgacaggagcatccggctggtgggccccagaaatcatgatgagctgaagagctctgtgaagaccaaggacaagaagatcatcaccaaccaccagaagaagaacctcttcagtgacacagaaacagagtaccgctgtgatgacagcaagacagacatctcctggctgcgggagcccaagagcaagccccagctgattgactacagcaggaacaagaatgtgaagaaccacaagagcggcaagagccgcagcagcctggagaagggccagcccagcagcaagatgacccccagcaagaacatcaccaagaagatggacaagaccatccctgagggccgcatccggctgcccaggaaggccaccaagaccaagaagtag

SEQ ID NO: 172248 - DNA, 711 bp, Artificial Sequence
  Description of Artificial Sequence: Synthetic coding sequence
atggtgagcagcggcaagaagtacagcaggaagagcggcaagcccagcgtggaggaccagttcacccgggcctatgactttgaaacagaggacaagaaggacctgagcggcagcgaggaggatgtgattgagggcaagacagctgtgattgagaagaggaggaagaagaggagcagcgctggggtggtggaggacatgggcggggaggtgcagaacatgctggagggcgtgggcgtggacatcaacaaggccctgctggccaagaggaagaggctggagatgtacaccaaggccagcctgaagaccagcaaccagaagattgaacatgtgtggaagacccagcaggaccagaggcagaagctgaaccaggagtacagccagcagttcctgaccctcttccagcagtgggacctggacatgcagaaggccgaggagcaggaggagaagatcctgaacatgttccggcagcagcagaagatcctgcagcagagccgcatcgtgcagagccagaggctgaagaccatcaagcagctgtatgagcagttcatcaagtccatggaggagctggagaagaaccacgacaacctgctgaccggggcccagaatgagttcaagaaggagatggccatgctgcagaagaagatcatgatggagacccagcagcaggagatcgcctctgtgaggaagagcctgcagagcatgctgttctag

SEQ ID NO: 172249 - DNA, 711 bp, Artificial Sequence; identical to SEQ ID NO: 172248
  Description of Artificial Sequence: Synthetic coding sequence

SEQ ID NO: 172250 - DNA, 711 bp, Artificial Sequence; identical to SEQ ID NO: 172248
  Description of Artificial Sequence: Synthetic coding sequence

SEQ ID NO: 172251 - DNA, 942 bp, Artificial Sequence
  Description of Artificial Sequence: Synthetic coding sequence
atgctgctgctggccgacatggatgtggtgaaccagctggtggccggcggccagttccgggtggtgaaggagcccctgggctttgtgaaggtgctgcagtgggtgtttgccatctttgcctttgccacctgtggcagctacagcggggagctgcagctgtctgtggactgtgccaacaagacagaaagtgacctgagcattgaggtggagtttgagtaccccttccggctgcaccaggtgtactttgatgcccccacctgccggggcggcaccaccaaggtgttcctggtgggggactacagcagcagcgctgagttctttgtgacagtggccgtgtttgccttcctgtacagcatgggcgccctggccacctacatcttcctgcagaacaagtaccgggagaacaacaagggccccatgctggacttcctggccacagctgtgtttgccttcatgtggctggtgagcagcagcgcctgggccaagggcctgagtgatgtgaagatggccacagatcctgagaacatcatcaaggagatgcctgtgtgccggcagacaggcaacacctgcaaggagctgcgggaccctgtgaccagcggcctgaacacctctgtggtgtttggcttcctgaacctggtgctgtgggtgggcaacctgtggtttgtgttcaaggagaccggctgggccgcccccttcctgcgggcccctcctggggcccctgagaagcagcctgcccctggagatgcctatggagatgctggctacggccagggccctgggggctacggcccccaggacagctatggcccccagggcggctaccagcctgactatggccagcctgctggcagcggcggcagcggctacggcccccagggcgactatggccagcagggctacggcccccagggcgcccccaccagcttcagcaaccagatgtag

SEQ ID NO: 172252 - DNA, 942 bp, Artificial Sequence; identical to SEQ ID NO: 172251
  Description of Artificial Sequence: Synthetic coding sequence

SEQ ID NO: 172253 - DNA, 588 bp, Artificial Sequence
  Description of Artificial Sequence: Synthetic coding sequence
atgggcgccctggccacctacatcttcctgcagaacaagtaccgggagaacaacaagggccccatgctggacttcctggccacagctgtgtttgccttcatgtggctggtgagcagcagcgcctgggccaagggcctgagtgatgtgaagatggccacagatcctgagaacatcatcaaggagatgcctgtgtgccggcagacaggcaacacctgcaaggagctgcgggaccctgtgaccagcggcctgaacacctctgtggtgtttggcttcctgaacctggtgctgtgggtgggcaacctgtggtttgtgttcaaggagaccggctgggccgcccccttcctgcgggcccctcctggggcccctgagaagcagcctgcccctggagatgcctatggagatgctggctacggccagggccctgggggctacggcccccaggacagctatggcccccagggcggctaccagcctgactatggccagcctgctggcagcggcggcagcggctacggcccccagggcgactatggccagcagggctacggcccccagggcgcccccaccagcttcagcaaccagatgtag

SEQ ID NO: 172254 - DNA, 2712 bp, Artificial Sequence
  Description of Artificial Sequence: Synthetic coding sequence
atggagggctacagcgaggaggccagcctgctgcggcacctggagaaggtggccagcgaggaggaggaggtgcccctggtggtgtacctgaaggaaaatgctgccctgctgacagccaacggcctgcacctgagccagaaccgggaggcccagcagagcagccctgcccctcctcctgctgaggtgcacagccctgctgctgatgtgaaccagaacctggccagccccagcgccaccctgaccacccccaccagcaacagcagccacaaccccccagccacagatgtgaaccagaaccccccagccaccgtggtgccccagagcctgcccctgagcagcatccagcagaacagcagcgaggcccagctgcccagcaatggcaccggccctgccagcaagcccagcaccctgtgtgctgatggccagccccaggccccagctgaggaggtgcgctgcagcaccctgctgattgacaaggtgtccaccccagccaccaccaccagcaccttcagccgggaggccaccctcatccccagcagccggcccccagccagtgacttcatgagcagcagcctgctgattgacatccagcccaacaccctggtggtgtctgctgaccaggagatgagcggccgggccgccgccaccacccccaccaaggtgtacagcgaggtgcacttcaccctggccaagccacccagcgtggtgaacagaacagcccggcccttcggcatccaggcccctgggggcaccagccagatggagaggagccccatgctggagcggcggcactttggagagaaggccccagccccccagccccccagcctgcctgacaggagcccccggccccagaggcacatcatgagccgcagccccatggtggagaggaggatgatgggccagaggagccctgccagcgagcggcggcccctgggcaacttcaccgccccacccacctacacagagaccctgagcacagcccccctggcctcctgggtgcgcagccccccatcctacagcgtgctgtaccccagcagtgaccccaagagcagccacctgaagggccaggccgtgcctgccagcaagacaggcatcctggaggagagcatggcccggcggggcagcaggaagtccatgttcacctttgtggagaagcccaaggtgacccccaacccagacctgctggacctggtgcagacagcagatgagaagaggcggcagagggaccagggcgaggtgggcgtggaggaggagccctttgccctgggcgctgaggccagcaacttccagcaggagcccgccccccgggaccgggccagccctgctgctgctgaggaggtggtgcctgagtgggccagctgcctgaagagcccccgcatccaggccaagcccaagcccaagcccaaccagaacctgtctgaggccagcgggaaaggagctgagctgtatgcccggcggcagagcaggatggagaagtatgtgattgagagcagcagccacaccccagagctggcccgctgccccagccccaccatgagcctgcccagctcctggaagtaccccaccaatgcccctggggccttccgggtggccagccgcagccctgcccggaccccaccagccagcctgtaccacggctacctgcctgaaaatggagtgctgcggcctgagcccaccaagcagcccccctaccagctgcggcccagcctgtttgtgctgagccccatcaaggagcccgccaaggtgagccccagggctgccagccctgccaagcccagcagcctggacctggtgcccaacctgcccaagggggccctgccccccagccctgccctgccccggcccagccgcagcagccctggcctgtacaccagccctggccaggacagcctgcagcccacagctgtgtccccaccctatggaggagacatcagccctgtgagccccagccgggcctggagcccccgggccaagcaggccccccggcccagcttcagcaccagaaatgccggcatcgaggcccaggaccggcgggagagcctgcccaccagccccccctggacccctggggccagcaggcctcccagcagcctggatggctgggtgtccccaggcccctgggagcccggccggggcagctccatgagcagccccccacccctgcccccacctccacccatgagccccagctggagcgagaggtctgtgagccccctgcggcctgagacagaggcccggccccccagccggcagctgcaggccctgctggccaggaacatcatcaatgctgcccggaggaagagcgccagccccaggtctgctggagctgagaacccccggcccttcagccccccccgggcccctcctcctcctcctcctcctcctcctcctccacccaggatgaggagcccccagcctgcccggcccggcagcgctgctgtgcctggggccgcctttgcccccatccccaggagccccctgcctgctggccccagcagctgcaccagccccaggagccccctgcctgccccaccccggcccttcctgtaccgccgcagccccacagacagtgatgtgtccctggacagtgaagattctggggccaagagccctggcatcctgggctacaacatctgcccccggggctggaatggcagcctgcggctgaagaggggcagcctgcctgctgaggccagctgcaccacctag

SEQ ID NO: 172255 - DNA, 2790 bp, Artificial Sequence
  Description of Artificial Sequence: Synthetic coding sequence
atgctgggcccccacctgcccccaccacccctggcccccagcgagggccggcccaccccctgtgccttccagatcccagatggcagctaccgctgcctggccctggaggccgaggagagcagtggagaggagggcctgcagggcgaggtgggccccacagacctggaggaggatgagggcgtgagccgctctggagatgacagcgcctgccgggtgacccagggcaccccccagctgcccaaggccctgggcatccagccccccagctgcagccgggaggagcagggcgccagccagcatgatgaccgggccagccaggactgggatgtggtgaaggccggccagatgatgacagccagccccagccctggccctggcccccgggtggcccagaagccagccctgggccgcagcaccagcctgacagagaaggacctgaaggaggccaaggcccggagccagcagattgctgcccagctgaccaccccacccagcagcaacagccggggcgtgcagctgttcaacagaagacggcagagggtgaatgagttcaccctggagagccacggccagaggggccagaagcccagccaggagagcctgcgggtgctgcccagcagcctgcccggccacgcccctggcctgagcctgagcagcaccagcctgcctgagcccggccccccaagacaccccagcccccagagcccagacagaggagtgcccggccacagcatggagggctacagcgaggaggccagcctgctgcggcacctggagaaggtggccagcgaggaggaggaggtgcccctggtggtgtacctgaaggaaaatgctgccctgctgacagccaacggcctgcacctgagccagaaccgggaggcccagcagagcagccctgcccctcctcctgctgaggtgcacagccctgctgctgatgtgaaccagaacctggccagccccagcgccaccctgaccacccccaccagcaacagcagccacaaccccccagccacagatgtgaaccagaaccccccagccaccgtggtgccccagagcctgcccctgagcagcatccagcagaacagcagcgaggcccagctgcccagcaatggcaccggccctgccagcaagcccagcaccctgtgtgctgatggccagccccaggccccagctgaggaggtgcgctgcagcaccctgctgattgacaaggtgtccaccccagccaccaccaccagcaccttcagccgggaggccaccctcatccccagcagccggcccccagccagtgacttcatgagcagcagcctgctgattgacatccagcccaacaccctggtggtgtctgctgaccaggagatgagcggccgggccgccgccaccacccccaccaaggtgtacagcgaggtgcacttcaccctggccaagccacccagcgtggtgaacagaacagcccggcccttcggcatccaggcccctgggggcaccagccagatggagaggagccccatgctggagcggcggcactttggagagaaggccccagccccccagccccccagcctgcctgacaggagcccccggccccagaggcacatcatgagccgcagccccatggtggagaggaggatgatgggccagaggagccctgccagcgagcggcggcccctgggcaacttcaccgccccacccacctacacagagaccctgagcacagcccccctggcctcctgggtgcgcagccccccatcctacagcgtgctgtaccccagcagtgaccccaagagcagccacctgaagggccaggccgtgcctgccagcaagacaggcatcctggaggagagcatggcccggcggggcagcaggaagtccatgttcacctttgtggagaagcccaaggtgacccccaacccagacctgctggacctggtgcagacagcagatgagaagaggcggcagagggaccagggcgaggtgggcgtggaggaggagccctttgccctgggcgctgaggccagcaacttccagcaggagcccgccccccgggaccgggccagccctgctgctgctgaggaggtggtgcctgagtgggccagctgcctgaagagcccccgcatccaggccaagcccaagcccaagcccaaccagaacctgtctgaggccagcgggaaaggagctgagctgtatgcccggcggcagagcaggatggagaagtatgtgattgagagcagcagccacaccccagagctggcccgctgccccagccccaccatgagcctgcccagctcctggaagtaccccaccaatgcccctggggccttccgggtggccagccgcagccctgcccggaccccaccagccagcctgtaccacggctacctgcctgaaaatggagtgctgcggcctgagcccaccaagcagcccccctaccagctgcggcccagcctgtttgtgctgagccccatcaaggagcccgccaaggtgagccccagggctgccagccctgccaagcccagcagcctggacctggtgcccaacctgcccaagggggccctgccccccagccctgccctgccccggcccagccgcagcagccctggcctgtacaccagccctggccaggacagcctgcagcccacagctgtgtccccaccctatggaggagacatcagccctgtgagccccagccgggcctggagcccccgggccaagcaggccccccggcccagcttcagcaccagaaatgccggcatcgaggcccaggtgtggaagcccagcttctgcttcaagtag

SEQ ID NO: 172256 - DNA, 2058 bp, Artificial Sequence
  Description of Artificial Sequence: Synthetic coding sequence
atggagggctacagcgaggaggccagcctgctgcggcacctggagaaggtggccagcgaggaggaggaggtgcccctggtggtgtacctgaaggaaaatgctgccctgctgacagccaacggcctgcacctgagccagaaccgggaggcccagcagagcagccctgcccctcctcctgctgaggtgcacagccctgctgctgatgtgaaccagaacctggccagccccagcgccaccctgaccacccccaccagcaacagcagccacaaccccccagccacagatgtgaaccagaaccccccagccaccgtggtgccccagagcctgcccctgagcagcatccagcagaacagcagcgaggcccagctgcccagcaatggcaccggccctgccagcaagcccagcaccctgtgtgctgatggccagccccaggccccagctgaggaggtgcgctgcagcaccctgctgattgacaaggtgtccaccccagccaccaccaccagcaccttcagccgggaggccaccctcatccccagcagccggcccccagccagtgacttcatgagcagcagcctgctgattgacatccagcccaacaccctggtggtgtctgctgaccaggagatgagcggccgggccgccgccaccacccccaccaaggtgtacagcgaggtgcacttcaccctggccaagccacccagcgtggtgaacagaacagcccggcccttcggcatccaggcccctgggggcaccagccagatggagaggagccccatgctggagcggcggcactttggagagaaggccccagccccccagccccccagcctgcctgacaggagcccccggccccagaggcacatcatgagccgcagccccatggtggagaggaggatgatgggccagaggagccctgccagcgagcggcggcccctgggcaacttcaccgccccacccacctacacagagaccctgagcacagcccccctggcctcctgggtgcgcagccccccatcctacagcgtgctgtaccccagcagtgaccccaagagcagccacctgaagggccaggccgtgcctgccagcaagacaggcatcctggaggagagcatggcccggcggggcagcaggaagtccatgttcacctttgtggagaagcccaaggtgacccccaacccagacctgctggacctggtgcagacagcagatgagaagaggcggcagagggaccagggcgaggtgggcgtggaggaggagccctttgccctgggcgctgaggccagcaacttccagcaggagcccgccccccgggaccgggccagccctgctgctgctgaggaggtggtgcctgagtgggccagctgcctgaagagcccccgcatccaggccaagcccaagcccaagcccaaccagaacctgtctgaggccagcgggaaaggagctgagctgtatgcccggcggcagagcaggatggagaagtatgtgattgagagcagcagccacaccccagagctggcccgctgccccagccccaccatgagcctgcccagctcctggaagtaccccaccaatgcccctggggccttccgggtggccagccgcagccctgcccggaccccaccagccagcctgtaccacggctacctgcctgaaaatggagtgctgcggcctgagcccaccaagcagcccccctaccagctgcggcccagcctgtttgtgctgagccccatcaaggagcccgccaaggtgagccccagggctgccagccctgccaagcccagcagcctggacctggtgcccaacctgcccaagggggccctgccccccagccctgccctgccccggcccagccgcagcagccctggcctgtacaccagccctggccaggacagcctgcagcccacagctgtgtccccaccctatggaggagacatcagccctgtgagccccagccgggcctggagcccccgggccaagcaggccccccggcccagcttcagcaccagaaatgccggcatcgaggcccaggtgtggaagcccagcttctgcttcaagtag

SEQ ID NO: 172257 - DNA, 2790 bp, Artificial Sequence; identical to SEQ ID NO: 172255
  Description of Artificial Sequence: Synthetic coding sequence

SEQ ID NO: 172258 - DNA, 636 bp, Artificial Sequence
  Description of Artificial Sequence: Synthetic coding sequence
atggacaacctgagcagcgaggagatccagcagagggcccaccagatcacagatgagagcctggagagcacccggcgcatcctgggcctggccatcgagagccaggatgctggcatcaagaccatcaccatgctggatgagcagaaggagcagctgaacagaattgaggagggcctggaccagatcaacaaggacatgagggagacagagaagaccctgacagagctgaacaagtgctgcggcctgtgtgtgtgcccctgcaacagaaccaagaactttgaaagtggcaaggcctacaagaccacctggggagatggaggagagaacagcccctgcaatgtggtgtccaagcagcccggccctgtgaccaacggccagctgcagcagcccaccaccggggccgccagcggcggctacatcaagaggatcaccaatgatgccagagaagatgagatggaggagaacctgacccaggtgggcagcatcctgggcaacctgaaggacatggccctgaacattggaaatgaaattgatgcccagaacccccagatcaagaggatcacagacaaggctgacaccaacagagacagaattgacatcgccaatgcccgggccaagaagctgattgacagctag

SEQ ID NO: 172259 - DNA, 477 bp, Artificial Sequence
  Description of Artificial Sequence: Synthetic coding sequence
atggacaacctgagcagcgaggagatccagcagagggcccaccagatcacagatgagagcctggagagcacccggcgcatcctgggcctggccatcgagagccaggatgctggcatcaagaccatcaccatgctggatgagcagaaggagcagctgaacagaattgaggagggcctggaccagatcaacaaggacatgagggagacagagaagaccctgacagagctgaacaagtgctgcggcctgtgtgtgtgcccctgcaacagcatcaccaatgatgcccgggaggatgagatggaggagaacctgacccaggtgggcagcatcctgggcaacctgaaggacatggccctgaacattggaaatgaaattgatgcccagaacccccagatcaagaggatcacagacaaggctgacaccaacagagacagaattgatattgccaatgcccgggccaagaagctgattgacagctag

SEQ ID NO: 172260 - DNA, 477 bp, Artificial Sequence; identical to SEQ ID NO: 172259
  Description of Artificial Sequence: Synthetic coding sequence

SEQ ID NO: 172261 - DNA, 621 bp, Artificial Sequence
  Description of Artificial Sequence: Synthetic coding sequence
atggctgaagatgctgacatgagaaatgagctggaggagatgcagaggagagctgaccagctggctgatgagagcctggagagcaccaggaggatgctgcagctggtggaggagagcaaggatgctggcatccgcaccctggtgatgctggatgagcagggcgagcagctggagcgcatcgaggagggcatggaccagatcaacaaggacatgaaggaggccgagaagaacctgacagacctgggcaagttctgtggcctgtgtgtgtgcccctgcaacaagctgaagagcagtgatgcctacaagaaggcctggggcaacaaccaggatggagtggtggccagccagcctgcccgggtggtggatgagcgggagcagatggccatcagcggcggcttcatcagaagagtgaccaatgatgccagagaaaatgagatggatgagaacctggagcaggtgtctggcatcatcggcaacctgcggcacatggccctggacatgggaaatgaaattgacacccagaaccggcagattgaccgcatcatggagaaggctgacagcaacaagaccagaattgatgaggccaaccagagggccaccaagatgctgggcagcggctag

SEQ ID NO: 172262 - DNA, 621 bp, Artificial Sequence
  Description of Artificial Sequence: Synthetic coding sequence
atggctgaagatgctgacatgagaaatgagctggaggagatgcagaggagagctgaccagctggctgatgagagcctggagagcaccaggaggatgctgcagctggtggaggagagcaaggatgctggcatccgcaccctggtgatgctggatgagcagggcgagcagctggacagagtggaggagggcatgaaccacatcaaccaggacatgaaggaggccgagaagaacctgaaggacctgggcaagtgctgcggcctcttcatctgcccctgcaacaagctgaagagcagtgatgcctacaagaaggcctggggcaacaaccaggatggagtggtggccagccagcctgcccgggtggtggatgagcgggagcagatggccatcagcggcggcttcatcagaagagtgaccaatgatgccagagaaaatgagatggatgagaacctggagcaggtgtctggcatcatcggcaacctgcggcacatggccctggacatgggaaatgaaattgacacccagaaccggcagattgaccgcatcatggagaaggctgacagcaacaagaccagaattgatgaggccaaccagagggccaccaagatgctgggcagcggctag

SEQ ID NO: 172263 - DNA, 282 bp, Artificial Sequence
  Description of Artificial Sequence: Synthetic coding sequence
atggctgaagatgctgacatgagaaatgagctggaggagatgcagaggagagctgaccagctggctgatgagagcctggagagcaccaggaggatgctgcagctggtggaggagagcaaggatgctggcatccgcaccctggtgatgctggatgagcagggcgagcagctggagcgcatcgaggagggcatggaccagatcaacaaggacatgaaggaggccgagaagaacctgacagacctgggcaagttctgtggcctgtgtgtgtgcccctgcaactag

SEQ ID NO: 172264 - DNA, 1500 bp, Artificial Sequence; identical to SEQ ID NO: 169414
  Description of Artificial Sequence: Synthetic coding sequence

SEQ ID NO: 172265 - DNA, 1269 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccctgggccctgattgccatcgccatcgtggccgtgctgctggtgctgacctgctgcttctgcatctgcaagaagtgcctcttcaagaagaagaacaagaagaagggcaaggagaagggcggcaagaatgccatcaacatgaaggatgtgaaggacctgggcaagaccatgaaggaccaggccctgaaggatgatgatgctgagaccggcctgacagatggagaggagaaggaggagcccaaggaggaggagaagctgggcaagctgcagtacagcctggactatgacttccagaacaaccagctgctggtgggcatcatccaggccgctgagctgcctgccctggacatgggcggcaccagtgacccctacgtgaaggtgttcctgctgcctgacaagaagaagaagtttgagaccaaggtgcacaggaagaccctgaaccctgtgttcaatgagcagttcaccttcaaggtgccctacagcgagctgggcggcaagaccctggtgatggctgtgtatgactttgaccgcttcagcaagcatgacatcattggagagttcaaggtgcccatgaacacagtggactttggacatgtgacagaggagtggagggacctgcagagcgctgagaaggaggagcaggagaagctgggggacatctgcttcagcctgcgctacgtgcccacagctgggaagctgactgtggtgatcctggaggccaagaacctgaagaagatggatgtgggcggcctgagtgacccctacgtgaagatccacctgatgcagaatggcaagaggctgaagaagaagaagaccaccatcaagaagaacaccctgaacccctactacaatgaaagcttctcctttgaggtgccctttgagcagatccagaaggtgcaggtggtggtgacagtgctggactatgacaagattggcaagaatgatgccatcggcaaggtgtttgtgggctacaacagcactggagctgagctgcggcactggagcgacatgctggccaacccccggcggcccatcgcccagtggcacaccctgcaggtggaggaggaggtggatgccatgctggccgtgaagaagtag

SEQ ID NO: 172266 - DNA, 1269 bp, Artificial Sequence; identical to SEQ ID NO: 172265
  Description of Artificial Sequence: Synthetic coding sequence

SEQ ID NO: 172267 - DNA, 549 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccctgggccctgattgccatcgccatcgtggccgtgctgctggtgctgacctgctgcttctgcatctgcaagaagtgcctcttcaagaagaagaacaagaagaagggcaaggagaagggcggcaagaatgccatcaacatgaaggatgtgaaggacctgggcaagaccatgaaggaccaggccctgaaggatgatgatgctgagaccggcctgacagatggagaggagaaggaggagcccaaggaggaggagaagctgggcaagctgcagtacagcctggactatgacttccagaacaaccagctgctggtgggcatcatccaggccgctgagctgcctgccctggacatgggcggcaccagtgacccctacgtgtag

SEQ ID NO: 172268 - DNA, 177 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccatag

SEQ ID NO: 172269 - DNA, 219 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccctgggccctgattgccatcgccatcgtggccgtgctgctggtgtag

SEQ ID NO: 172270 - DNA, 222 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccctgggccctgattgccatcgccatcgtggccgtgctgctggtgctgtag

SEQ ID NO: 172271 - DNA, 285 bp, Artificial Sequence
  Description of Artificial Sequence: Synthetic coding sequence
atggtgtctgagagccaccacgaggccctggccgcccctcctgtgaccaccgtggccaccgtgctgcccagcaatgccacagagcccgccagccctggagagggcaaggaggatgccttcagcaagctgaaggagaagttcatgaatgagctgcacaagatccccctgcccccctgggccctgattgccatcgccatcgtggccgtgctgctggtgctgacctgctgcttctgcatctgcaagaagtgcctcttcaagaagaagaacaagaagaagggcaagtag

SEQ ID NO: 172272 - DNA, 1269 bp, Artificial Sequence; identical to SEQ ID NO: 172265
  Description of Artificial Sequence: Synthetic coding sequence

SEQ ID NO: 172273 - DNA, 1773 bp, Artificial Sequence
  Description of Artificial Sequence: Synthetic coding sequence
atgtctggggactatgaagatgacctgtgcagaagagccctgatcctggtgtctgacctgtgtgcccgggtgagagatgctgacaccaatgaccgctgccaggagttcaatgaccgcatccggggctacccccggggcccagatgctgacatctctgtgtccctgctgtctgtgattgtgaccttctgtggcatcgtgctgctgggcgtgtccctgtttgtgtcctggaagctgtgctgggtgccctggagggacaagggcggcagcgctgtgggcggcggccccctgaggaaggacctgggccctggggtgggcctggccggcctggtgggcggcggcggccaccacctggccgccggcctgggcggccaccccctgctgggcggcccccaccaccacgcccacgccgcccaccaccccccatttgctgagctgctggagcccggcagcctgggcggcagtgacaccccagagcccagctacctggacatggacagctacccagaggccgctgctgctgctgtggccgccggcgtgaagcccagccagaccagccctgagctgcccagcgagggcggggccggcagcggcctgctgctgctgccccccagcggcggcggcctgcccagcgcccagagccaccagcaggtgaccagcctggcccccaccacccgctacccagccctgccccggcccctgacccagcagaccctgaccagccagcctgaccccagcagcgaggagcggcccccagccctgcccctgcccctgcccggcggggaggagaaggccaagctgattggccagatcaagccagagctgtaccagggcaccggccctgggggcagaagaagtggcggcggccctggcagcggggaggccggcaccggggccccctgtggccgcatcagctttgccctgcgctacctgtatggcagtgaccagctggtggtgcgcatcctgcaggccctggacctgcctgccaaggacagcaatggcttcagtgacccctacgtgaagatctacctgctgcctgacaggaagaagaagttccagaccaaggtgcacaggaagaccctgaaccctgtgttcaatgagaccttccagttctctgtgcccctggccgagctggcccagaggaagctgcacttctctgtgtatgactttgaccgcttcagcagacatgacctgattggccaggtggtgctggacaacctgctggagctggccgagcagcccccagaccggcccctgtggagggacatcgtggagggcggcagcgagaaggctgacctgggggagctgaacttcagcctgtgctacctgcccacagctggccgcctgactgtgaccatcatcaaggccagcaacctgaaggccatggacctgaccggcttcagtgacccctacgtgaaggccagcctcatcagcgagggccggcggctgaagaagaggaagaccagcatcaagaagaacaccctgaaccccacctacaatgaggccctggtgtttgatgtggcccctgagagcgtggagaatgtgggcctgagcattgctgtggtggactatgactgcatcggccacaatgaagtcatcggcgtgtgccgggtgggcccagatgctgctgacccccacggccgggagcactgggccgagatgctggccaaccccaggaagcctgtggagcactggcaccagctggtggaggagaagacagtgaccagcttcaccaagggcagcaagggcctgtctgagaaggaaaattctgagtag

SEQ ID NO: 172274 - DNA, 1773 bp, Artificial Sequence; identical to SEQ ID NO: 172273
  Description of Artificial Sequence: Synthetic coding sequence

SEQ ID NO: 172275 - DNA, 1773 bp, Artificial Sequence; identical to SEQ ID NO: 172273
  Description of Artificial Sequence: Synthetic coding sequence

SEQ ID NO: 172276 - DNA, 1773 bp, Artificial Sequence; identical to SEQ ID NO: 172273
  Description of Artificial Sequence: Synthetic coding sequence

SEQ ID NO: 172277 - DNA, 1278 bp, Artificial Sequence
  Description of Artificial Sequence: Synthetic coding sequence
atggcccccatcaccaccagccgggaggagtttgatgagatccccaccgtggtgggcatcttcagcgccttcggcctggtgttcaccgtgtccctgtttgcctggatctgctgccagaggaagagcagcaagagcaacaagaccccaccctacaagtttgtgcacgtgctgaagggcgtggacatctacccagagaacctgaacagcaagaagaagtttggagcagatgacaagaatgaggtgaagaacaagccagctgtgcccaagaacagcctgcacctggacctggagaagagggacctgaatggaaacttccccaagaccaacctgaagccaggcagccccagcgacctggagaatgccacccccaagctgttcctggagggggagaaggagagcgtgtccccagagagcctgaagagcagcaccagcctgaccagcgaggagaagcaggagaagctgggcaccctcttcttcagcctggagtacaactttgagaggaaggcctttgtggtgaacatcaaggaggcccggggcctgcctgccatggatgagcagagcatgaccagtgacccctacatcaagatgaccatcctgcctgagaagaagcacaaggtgaagaccagggtgctgaggaagaccctggaccctgcctttgatgagaccttcaccttctacggcatcccctacacccagatccaggagctggccctgcacttcaccatcctgagctttgaccgcttcagcagagatgacatcatcggggaggtgctgatccccctgagcggcatcgagctgtctgagggcaagatgctgatgaaccgggagatcatcaagagaaatgtgaggaagagcagcggccgcggggagctgctgatcagcctgtgctaccagagcaccaccaacaccctgactgtggtggtgctgaaggcccggcacctgcccaagagtgatgtgtctggcctgagtgacccctacgtgaaggtgaacctgtaccacgccaagaagaggatcagcaagaagaagacccacgtgaagaagtgcaccccaaatgctgtgttcaatgagctgtttgtgtttgacatcccctgtgagggcctggaggacatctctgtggagttcctggtgctggacagcgagcggggcagcagaaatgaagtcatcggccagctggtgctgggcgctgctgctgagggcaccggcggggagcactggaaggagatctgtgactacccccggcggcagatcgccaagtggcacgtgctgtgtgatggatag

SEQ ID NO: 172278 - DNA, 693 bp, Artificial Sequence
  Description of Artificial Sequence: Synthetic coding sequence
atggacctgctgtctgagaagaagcacaaggtgaagaccagggtgctgaggaagaccctggaccctgcctttgatgagaccttcaccttctacggcatcccctacacccagatccaggagctggccctgcacttcaccatcctgagctttgaccgcttcagcagagatgacatcattggagaggtgctgatccccctgtctggaattgagctgtctgagggcaagatgctgatgaaccgggagatcatcaagagaaatgtgaggaagagcagcggccgcggggagctgctgatcagcctgtgctaccagagcaccaccaacaccctgactgtggtggtgctgaaggcccggcacctgcccaagagtgatgtgtctggcctgagtgacccctacgtgaaggtgaacctgtaccacgccaagaagaggatcagcaagaagaagacccacgtgaagaagtgcaccccaaatgctgtgttcaatgagctgtttgtgtttgacatcccctgtgagggcctggaggacatctctgtggagttcctggtgctggacagcgagcggggcagcagaaatgaggtgattggccagctggtgctgggcgctgctgctgagggcactggaggagagcactggaaggagatctgtgactacccccggcggcagatcgccaagtggcacgtgctgtgtgatggatag

SEQ ID NO: 172279 - DNA, 1476 bp, Artificial Sequence
  Description of Artificial Sequence: Synthetic coding sequence
atgcctggggccagagatgccctgtgccaccaggccctgcagctgctggccgagctgtgtgcccggggggccctggagcatgacagctgccaggacttcatctaccacctgcgggaccgggcccggccccggctgcgggaccctgacatctctgtgtccctgctgaccctggtggtgacagcctgtggcctggccctgtttggagtgtccctgtttgtgtcctggaagctgtgctgggtgccctggagggagcggggcctgcccagcggcagcaaggacaacaaccaggagcccctgaactacatggacacagagaccaatgagcaggagaacagcgaggacttcctggacccccccaccccctgcccagacagctccatgaagatcagccacaccagcccagacatccccctgagcacccagacaggcatccaggagaactgtgcccacggcgtgcgggtgcagaggcaggtgacagagcccaccagcagcgcccggcacaacagcatccggcggcagctgaacctgagcaacccagacttcaacatccagcagctgcagaagcaggagcagctgactggaattggccgcatcaagccagagctgtacaagcagaggagcctggacaatgatgatggccgccgcagcaacagcaaggcctgtgggaagctgaacttcatcctgaagtatgactgtgacctggagcagctgattgtgaagatccacaaggctgtgaacctgcctgccaaggacttcagcggcaccagtgacccctacgtgaagatctacctgctgcctgacaggaagaccaagcaccagaccaaggtgcacaggaagaccctgaaccctgtgtttgatgaggtgttcctgtttcctgtgccctacaatgacctggaggccaggaagctgcacttctctgtgtatgactttgaccgcttcagcagacatgacctgattggccaggtggtggtggaccacttcctggacctggccgacttcccccgggagtgcatcctgtggaaggacattgaatatgtgaccaatgacaacgtggacctgggggagctgatgttcagcctgtgctacctgcccacagctggccgcctgaccatcaccatcatcaaggccaggaacctgaaggccatggacatcactggagccagtgacccctacgtgaaggtgtccctgatgtgtgatggaagaaggctgaagaagaggaagaccagcaccaagaggaacaccctgaaccctgtgtacaatgaggccatcgtgtttgatgtgcccccagagaacatcgaccagatccacctgagcattgctgtgatggactatgacagagtgggccacaatgagatcattggagtgtgccaggtgggcaatgaggccgagcggctgggccgggaccactggagcgagatgctgagctaccccaggaagcccatcgcccactggcacagcctggtggagaagaggtag

SEQ ID NO: 172280 - DNA, 960 bp, Artificial Sequence
  Description of Artificial Sequence: Synthetic coding sequence
atgctggccaaggtggtggagggggacctggccttcaagggcggccgggacatctctgtgtccctgctgaccctggtggtgacagcctgtggcctggccctgtttggagtgtccctgtttgtgtcctggaagctgtgctgggtgccctggagggagcggggcctgcccagcggcagcaaggacaacaaccaggagcccctgaactacatggacacagagaccaatgagcaggagaacagcgaggacttcctggacccccccaccccctgcccagacagctccatgaagatcagccacaccagcccagacatccccctgagcacccagacaggcatccaggagaactgtgcccacggcgtgcgggtgcagaggcaggtgacagagcccaccagcagcgcccggcacaacagcatccggcggcagctgaacctgagcaacccagacttcaacatccagcagctgcagaagcaggagcagctgactggaattggccgcatcaagccagagctgtacaagcagaggagcctggacaatgatgatggccgccgcagcaacagcaaggcctgtgggaagctgaacttcatcctgaagtatgactgtgacctggagcagctgattgtgaagatccacaaggctgtgaacctgcctgccaaggacttcagcggcaccagtgacccctacgtgaagatctacctgctgcctgacaggaagaccaagcaccagaccaaggtgcacaggaagaccctgaaccctgtgtttgatgaggtgttcctgtttcctgtgccctacaatgacctggaggccaggaagctgcacttctctgtgtatgactttgaccgcttcagcagacatgacctgattggccaggtggtggtggaccacttcctggacctggccgacttcccccgggagtgcatcctgtggaaggacattgaatatgtgaccaacatcctgtcctag

SEQ ID NO: 172281 - DNA, 1161 bp, Artificial Sequence
  Description of Artificial Sequence: Synthetic coding sequence
atgtttcctgagccccccaccccaggcccccccagcccagacaccccaccagacagcagccgcatcagccacggccctgtgcccccctgggccctggccaccatcgtgctggtgtctggcctgctgatcttcagctgctgcttctgcctgtacaggaagagctgcagaagaagaacaggcaagaagagccaggcccaggcccaggtgcacctgcaggaggtgaagggcctgggccagagctacatcgacaaggtgcagcctgaggtggaggagctggagcccgcccccagcggccctggccagcaggtggccgacaagcatgagctgggccgcctgcagtacagcctggactatgacttccagagcggccagctgctggtgggcatcctgcaggccatgggcctggccgccctggacctgggcggcagcagtgacccctacgtgcgggtgtacctgctgcctgacaagagaagaagatatgagaccaaggtgcaccggcagaccctgaacccccactttggagagacctttgccttcaaggtgccctacgtggagctgggcggccgggtgctggtgatggctgtgtatgactttgaccgcttcagcagaaatgatgccatcggggaggtgcgggtgcccatgagctctgtggacctgggccggcctgtgcaggcctggagggagctgcaggccgccccccgggaggagcaggagaagctgggggacatctgcttcagcctgcgctacgtgcccacagctgggaagctgactgtgattgtgctggaggccaagaacctgaagaagatggatgtgggcggcctgagtgacccctacgtgaaggtgcacctgctgcagggcggcaagaaggtgaggaagaagaagaccaccatcaagaagaacaccctgaacccctactacaatgaggccttctcctttgaggtgccctgtgaccaggtgcagaaggtgcaggtggagctgactgtgctggactatgacaagctgggcaagaatgaggccatcggccgggtggccgtgggcgctgctgctggaggagctggcctgcggcactgggccgacatgctggccaacccccggcggcccatcgcccagtggcacagcctgcggcccccagacagagtgcggctgctgcctgccccctag

SEQ ID NO: 172282 - DNA, 1161 bp, Artificial Sequence; identical to SEQ ID NO: 172281
  Description of Artificial Sequence: Synthetic coding sequence

SEQ ID NO: 172283 - DNA, 1149 bp, Artificial Sequence
  Description of Artificial Sequence: Synthetic coding sequence
atgacccggggcggctgccctgtgtctgcccggctgtttgcccagaggccccacggctcctggagcagcctgctgtgtgtgggcctgaagggccgcctgggctgggagtggggcaccagggtgctggagtgcctgtgcaggaaggacagcaggaccccaccaccctgcagccgcagcccccagccccggggcctgcaccggcccacccggctgcccacccctgtggccagcgccacagcccaggtgcagcctgaggtggaggagctggagcccgcccccagcggccctggccagcaggtggccgacaagcatgagctgggccgcctgcagtacagcctggactatgacttccagagcggccagctgctggtgggcatcctgcaggccatgggcctggccgccctggacctgggcggcagcagtgacccctacgtgcgggtgtacctgctgcctgacaagagaagaagatatgagaccaaggtgcaccggcagaccctgaacccccactttggagagacctttgccttcaaggtgccctacgtggagctgggcggccgggtgctggtgatggctgtgtatgactttgaccgcttcagcagaaatgatgccatcggggaggtgcgggtgcccatgagctctgtggacctgggccggcctgtgcaggcctggagggagctgcaggccgccccccgggaggaggagaagctgggggacatctgcttcagcctgcgctacgtgcccacagctgggaagctgactgtgattgtgctggaggccaagaacctgaagaagatggatgtgggcggcctgagtgacccctacgtgaaggtgcacctgctgcagggcggcaagaaggtgaggaagaagaagaccaccatcaagaagaacaccctgaacccctactacaatgaggccttctcctttgaggtgccctgtgaccaggtgcagaaggtgcaggtggagctgactgtgctggactatgacaagctgggcaagaatgaggccatcggccgggtggccgtgggcgctgctgctggaggagctggcctgcggcactgggccgacatgctggccaacccccggcggcccatcgcccagtggcacagcctgcggcccccagacagagtgcggctgctgcctgccccctag

SEQ ID NO: 172284 - DNA, 1533 bp, Artificial Sequence
  Description of Artificial Sequence: Synthetic coding sequence
atgtctggagtgtggggcgccggcggcccccgctgccaggaggccctggccgtgctggccagcctgtgccgggcccggcccccacccctgggcctggatgtggagacctgccgcagctttgagctgcagcccccagagaggagccccagcgctgctggggccggcacctctgtgtccctgctggccgtggtggtgattgtgtgtggggtggccctggtggccgtgttcctgttcctgttctggaagctgtgctggatgccctggaggaacaaggaggccagcagccccagcagcgccaacccccccctggaggccctgcagagccccagcttccggggcaacatggctgacaagctgaaggaccccagcaccctgggcttcctggaggccgctgtgaagatcagccacaccagcccagacatcccagctgaggtgcagatgtctgtgaaggagcacatcatgaggcacacccggctgcagaggcagaccacagagcccgccagcagcaccaggcacaccagcttcaagaggcacctgccccggcagatgcacgtgtcctctgtggactatggaaatgagctgcccccagctgctgagcagcccaccagcatcggccgcatcaagccagagctgtacaagcagaagtctgtggatggagaagatgccaagtctgaggccaccaagagctgtgggaagatcaacttcagcctgcgctatgactatgaaacagagaccctgattgtgcgcatcctgaaggcctttgacctgcctgccaaggacttctgtggcagcagtgacccctacgtgaagatctacctgctgcctgacaggaagtgcaagctgcagaccagggtgcacaggaagaccctgaaccccacctttgatgagaacttccacttccctgtgccctatgaggagctggccgacaggaagctgcacctgtctgtgtttgattttgaccgcttcagcagacatgacatgattggagaggtgatcctggacaacctgtttgaggccagtgacctgagccgggagaccagcatctggaaggacatccagtatgccaccagcgagagcgtggacctgggggagatcatgttcagcctgtgctacctgcccacagctggccgcctgaccctgaccgtcatcaagtgcaggaacctgaaggccatggacatcaccggctacagcgacccctacgtgaaggtgtccctgctgtgtgatggccggcggctgaagaagaagaagaccaccatcaagaagaacaccctgaaccctgtgtacaatgaggccatcatctttgacatccccccagagaacatggaccaggtgtccctgctgatctctgtgatggactatgacagagtgggccacaatgagatcatcggcgtgtgccgggtgggcatcacagctgagggcctgggccgggaccactggaatgagatgctggcctaccccaggaagcccatcgcccactggcacagcctggtggaggtgaagaagagcttcaaggagggcaacccccggctgtag

SEQ ID NO: 172285 - DNA, 1278 bp, Artificial Sequence
  Description of Artificial Sequence: Synthetic coding sequence
atgccctggaggaacaaggaggccagcagccccagcagcgccaacccccccctggaggccctgcagagccccagcttccggggcaacatggctgacaagctgaaggaccccagcaccctgggcttcctggaggccgctgtgaagatcagccacaccagcccagacatcccagctgaggtgcagatgtctgtgaaggagcacatcatgaggcacacccggctgcagaggcagaccacagagcccgccagcagcaccaggcacaccagcttcaagaggcacctgccccggcagatgcacgtgtcctctgtggactatggaaatgagctgcccccagctgctgagcagcccaccagcatcggccgcatcaagccagagctgtacaagcagaagtctgtggatggagaagatgccaagtctgaggccaccaagagctgtgggaagatcaacttcagcctgcgctatgactatgaaacagagaccctcatcgtgcgcatcctgaaggcctttgacctgcctgccaaggacttctgtggcagcagtgacccctacgtgaagatctacctgctgcctgacaggaagtgcaagctgcagaccagggtgcacaggaagaccctgaaccccacctttgatgagaacttccacttccctgtgccctatgaggagctggccgacaggaagctgcacctgtctgtgtttgattttgaccgcttcagcagacatgacatgattggagaggtgatcctggacaacctgtttgaggccagtgacctgagccgggagaccagcatctggaaggacatccagtatgccaccagcgagagcgtggacctgggggagatcatgttcagcctgtgctacctgcccacagctggccgcctgaccctgaccgtcatcaagtgcaggaacctgaaggccatggacatcaccggctacagcgacccctacgtgaaggtgtccctgctgtgtgatggaagaaggctgaagaagaagaagaccaccatcaagaagaacaccctgaaccctgtgtacaatgaggccatcatctttgacatccccccagagaacatggaccaggtgtccctgctgatctctgtgatggactatgacagagtgggccacaatgagatcattggagtgtgccgggtgggcatcacagctgagggcctgggccgggaccactggaatgagatgctggcctaccccaggaagcccatcgcccactggcacagcctggtggaggtgaagaagagcttcaaggagggcaacccccggctgtag

SEQ ID NO: 172286 - DNA, 1278 bp, Artificial Sequence; identical to SEQ ID NO: 172285
  Description of Artificial Sequence: Synthetic coding sequence

SEQ ID NO: 172287 - DNA, 1533 bp, Artificial Sequence; identical to SEQ ID NO: 172284
  Description of Artificial Sequence: Synthetic coding sequence

SEQ ID NO: 172288 - DNA, 288 bp, Artificial Sequence
  Description of Artificial Sequence: Synthetic coding sequence
atgccctggaggaacaaggaggccagcagccccagcagcgccaacccccccctggaggccctgcagagccccagcttccggggcaacatggctgacaagctgaaggaccccagcaccctgggcttcctggaggccgctgtgaagatcagccacaccagcccagacatcccagctgaggtgcagatgtctgtgaaggagcacatcatgaggcacacccggctgcagaggcagaccacagagcccgccagcagcaccaggcacaccagcttcaagaggcacctgccctag

SEQ ID NO: 172289 - DNA, 261 bp, Artificial Sequence
  Description of Artificial Sequence: Synthetic coding sequence
atgccctggaggaacaaggaggccagcagccccagcagcgccaacccccccctggaggccctgcagagccccagcttccggggcaacatggctgacaagctgaaggaccccagcaccctgggcttcctggaggccgctgtgaagatcagccacaccagcccagacatcccagctgaggtgcagatgtctgtgaaggagcacatcatgaggcacacccggctgcagaggcagaccacagagcccgccagcagcaccaggtag

SEQ ID NO: 172290 - DNA, 1212 bp, Artificial Sequence
  Description of Artificial Sequence: Synthetic coding sequence
atgtacagagatcctgaggccgccagccctggggcccccagcagagatgtgctgctggtgtctgccatcatcaccgtgtccctgtctgtgacagtggtgctgtgtggcctgtgccactggtgccagaggaagctgggcaagcgctacaagaacagcctggagaccgtgggcaccccagattctggccggggccgctctgagaagaaggccatcaagctgcctgctgggggcaaggctgtgaacacagcccctgtgcccggccagacccctcatgatgaaagtgacagaagaacagagcccaggagctctgtgtctgacctggtgaacagcctgaccagcgagatgctgatgctgagccctggcagcgaggaggatgaggcccacgagggctgcagccgggagaacctgggccgcatccagttctctgtgggctacaacttccaggagagcaccctgactgtgaagatcatgaaggcccaggagctgcctgccaaggacttcagcggcaccagtgacccctttgtgaagatctacctgctgcctgacaagaagcacaagctggagaccaaggtgaagaggaagaacctgaacccccactggaatgagaccttcctgtttgagggcttcccctatgagaaggtggtgcagaggatcctgtacctgcaggtgctggactatgaccgcttcagcagaaatgaccccatcggggaggtgtccatccccctgaacaaggtggacctgacccagatgcagaccttctggaaggacctgaagccctgcagtgatggcagcggcagcagaggagagctgctgctgagcctgtgctacaaccccagcgccaacagcatcatcgtgaacatcatcaaggccaggaacctgaaggccatggacatcggcggcaccagtgacccctacgtgaaggtgtggctgatgtacaaggacaagagggtggagaagaagaagacagtgaccatgaagaggaacctgaaccccatcttcaatgaaagctttgcctttgacatccccacagagaagctgcgggagaccaccatcatcatcaccgtgatggacaaggacaagctgagcagaaatgatgtgattggcaagatctacctgtcctggaagagcggccctggagaggtgaagcactggaaggacatgattgcccggccccggcagcctgtggcccagtggcaccagctgaaggcctag

SEQ ID NO: 172291 - DNA, 1266 bp, Artificial Sequence
  Description of Artificial Sequence: Synthetic coding sequence
atggctgtggatgtggccgagtaccacctgagcgtcatcaagagccccccaggctgggaggtgggcgtgtatgctgctggggccctggccctgctgggcattgctgctgtgtccctgtggaagctgtggaccagcggcagcttccccagccccagccccttccccaactatgactaccgctacctgcagcagaagtacggggagagctgtgccgaggcccgggagaagagggtgcctgcctggaatgcccagagggccagcacccggggcccccccagcaggaagggcagcctgagcattgaggacacctttgagagcatcagcgagctgggccccctggagctgatgggccgggagctggacctggccccctacggcaccctgaggaagagccagagcgctgacagcctgaacagcatcagctctgtgagcaacaccttcggccaggacttcaccctgggccaggtggaggtgtccatggagtatgacacagccagccacaccctgaatgtggccgtgatgcagggcaaggacctgctggagcgggaggaggccagctttgagagctgcttcatgagggtgtccctgctgcctgatgagcagatcgtgggcatcagccgcatccagagaaatgcctacagcatcttctttgatgagaagttcagcatccccctggaccccacagccctggaggagaagagcctgcgcttctctgtgtttggaattgatgaagatgaaagaaatgtgtccactggagtggtggagctgaagctgtctgtgctggacctgcccctgcagcccttcagcggctggctgtacctgcaggaccagaacaaggctgctgatgctgtgggggagatcctgctgagcctgagctacctgcccacagctgagcggctgactgtggtggtggtgaaggccaagaacctgatctggaccaatgacaagaccacagctgacccctttgtgaaggtgtacctgctgcaggacggcaggaagatgagcaagaagaagacagctgtgaagagagatgaccccaaccctgtgttcaatgaggccatgatcttctctgtgcctgccatcgtgctgcaggacctgagcctgcgggtgacagtggccgagagcagcagtgatggccgcggggacaacgtgggccacgtgatcatcggccccagcgccagcggcatgggcaccacccactggaaccagatgctggccaccctgcggcggcctgtgtccatgtggcatgctgtgagaagaaattag

SEQ ID NO: 172292 - DNA, 1266 bp, Artificial Sequence; identical to SEQ ID NO: 172291
  Description of Artificial Sequence: Synthetic coding sequence

SEQ ID NO: 172293 - DNA, 1266 bp, Artificial Sequence; identical to SEQ ID NO: 172291
  Description of Artificial Sequence: Synthetic coding sequence

SEQ ID NO: 172294 - DNA, 1281 bp, Artificial Sequence
  Description of Artificial Sequence: Synthetic coding sequence
atggtgctgtctgtgcctgtgattgccctgggcgccaccctgggcacagccaccagcatcctggccctgtgtggggtgacctgcctgtgccgccacatgcaccccaagaagggcctgctgccccgggaccaggaccctgacctggagaaggccaagcccagcctgctgggcagcgcccagcagttcaacgtgaagaagagcacagagcctgtgcagccccgggccctgctgaagttcccagacatctacggccccaggcctgctgtgacagcccctgaggtgatcaactatgctgactacagcctgcggagcacagaggagcccacagccccagccagcccccagcccccaaatgacagccggctgaagaggcaggtgacagaggagctgttcatcctgccccagaatggagtggtggaggatgtgtgtgtgatggagacctggaaccctgagaaggccgcctcctggaaccaggcccccaagctgcactactgcctggactatgactgccagaaggccgagctgtttgtgacccggctggaggccgtgaccagcaaccatgatggcggctgtgactgctacgtgcagggctctgtggccaacagaactggatctgtggaggcccagacagccctgaagaagaggcagctgcacaccacctgggaggagggcctggtgctgcccctggccgaggaggagctgcccacagccaccctgaccctgaccctgcggacctgtgaccgcttcagccgccacagcgtggccggggagctgcggctgggcctggatggcacctctgtgcccctgggcgccgcccagtggggcgagctgaagaccagcgccaaggagcccagcgctggggccggggaggtgctgctgagcatctcctacctgcctgctgccaaccggctgctggtggtgctgatcaaggccaagaacctgcacagcaaccagagcaaggagctgctgggcaaggatgtgtctgtgaaggtgaccctgaagcaccaggccaggaagctgaagaagaagcagaccaagagggccaagcacaagatcaaccctgtgtggaatgagatgatcatgtttgagctgcctgatgacctgctgcaggccagctctgtggagctggaggtgctgggccaggatgacagcggccagagctgtgccctgggccactgcagcctgggcctgcacaccagcggcagcgagaggagccactgggaggagatgctgaagaacccccggcggcagatcgccatgtggcaccagctgcacctgtag

SEQ ID NO: 172295 - DNA, 1554 bp, Artificial Sequence
  Description of Artificial Sequence: Synthetic coding sequence
atgctgctgctcttcctgtacatcaacaagaagttctgctttgaaaatgtgggcggcttcccagacctgggcagcgagtacagcaccaggaagaacagccaggacaagatctacaacagctacatggacaaggatgaacatggcagcagcagcgagagtgaagatgaggccctgggcaagtaccacgaggccctgagcaggacccacaacagccggctgcccctggccgacagccggcagagaaattatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgacagcggcagcccccacctgagctgcacccccagcgagatcggggacagcaaatgtgagttcagccactgcagcaacagcccccgctgcagctacaacaagtgccccagcgagggcagcactggacatgaaattgagagcttccacaacaagggctatgaagaagatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcccgtcatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaaccggccccccaacacctacgtgaagctgaccctgctgaacagcatgggccaggagatgagcaagtgcaagaccagcatcagaagaggccagcccaaccctgtgtacaaggagacctttgtgttccaggtggccctcttccagctgagtgatgtgaccctcatcctgtctgtgtacaacaagaggtccatgaagaggaaggagatgattggctggatcagcctgggcctgaacagcagtggagaggaggagctgaaccactggacagagatgaaggagagcaagggccagcaggtgtgccgctggcacgccctgctggagagctag

SEQ ID NO: 172296 - DNA, 1725 bp, Artificial Sequence
  Description of Artificial Sequence: Synthetic coding sequence
atggccattgaaggaggagagaggacctgtggggtgcatgagctgatctgcatcaggaaggtgtccccagaggccgtgggcttcctgtctgctgtgggcgtcttcatcatcctgatgctgctgctcttcctgtacatcaacaagaagttctgctttgaaaatgtgggcggcttcccagacctgggcagcgagtacagcaccaggaagaacagccaggacaagatctacaacagctacatggacaaggatgaacatggcagcagcagcgagagtgaagatgaggccctgggcaagtaccacgaggccctgagcaggacccacaacagccggctgcccctggccgacagccggcagagaaattatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgacagcggcagcccccacctgagctgcacccccagcgagatcggggacagcaaatgtgagttcagccactgcagcaacagcccccgctgcagctacaacaagtgccccagcgagggcagcactggacatgaaattgagagcttccacaacaagggctatgaagaagatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcccgtcatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaaccggccccccaacggcctcttctgctgcctgaagcacctgattggaggccaggtgtacatcatccgggacacctacgtgaagctgaccctgctgaacagcatgggccaggagatgagcaagtgcaagaccagcatccggcggggccagcccaaccctgtgtacaaggagacctttgtgttccaggtggccctcttccagctgagtgatgtgaccctcatcctgtctgtgtacaacaagaggtccatgaagaggaaggagatgattggctggatcagcctgggcctgaacagcagcggggaggaggagctgaaccactggacagagatgaaggagagcaagggccagcaggtgtgccgctggcacgccctgctggagagctag

SEQ ID NO: 172297 - DNA, 1377 bp, Artificial Sequence
  Description of Artificial Sequence: Synthetic coding sequence
atggccattgaaggaggagagaggacctgtggggtgcatgagctgatctgcatcaggaaggtgtccccagaggccgtgggcttcctgtctgctgtgggcgtcttcatcatcctgatgctgctgctcttcctgtacatcaacaagaagttctgctttgaaaatgtgggcggcttcccagacctgggcagcgagtacagcaccaggaagaacagccaggacaagatctacaacagctacatggacaaggatgaacatggcagcagcagcgagagtgaagatgaggccctgggcaagtaccacgaggccctgagcaggacccacaacagccggctgcccctggccgacagccggcagagaaattatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgacagcggcagcccccacctgagctgcacccccagcgagatcggggacagcaaatgtgagttcagccactgcagcaacagcccccgctgcagctacaacaagtgccccagcgagggcagcactggacatgaaattgagagcttccacaacaagggctatgaagaagatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcccgtcatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaaccggccccccaagatggactgcagcgtggtgtag

SEQ ID NO: 172298 - DNA, 1860 bp, Artificial Sequence
  Description of Artificial Sequence: Synthetic coding sequence
atggccagcgcctcctggaggctgaaggtggagcgggagcctgtggagtacatgaacctgtctgtgctggagaagattggctacttctctgtggcccggctggagtacagcggcaccatcctggcccactgcaacttccggctgctgggcagcaatgacagcagcgccagcgccagccaggtgacaggcaccaccgtgtccccagaggccgtgggcttcctgtctgctgtgggcgtcttcatcatcctgatgctgctgctcttcctgtacatcaacaagaagttctgctttgaaaatgtgggcggcttcccagacctgggcagcgagtacagcaccaggaagaacagccaggacaagatctacaacagctacatggacaaggatgagcacggcagcagcagcgagagtgaagatgaggccctgggcaagtaccacgaggccctgagcaggacccacaacagccggctgcccctggccgacagccggcagaggaactatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgattctggcagcccccacctgagctgcaccccatctgaaattggagacagcaaatgtgagttcagccactgcagcaacagcccccgctgcagctacaacaagtgccccagcgagggcagcacaggccacgagattgagagcttccacaacaagggctatgaggaggatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcctgtgatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaacagacctccaaatggcctcttctgctgcctgaagcacctgattggaggccaggtgtacatcatccgggacacctacgtgaagctgaccctgctgaacagcatgggccaggagatgagcaagtgcaagaccagcatcagaagaggccagcccaaccctgtgtacaaggagacctttgtgttccaggtggccctcttccagctgagtgatgtgaccctcatcctgtctgtgtacaacaagaggtccatgaagaggaaggagatgattggctggatcagcctgggcctgaacagcagtggagaggaggagctgaaccactggacagagatgaaggagagcaagggccagcaggtgtgccgctggcacgccctgctggagagctag

SEQ ID NO: 172299 - DNA, 1668 bp, Artificial Sequence
  Description of Artificial Sequence: Synthetic coding sequence
atggccattgaaggaggagagaggacctgtggggtgcatgagctgatctgcatcaggaaggtgtccccagaggccgtgggcttcctgtctgctgtgggcgtcttcatcatcctgatgctgctgctcttcctgtacatcaacaagaagttctgctttgaaaatgtgggcggcttcccagacctgggcagcgagtacagcaccaggaagaacagccaggacaagatctacaacagctacatggacaaggatgaacatggcagcagcagcgagagtgaagatgaggccctgggcaagtaccacgaggccctgagcaggacccacaacagccggctgcccctggccgacagccggcagagaaattatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgacagcggcagcccccacctgagctgcacccccagcgagatcggggacagcaaatgtgagttcagccactgcagcaacagcccccgctgcagctacaacaagtgccccagcgagggcagcactggacatgaaattgagagcttccacaacaagggctatgaagaagatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcccgtcatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaaccggccccccaacacctacgtgaagctgaccctgctgaacagcatgggccaggagatgagcaagtgcaagaccagcatcagaagaggccagcccaaccctgtgtacaaggagacctttgtgttccaggtggccctcttccagctgagtgatgtgaccctcatcctgtctgtgtacaacaagaggtccatgaagaggaaggagatgattggctggatcagcctgggcctgaacagcagtggagaggaggagctgaaccactggacagagatgaaggagagcaagggccagcaggtgtgccgctggcacgccctgctggagagctag

SEQ ID NO: 172300 - DNA, 1746 bp, Artificial Sequence
  Description of Artificial Sequence: Synthetic coding sequence
atggccattgaaggaggagagaggacctgtggggtgcatgagctgatctgcatcaggaaggtgtccccagaggccgtgggcttcctgtctgctgtgggcgtcttcatcatcctgatgctgctgctcttcctgtacatcaacaagaagttctgctttgaaaatgtgggcggcttcccagacctgggcagcgagtacagcaccaggaagaacagccaggacaagatctacaacagctacatggacaaggatgaacatggcagcagcagcgagagtgaagatgaggccctgggcaagtaccacgaggccctgagcaggacccacaacagccggctgcccctggccgacagccggcagagaaattatgcctgggagacccggcagaagtacagccccctgtctgcagaatatgatggctacagcagcgaggccagcattgatgagggcaactgcatccagaggatgaggaggaccccacccctggatgagctgcagcccccaccctaccaggatgacagcggcagcccccacctgagctgcacccccagcgagatcggggacagcaaatgtgagttcagccactgcagcaacagcccccgctgcagctacaacaagtgccccagcgagggcagcactggacatgaaattgagagcttccacaacaagggctatgaagaagatgtgcccagcgacagcacagctgtgctgagccctgaggacatgtctgcccagggcagcagcagccagctgcccaagccctttgatcctgagcctgaggccaagtatggcaccctggatgtgacctttgattatgacagccaggagcagaagctgctggtgacagtgacagctgtgacagacatccccacctacaacagaactggaggcaacagctggcaggtgcacctggtgctgctgcccatcaagaagcagagggccaagaccagcatccagaggggcccctgccctgtgttcacagagaccttcaagttcaaccacgtggagagcgagatgattggcaactatgctgtgcgcttccggctgtatggagtgcacaggatgaagaaggagaagatcgtgggggagaagatcttctacctgaccaagctgaacctgcagggcaagatgagcctgcccgtcatcctggagcccagctacaaccacagcggctgtgacagccagatgtctgtgtctgagatgagctgcagcgagagcaccagcagctgccagagcctggagcacggctctgtgcctgagatcctgattggcctgctgtacaatgccaccaccggccgcctgtctgctgaggtgatcaagggcagccacttcaagaacctggccgccaaccggccccccaccttccaccccctgctgagtgatggcctcttctgctgcctgaagcacctgattggaggccaggtgtacatcatccgggacacctacgtgaagctgaccctgctgaacagcatgggccaggagatgagcaagtgcaagaccagcatcagaagaggccagcccaaccctgtgtacaaggagacctttgtgttccaggtggccctcttccagctgagtgatgtgaccctcatcctgtctgtgtacaacaagaggtccatgaagaggaaggagatgattggctggatcagcctgggcctgaacagcagtggagaggaggagctgaaccactggacagagatgaaggagagcaagggccagcaggtgtgccgctggcacgccctgctggagagctag

SEQ ID NO: 172301 - DNA, 1554 bp, Artificial Sequence; identical to SEQ ID NO: 172295
  Description of Artificial Sequence: Synthetic coding sequence

SEQ ID NO: 172302 - DNA, 1266 bp, Artificial Sequence
  Description of Artificial Sequence: Synthetic coding sequence
atggccgagcagctggccctggtgattggaggcaccatcggcggcctgctgctgctgctgctgattggagccagctgctgcctgtggaggcgcttctgtgccaccctgacctatgaggagctgcccggcaccccagccatggccaccacagctgccagcagcggccagagggaccggccctgccagccccacgcccggacccagctgagccggcccccagctgtgccctttgtggtgccccccaccctgcagggccgggactgggtgcccctgcacagcggggagtgggcagatgccccctgggacccctgcccagccagcgagctgctgccccacaccagcagcggcggcctgggagatgcctgcatggtgggcgccatcaaccctgagctgtacaagtttcctgaggacaagtcagaaacagacttcccagatggctgcctgggccgcctgtggttctctgtggagtatgagcaggaggccgagcggctgctggtgggcctcatcaaggcccagcacctgcaggcccccagcgagacctgcagccccctggtgaagctgtacctgctgcctgatgagcggcgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgcagaagagtcatctggagggacctggaggccgagagcctggagcccccatctgaatttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagagccagcagctgggccgggtggtggtgggcccctacatgtacacccggggccgggagctggagcactgggatgagatgctgagcaagcccaaggagctggtgaagcgctggcacgccctgtgcaggaccacagagccctag

SEQ ID NO: 172303 - DNA, 1425 bp, Artificial Sequence
  Description of Artificial Sequence: Synthetic coding sequence
atgggcgtggtgctgagcccccacccagcccccagcagaagagagcccctggcccccctggcccctggcacccggcccggctggagccctgctgtgtctggcagcagccgcagcgccctgcggcccagcacagctggccctggccctggccctggcaccggctggggcggcacagctgccagcggccgctgggtgcctgccccagctgtgcactgtgccgcccccagggctgctgctggccaccagcagcaccacggcccccccctgtgcagcccagatggagccccccggcgcttcaagagaagacctggcagccctgccccagctgcccagacaggagagaccagcctgcgggagcagccccacggcggccccccagctgtgccctttgtggtgccccccaccctgcagggccgggactgggtgcccctgcacagcggggagtgggcagatgccccctgggacccctgcccagccagcgagctgctgccccacaccagcagcggcggcctgggagatgcctgcatggtgggcgccatcaaccctgagctgtacaagtttcctgaggacaagtcagaaacagacttcccagatggctgcctgggccgcctgtggttctctgtggagtatgagcaggaggccgagcggctgctggtgggcctcatcaaggcccagcacctgcaggcccccagcgagacctgcagccccctggtgaagctgtacctgctgcctgatgaaagacgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgccggcgggtcatctggagggacctggaggccgagagcctggagccccccagcgagtttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagagccagcagctgggccgggtggtggtgggcccctacatgtacacccggggccgggagctggagcactgggatgagatgctgagcaagcccaaggagctggtgaagcgctggcacgccctgtgcaggaccacagagccctag

SEQ ID NO: 172304 - DNA, 1173 bp, Artificial Sequence
  Description of Artificial Sequence: Synthetic coding sequence
atggccgagcagctggccctggtgattggaggcaccatcggcggcctgctgctgctgctgctgattggagccagctgctgcctgtggaggcgcttctgtgccaccctgacctatgaggagctgcccggcaccccagccatggccaccacagctgccagcagcggccagagggaccggccctgccagccccacgcccggacccagctgagccggcccccagctgtgccctttgtggtgccccccaccctgcagggccgggactgggtgcccctgcacagcggggagtgggcagatgccccctgggacccctgcccagccagcgagctgctgccccacaccagcagcggcggcctgggagatgcctgcatggtgggcgccatcaaccctgagctgtacaagtttcctgaggacaagtcagaaacagacttcccagatggctgcctgggccgcctgtggttctctgtggagtatgagcaggaggccgagcggctgctggtgggcctcatcaaggcccagcacctgcaggcccccagcgagacctgcagccccctggtgaagctgtacctgctgcctgatgagcggcgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgcagaagagtcatctggagggacctggaggccgagagcctggagcccccatctgaatttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagcaggccaccaccgtggagctgttcctgttccacctgaccagcggctag

SEQ ID NO: 172305 - DNA, 543 bp, Artificial Sequence
  Description of Artificial Sequence: Synthetic coding sequence
gatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgcagaagagtcatctggagggacctggaggccgagagcctggagcccccatctgaatttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagcaggccaccaccgtggagctgttcctgttccacctgaccagcggctag

SEQ ID NO: 172306 - DNA, 783 bp, Artificial Sequence
  Description of Artificial Sequence: Synthetic coding sequence
atggtgggcgccatcaaccctgagctgtacaagtttcctgaggacaagtctgagacctgcagccccctggtgaagctgtacctgctgcctgatgaaagacgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgccggcgggtcatctggagggacctggaggccgagagcctggagccccccagcgagtttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagagccagcagctgggccgggtggtggtgggcccctacatgtacacccggggccgggagctggagcactgggatgagatgctgagcaagcccaaggagctggtgaagcgctggcacgccctgtgcaggaccacagagccctag

SEQ ID NO: 172307 - DNA, 1047 bp, Artificial Sequence
  Description of Artificial Sequence: Synthetic coding sequence
atggccgagcagctggccctggtgattggaggcaccatcggcggcctgctgctgctgctgctgattggagccagctgctgcctgtggaggcgcttctgtgccaccctgacctatgaggagctgcccggcaccccagccatggccaccacagctgccagcagcggccagagggaccggccctgccagccccacgcccggacccagctgagccggcccccagctgtgccctttgtggtgccccccaccctgcagggccgggactgggtgcccctgcacagcggggagtgggcagatgccccctgggacccctgcccagccagcgagctgctgccccacaccagcagcggcggcctgggagatgcctgcatggtgggcgccatcaaccctgagctgtacaagtttcctgaggacaagtcagaaacagacttcccagatggctgcctgggccgcctgtggttctctgtggagtatgagcaggaggccgagcggctgctggtgggcctcatcaaggcccagcacctgcaggcccccagcgagacctgcagccccctggtgaagctgtacctgctgcctgatgagcggcgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgcagaagagtcatctggagggacctggaggccgagagcctggagcccccatctgaatttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgccaagtgcaagccaggccctgacctgggggaggagagccggggcagcctgaacctgaagtag

SEQ ID NO: 172308 - DNA, 1173 bp, Artificial Sequence; identical to SEQ ID NO: 172304
  Description of Artificial Sequence: Synthetic coding sequence

SEQ ID NO: 172309 - DNA, 1152 bp, Artificial Sequence
  Description of Artificial Sequence: Synthetic coding sequence
atggtgctggccatggccagccaggatgtgcagaacttcttccagcccttcagctcctggatcagccgggtgtatgaggccctgcagcaggccggggacatgctgagcgccagcctggtgaacatcagcaagcaggacagcaagctgagtgacaagctggaccaggacctggacaacatccagatccaggagacctactttgaagatgaggagcaggacaatgactggagccaggaggatgccaacagcctcttcctggaggtggaccacttcagctgctgcaacagcgacctgcaggacagcgcccagaacagcagccccagcctgagccagcacgccaaggacagctgcagcaccatgagccagtggcccaactgggccagtgatgacaggaagctgccccacgtgctgagcagcattgctgaggaggagcaccacctggagaagcagaggagcggcctgcagcacggctttgacagccagctgcccggcaccctggagaccgtgaatggcaagaagcaggtgaacagctttggagatgatgaggagctgagcaccagcagtgacagtgatgaggaggtgatcaagcagtttgagatctctgtgagccgcagccagagcttccgctctgtgaccagcgagaagggcaagcagacaggcctggagcagaagcccaagttcagccgcagcctgctgacccacggggaggatggaacagaggtgtctgcctgtgaggacctggatggagccagccagaggcgctacagcgagaacctgtcctatggagaagatgaccacatcccagcccacagccagagcccctgtgaaagaggagatgccaagcaccacggcaccagccaccaggagagctctgtggtgcagagcctgcggcggcagagcacagagggcagcctggagatggagacagccttcaacagccggggctttgaagattcctatgccacagacagcagctccatgtggagccctgaggccaacctgaacctgaagaggaagggctacctgctggatgtgtactgcctgagcagccccctgctcttcaccaccagcctgcacagaagaaacagaacaggccccatctgccgctgccaccctggcagccagagccccagccagagcgtggtgacctag

SEQ ID NO: 172310 - DNA, 1938 bp, Artificial Sequence
  Description of Artificial Sequence: Synthetic coding sequence
atggtgctggccatggccagccaggatgtgcagaacttcttccagcccttcagctcctggatcagccgggtgtatgaggccctgcagcaggccggggacatgctgagcgccagcctggtgaacatcagcaagcaggacagcaagctgagtgacaagctggaccaggacctggacaacatccagatccaggagacctactttgaagatgaggagcaggacaatgactggagccaggaggatgccaacagcctcttcctggaggtggaccacttcagctgctgcaacagcgacctgcaggacagcgcccagaacagcagccccagcctgagccagcacgccaaggacagctgcagcaccatgagccagtggcccaactgggccagtgatgacaggaagctgccccacgtgctgagcagcattgctgaggaggagcaccacctggagaagcagaggagcggcctgcagcacggctttgacagccagctgcccggcaccctggagaccgtgaatggcaagaagcaggtgaacagctttggagatgatgaggagctgagcaccagcagtgacagtgatgaggaggtgatcaagcagtttgagatctctgtgagccgcagccagagcttccgctctgtgaccagcgagaagggcaagcagacaggcctggagcagaagcccaagttcagccgcagcctgctgacccacggggaggatggaacagaggtgtctgcctgtgaggacctggatggagccagccagaggcgctacagcgagaacctgtcctatggagaagatgaccacatcccagcccacagccagagcccctgtgaaagaggagatgccaagcaccacggcaccagccaccaggagagctctgtggtgcagagcctgcggcggcagagcacagagggcagcctggagatggagacagccttcaacagccggggctttgaagattcctatgccacagacagcagctccatgtggagccctgaggagcaggacaggaccaacctgcaggtgcccagcggcgtgtctgagcccatcagcaaatgtggggacctggatgtgatctttgagtaccgggccgccagccagaagctgactgtgaccatcgtgcgggcccagggcctgcctgacaaggacagaagtggagtgaacagctggcaggtgcacgtggtgctgctgcccgggaagaagcaccggggccgcaccaacatccagaggggccccaaccctgtgttccgggagaaggtgacctttgccaagctggagcccagagatgtggccgcctgtgctgtgcgcttccggctgtatgctgccaggaagatgacccgggagaggatgatgggagagaagctgttctacctgagccacctgcaccctgagggggagatgaaggtgaccctggtgctggagcccaggagcaacatcagcagcggcggcagccccctgagccccagcgctgtgagccacagcgacagcaccagcagcacccagagcctgagccatggaggagcccctgagctgctggtgggcctgagctacaatgccaccaccggccgcctgtctgtggagatgatcaagggcagccacttcaggaacctggccgtgaacagagccccagacacctacggcaagctgttcctgctgaacagcgtgggccaggagatgagccgctgcaagaccagcatcagaagaggccagcccaaccctgtgtacaaggagacctttgtgttccaggtggccctcttccagctgagtgatgtgaccctgatgatctctgtgtacaacagaaggaccatgaagaggaaggagatgattggctggatcgccctgggccagaacagcagtggagaggaggagcaggaccactgggaggagatgaaggagaccaagggccagcagatctgccgctggcacaccctgctggagagctag

SEQ ID NO: 172311 - DNA, 1653 bp, Artificial Sequence
  Description of Artificial Sequence: Synthetic coding sequence
atgccccagaggggccaccccagccaggagggcctgtgggccctgcccagcctgcccatggcccacggccccaagccagagacagagggcctgctggacctgtccttcctgacagaggaggagcaggaggccatcgccggcgtgctgcagagagatgcccggctgcggcagctggaggagggccgggtgtccaagctgcgggcctctgtggccgaccccggccagctgaagatcctgaccggggactggttccaggaggcccggagccagaggcaccacaatgcccactttggaagtgacctggtgcgggcctccatgaggaggaagaagagcaccaggggggaccaggcccctggccatgaccgggaggccgaggccgctgtgaaggagaaggaggagggccctgagccccggctgaccattgatgaggccccccaggagcggctgcgggagacagaggccagtgaccctgaggaggccagccaggcccaggaggaccccggccagggcgaccagcaggtgtgtgccgaggaggccgaccctgagctggagcccgccagcggcggggagcaggagccccggccccagcaggcccagaccaaggccgccagccagatcctggagaatggagaggaggcccctggccctgaccccagcctggacaggatgctgagcagcagcagctctgtgagcagcctgaacagcagcaccctgagcggcagccagatgagcctgtctggagatgctgaggccgtgcaggtgcggggctctgtgcactttgccctgcactatgagcccggggctgctgagctgcgggtgcacgtgatccagtgccagggcctggccgccgccaggagaagaagaagtgacccctacgtgaagagctacctgctgcctgacaagcagagcaagaggaagacagctgtgaagaagaggaacctgaaccctgtgttcaatgagaccctgcgctacagcgtgccccaggccgagctgcagggccgggtgctgagcctgtctgtgtggcaccgggagagcctgggcaggaacatcttcctgggggaggtggaggtgcccctggacacctgggactggggcagcgagcccacctggctgcccctgcagccccgggtgccccccagcccagatgacctgcccagccggggcctgctggccctgagcctgaagtatgtgcctgctggcagcgagggcgccggcctgcccccatctggagagctgcacttctgggtgaaggaggcccgggacctgctgcccctgcgggccggcagcctggacacctacgtgcagtgctttgtgctgcctgatgacagccaggccagccggcagaggaccagggtggtgcggcgcagcctgagccctgtgttcaaccacaccatggtgtatgatggcttcggccctgctgacctgcggcaggcctgtgccgagctgagcctgtgggaccatggagccctggccaaccggcagctgggcggcacccggctgagcctgggcaccggcagcagctatggcctgcaggtgccctggatggacagcaccccagaggagaagcagctgtggcaggccctgctggagcagccctgtgagtgggtggatggcctgctgcccctgcggaccaacctggcccccaggacatag

SEQ ID NO: 172312 - DNA, 231 bp, Artificial Sequence
  Description of Artificial Sequence: Synthetic coding sequence
atgccccagaggggccaccccagccaggagggcctgtgggccctgcccagcctgcccatggcccacggccccaagccagagacagagggcctgctggacctgtccttcctgacagaggaggagcaggaggccatcgccggcgtgctgcagagagatgcccggctgcggcagctggaggagggccgggtgtccaagctgcgggcctctgtggccgaccccggccagctgtag

SEQ ID NO: 172313 - DNA, 1065 bp, Artificial Sequence
  Description of Artificial Sequence: Synthetic coding sequence
atgccccagaggggccaccccagccaggagggcctgtgggccctgcccagcctgcccatggcccacggccccaagccagagacagagggcctgctggacctgtccttcctgacagaggaggagcaggaggccatcgccggcgtgctgcagagagatgcccggctgcggcagctggaggagggccgggtgtccaagctgcgggcctctgtggccgaccccggccagctgaagatcctgaccggggactggttccaggaggcccggagccagaggcaccacaatgcccactttggaagtgacctggtgcgggcctccatgaggaggaagaagagcaccaggggggaccaggcccctggccatgaccgggaggccgaggccgctgtgaaggagaaggaggagggccctgagccccggctgaccattgatgaggccccccaggagcggctgcgggagacagagggccctgacttccccagccccagcgtgcccctgaaggccagtgaccctgaggaggccagccaggcccaggaggaccccggccagggcgaccagcaggtgtgtgccgaggaggccgaccctgagctggagcccgccagcggcggggagcaggagccccggccccagcaggcccaggtgggcggcagcggcccctggctgctgagcaccagcggggctgacagcggccgcggggccctgctgccccgggccgccagccggccccggccccgggccctgggcgccggcgtgggcaaggagggcgcccccaggcacctgccccccctgcagaccaaggccgccagccagatcctggagaatggagaggaggcccctggccctgaccccagcctggacaggatgctgagcagcagcagctctgtgagcagcctgaacagcagcaccctgagcggcagccagatgagcctgtctggagatgctgaggccgtgcaggtgcggggctctgtgcactttgccctgcactatgagcctggagctgctgagctgcgggtgcacgtgatccagtgccagggcctggccgccgccaggagaagaagaagtgacccctag

SEQ ID NO: 172314 - DNA, 606 bp, Artificial Sequence
  Description of Artificial Sequence: Synthetic coding sequence
atgggcaccacagccctgctgggcggcgtgcggctgtctgagaccatccctgtgaagaggctggcccggggcctggcccgggtgagagatggcggctggggcagcccccaggccggggagaaggccctgggcggccccctgctgaccagcggcagccacctgcccagctatgtgaagagctacctgctgcctgacaagcagagcaagaggaagacagctgtgaagaagaggaacctgaaccctgtgttcaatgagaccctgcgctacagcgtgccccaggccgagctgcagggccgggtgctgagcctgtctgtgtggcaccgggagagcctgggcaggaacatcttcctgggggaggtggaggtgcccctggacacctgggactggggcagcgagcccacctggctgcccctgcagccccgggtgccccccagcccagatgacctgcccagccggggcctgctggccctgagcctgaagtatgtgcctgctggcagcgagggcgccggcctgccccccagcggggagctgcacttctgggtgaaggaggcccgggacctgctgcccctgcgggccggcagcctggacacctacgtgcagtggtag

SEQ ID NO: 172315 - DNA, 1083 bp, Artificial Sequence
  Description of Artificial Sequence: Synthetic coding sequence
atgccccagaggggccaccccagccaggagggcctgtgggccctgcccagcctgcccatggcccacggccccaagccagagacagagggcctgctggacctgtccttcctgacagaggaggagcaggaggccatcgccggcgtgctgcagagagatgcccggctgcggcagctggaggagggccgggtgtccaagctgcgggcctctgtggccgaccccggccagctgaagatcctgaccggggactggttccaggaggcccggagccagaggcaccacaatgcccactttggaagtgacctggtgcgggcctccatgaggaggaagaagagcaccaggggggaccaggcccctggccatgaccgggaggccgaggccgctgtgaaggagaaggaggagggccctgagccccggctgaccattgatgaggccccccaggagcggctgcgggagacagagggccctgacttccccagccccagcgtgcccctgaaggccagtgaccctgaggaggccagccaggcccaggaggaccccggccagggcgaccagcaggtgtgtgccgaggaggccgaccctgagctggagcccgccagcggcggggagcaggagccccggccccagcaggcccaggtgggcggcagcggcccctggctgctgagcaccagcggggctgacagcggccgcggggccctgctgccccgggccgccagccggccccggccccgggccctgggcgccggcgtgggcaaggagggcgcccccaggcacctgccccccctgcagaccaaggccgccagccagatcctggagaatggagaggaggcccctggccctgaccccagcctggacaggatgctgagcagcagcagctctgtgagcagcctgaacagcagcacagtgcggcgggagggcggggaccccggcggccggggcgtggaccccttccgctgtgtggccccagcctgccccagcctggccgccggccccacagctgctgccccccagcctgccacctatgaccccggcctgaagccaccccgctgcccccggccccggcgggagccctgtgagcggccctag

SEQ ID NO: 172316 - DNA, 879 bp, Artificial Sequence
  Description of Artificial Sequence: Synthetic coding sequence
tgaccccggccccagcaggcccaggtgggcggcagcggcccctggctgctgagcaccagcggggctgacagcggccgcggggccctgctgcccagggctgccagccggccccggccccgggccctgggcgctggggtgggcaaggagggcgcccccaggcacctgccccccctgcagaccaaggccgccagccagatcctggagaatggagaggaggcccctggccctgaccccagcctggacaggatgctgagcagcagcagctctgtgagcagcctgaacagcagcaccctgagcggcagccagatgagcctgtctggagatgctgaggccgtgcaggtgcggggctctgtgcactttgccctgcactatgagcccggggctgctgagctgcgggtgcacgtgatccagtgccagggcctggccgccgccaggagaagaagaagtgacccctacgtgaagagctacctgctgcctgacaagcagagcaagaggaagacagctgtgaagaagaggaacctgaaccctgtgttcaatgagaccctgcgctacagcgtgccccaggccgagctgcagggccgggtgctgagcctgtctgtgtggcaccgggagagcctgggcaggaacatcttcctgggggaggtggaggtgcccctggacacctgggactggggcagcgagcccacctggctgcccctgcagccccgggtgccccccagcccagatgacctgcccagccggggcctgctggccctgagcctgaagtatgtgcctgctggcagcgagggcgccggcctgcccccatctggagagctgcacttctgggtgaaggaggcccgggacctgctgcccctgcgggccggcagcctggacacctag

SEQ ID NO: 172317 - DNA, 1689 bp, Artificial Sequence
  Description of Artificial Sequence: Synthetic coding sequence
atgccccagaggggccaccccagccaggagggcctgtgggccctgcccagcctgcccatggcccacggccccaagccagagacagagggcctgctggacctgtccttcctgacagaggaggagcaggaggccatcgccggcgtgctgcagagagatgcccggctgcggcagctggaggagggccgggtgtccaagctgcgggcctctgtggccgaccccggccagctgaagatcctgaccggggactggttccaggaggcccggagccagaggcaccacaatgcccactttggaagtgacctggtgcgggcctccatgaggaggaagaagagcaccaggggggaccaggcccctggccatgaccgggaggccgaggccgctgtgaaggagaaggaggagggccctgagccccggctgaccattgatgaggccccccaggagcggctgcgggagacagagggccctgacttccccagccccagcgtgcccctgaaggccagtgaccctgaggaggccagccaggcccaggaggaccccggccagggcgaccagcaggtgtgtgccgaggaggccgaccctgagctggagcccgccagcggcggggagcaggagccccggccccagcaggcccagaccaaggccgccagccagatcctggagaatggagaggaggcccctggccctgaccccagcctggacaggatgctgagcagcagcagctctgtgagcagcctgaacagcagcaccctgagcggcagccagatgagcctgtctggagatgctgaggccgtgcaggtgcggggctctgtgcactttgccctgcactatgagcccggggctgctgagctgcgggtgcacgtgatccagtgccagggcctggccgccgccaggagaagaagaagtgacccctacgtgaagagctacctgctgcctgacaagcagagcaagaggaagacagctgtgaagaagaggaacctgaaccctgtgttcaatgagaccctgcgctacagcgtgccccaggccgagctgcagggccgggtgctgagcctgtctgtgtggcaccgggagagcctgggcaggaacatcttcctgggggaggtggaggtgcccctggacacctgggactggggcagcgagcccacctggctgcccctgcagccccgggtgccccccagcccagatgacctgcccagccggggcctgctggccctgagcctgaagtatgtgcctgctggcagcgagggcgccggcctgcccccatctggagagctgcacttctgggtgaaggaggcccgggacctgctgcccctgcgggccggcagcctggacacctacgtgcagtgctttgtgctgcctgatgacagccaggccagccggcagaggaccagggtggtgcggcgcagcctgagccctgtgttcaaccacaccatggtgtatgatggcttcggccctgctgacctgcggcaggcctgtgccgagctgagcctgtgggaccatggagccctggccaaccggcagctgggcggcacccggctgagcctgggcaccggcagcagctatggcctgcaggtgccctggatggacagcaccccagaggagaagcagctgtggcaggccctgctggagcagccctgtgagtgggtggatggcctgctgcccctgcggaccaacctggcccccaggacatag

SEQ ID NO: 172318 - DNA, 2808 bp, Artificial Sequence
  Description of Artificial Sequence: Synthetic coding sequence
atgattgacctgtccttcctgacagaggaggagcaggaggccatcatgaaggtgctgcagagagatgctgccctgaagagagctgaggaggagcgggtgcgccacctgcctgagaagatcaaggatgaccagcagctgaagaacatgagcggccagtggttctatgaggccaaggccaagaggcaccgggacaagatccatggagctgacatcatccgggcctccatgaggaagaagaggccccagattgctgctgagcagagcaaggaccgggagaatggagccaaggagagctgggtgaacaacgtgaacaaggatgccttcctgcccccagagctggccggcgtggtggaggagcctgaggaggatgctgccccagccagccccagcagctctgtggtgaacccagccagctctgtgattgacatgagccaggagaacaccaggaagcccaacgtgtccccagagaagcagaggaagaaccccttcaacagcagcaagctgcctgagggccacagcagccagcagaccaagaatgagcagagcaagaatggccgcacaggcctcttccagaccagcaaagaagatgagctgtctgagagcaaggagaagagcacagtggccgacaccagcatccagaagctggagaagagcaagcagaccctgcccggcctgagcaatggcagccagatcaaggcccccatccccaaggccaggaagatgatctacaagagcacagacctgaacaaggatgacaaccagagcttcccccggcagaggacagacagcctgaaggcccggggggccccccggggcatcctgaagaggaacagcagcagcagcagcacagattctgagaccctgcgctacaaccacaactttgagcccaagagcaagatcgtgtccccaggcctgaccatccacgagcgcatcagcgagaaggagcacagcctggaggacaacagcagccccaacagcctggagcccctgaagcacgtgcgcttctctgctgtgaaggatgagctgccccagagccctggcctcatccacggccgggaggtgggggagttctctgtgctggagagtgaccggctgaagaatggcatggaggatgctggggacacagaggagttccagagcgaccccaagcccagccagtacaggaagcccagcctcttccaccagagcaccagcagcccctacgtgtccaagtctgagacccaccagcccatgaccagcggcagcttccccatcaatggcctgcacagccacagcgaggtgctgacagcccggccccagagcatggagaacagccccaccatcaatgagcccaaggacaagagcagcgagctgacccggctggagagcgtgctgcccaggagccctgcagatgagctgagccactgtgtggagcctgagcccagccaggtgcctgggggcagcagccgggaccggcagcagggcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgtgtccacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccattgaatatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagagaaattccttcctgggggaggtggagctggacctggagacctgggactgggacaacaagcagaacaagcagctgcgctggtaccccctgaagaggaagacagcccctgtggccctggaggccgagaacagaggagagatgaagctggccctgcagtatgtgcctgagcctgtgcctgggaagaagctgcccaccaccggggaggtgcacatctgggtgaaggaatgtctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgagaattggatttggaacaggcaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172319 - DNA, 3819 bp, Artificial Sequence
  Description of Artificial Sequence: Synthetic coding sequence
atggatgagcccaatgctgagcaggtgtacaaccccagccagtttgagaacctgaggaagttctgggacctggaggccaacagcaacagcaaggacaatgacaagaacatcaccaccaccagccagaagaacagcgcccccttcaaccggcagaagcacaaggagttcagtgacatcaagctgagcggcaagaacacccatgaagctgaggtgctgctgagccccaagaaggtgatggcccgggaggagatggagaagctgaacagcaagggcatcctgcaggtgctgcctgatgagatcaccttccccctgagccccctgaggaagtacacctaccagctgcctggaaatgaaagcagcaaagaaaatgtggagaagaacacagagggcatcgtgacccctgtgttcaaggaggagaaggactacagcgagcaggagatccaggagagcatcatcaagaccaacgtgctgagcaaggactgcaaggacaccttcaatgacagcctgcagaagctgctgtctgagaccagcaccccagccatccagcccagcggcggcaaggtgcacggcaagcaggtgctggagcccagcgtgtctgagaacagaacctggccccagaagacagactttgctgacacagaggaggaggtgaagggccctgagaagatcatcaatgaacatgtggacaagacagtggtgcaccccaaggtgaagaggaacagcctgacagccagcctggacaagctgctgaaggaggccaccggcaccagccccagccccctgcaggccaagctggcccctgtgatcaccggcaccaacagcaagctggaggagggccgcttcttcggcaagggcatcgagcagagccacaacaccagcgctgacaagcgggagatcctggcccccttccctgtgagagatgagaccttcggcaacacagccctgctgaagaaggccgagagcggggagtgccagctgagcacccagaacctgatccagatggctgctgaggacagccaccccctggaccccaccagccagctgagcaggaagggcagctttggagatgtggccagccccccccaggacatgctgttcccccaggatgcccacctggtgccccaggcccgggtgcaccccagccagacagagatcagcgagaccgtggagaaggtgatcctgccccccaggcctgtgctgaatgatgtgtctgctgccctgcagaagctgtgtggggaggtgtggctgagctacccagctggccgggaggtgggccctggagaggtgaaccctgagttccctgaggccgtgcagcctgtgtgcagccccctgaaccccccaggagtcatcagcccctgggccaccatggacaccatcgtgcctgacaggaaggacttctacagcagcaatgtggtgcctgacaagacccatgaggtgggcagctacctggccgcccagatgagccccagcgaccagaccctgagcagctttgccagcatcgtggcccagtatggcaagggcctgccccaggaggtggaggagatcgtgcgggagaccatcgtgcagcccaagtctgagttcctggagttctctgctggcctggagaagctgctgaaggaggagacagagaccttccccagcaaatatgaaagtgacaccggcaacctgagccccagcaagctgattggcagcacagaggagccccggcgggccaccagcgagtgccaccctgaggagctgaaggagaccgtggagaaggccgaggcccccctcatcacagaaagtgcctttgatgctggctttgagaagctgctgaaggagatcacagaggccccaccctaccagccccaggtgtctgtgcgggaggagacccatgagaaggagagcagccagagcgagcagacccgcttcctgggcaccgtgccccacttctacagagctgccagccagaccagcgagatgaaggacaagagcaatggcctggagagccaggtgaaccagtgtgacaagatgctgggcggagatgccctggtgacagacctgctggtggacttctgtggcagccgcagcggcgtggagatccccaggaccccccagctgtatgtggcccacgagatcggcaccatcaagacagtgaccccacctgaggaccgggacagcgagagcggcgtggccggcggccagggcaccctgcaggagcccggctttggagaggccagcgaggccatctctgtgtccaggaaccggcagcccatccccctgctgatgaacaaggagaacagcaccaagaccagcaaggtggagctgaccctggccagcccctacatgaagcaggagaaggaggaggagaaggagggcttcagcgagagtgacttcagtgatggcaacaccagcagcaatgctgagagctggaggaaccccagcagcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgatgagaagccagaccagaagcctgtgaccaatgaatgtgtgccccgcatcagcacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172320 - DNA, 5343 bp, Artificial Sequence
  Description of Artificial Sequence: Synthetic coding sequence
atgatcaacagcagcctgtccatgctgttctcctacctggagaagtacttctacgtggctgatgagctgagccactgtgtggagcctgagcccagccaggtgcctgggggcagcagccgggaccggcagcagggcaagcccccacccctgcctgccctgaaggccaagaccagcagccgcagcggcccctatgccacagagatcaagaagagcacagatgacagcatcttcaaggtgctggactggttcaacagaagcagctacagtgatgacaacaagagcttcctgcagcacccccggggcatcgagagcaaggagaagacagacagcaagagccaggtggccgtggacctggtgacagatgacaccaccctgagagaaaatggcagcaagaccctgagccccagcaagattgagctgaagcctgtgcggagtgacagccccttccaggccgagggggacatgctggtgtctgagagctgccaggacaacaacgtgaacatcaagagcaagttcatgaacctgagccagaagggcacccccaaggagggccctggcatcctgcagccctttgagagctatggcacccccagccagggcagcaagaacatggactacagccaggacagcaagagccctggaaaaggaaatggagccagccccagcaacagcaactacagctacagcgtgctgaaggagagtgatgctgagaaccaggtgccctgcaacaccaacaacatcggcaacctgggggaggaggagcccaagttccacgcccacgaggagaacagaggccacagcgaggtgaactttgacagcagcacagtggtgaaggagcccggcctgaaggacaacatgaatgctgagaggaagagcaaggtgggcaacacctacatcctgaaggccagcctggagcctgagaacatcaagagcaccccaggagtggccaacaacggcagcccctggaagaagccagaggtgcagttccagcaggaggccggggaggtgcccaagaaccaggtgcagcgggagaagtacaagagggtgtctgaccgcatctccttctgggagggggagaaggccggggccaagatcacccatgagaagcccaccagcagctgcagccaggagcagcccagcgccaaggcctaccagcctgtgaagaagagccagggcgtgtcctccatggacagcctgagcacagaccagagcgagtacaaccaggccatccccaagagggtggtgctggatgaagatgaccaggccagccagctgagcaacagctacagcagcaacaagagcaaggagaccaagccccagattgctggccccagccgctactacctgtctgctgagcagagcgacaaggtgtccctcttccagaacaagaagaatgagcccatcaagaggagccaggtggccgacagcctgcccagcagaagaaacatcaccctgcctgccctgcagccccccagcaatgtgggcagcgagagacatgcccccctggagaaggaccggcccctggtgcgggagagcaatgccaacttcaaggtgatgagcctgaaggagaggatggatgagcccaatgctgagcaggtgtacaaccccagccagtttgagaacctgaggaagttctgggacctggaggccaacagcaacagcaaggacaatgacaagaacatcaccaccaccagccagaagaacagcgcccccttcaaccggcagaagcacaaggagttcagtgacatcaagctgagcggcaagaacacccatgaagctgaggtgctgctgagccccaagaaggtgatggcccgggaggagatggagaagctgaacagcaagggcatcctgcaggtgctgcctgatgagatcaccttccccctgagccccctgaggaagtacacctaccagctgcctggaaatgaaagcagcaaagaaaatgtggagaagaacacagagggcatcgtgacccctgtgttcaaggaggagaaggactacagcgagcaggagatccaggagagcatcatcaagaccaacgtgctgagcaaggactgcaaggacaccttcaatgacagcctgcagaagctgctgtctgagaccagcaccccagccatccagcccagcggcggcaaggtgcacggcaagcaggtgctggagcccagcgtgtctgagaacagaacctggccccagaagacagactttgctgacacagaggaggaggtgaagggccctgagaagatcatcaatgaacatgtggacaagacagtggtgcaccccaaggtgaagaggaacagcctgacagccagcctggacaagctgctgaaggaggccaccggcaccagccccagccccctgcaggccaagctggcccctgtgatcaccggcaccaacagcaagctggaggagggccgcttcttcggcaagggcatcgagcagagccacaacaccagcgctgacaagcgggagatcctggcccccttccctgtgagagatgagaccttcggcaacacagccctgctgaagaaggccgagagcggggagtgccagctgagcacccagaacctgatccagatggctgctgaggacagccaccccctggaccccaccagccagctgagcaggaagggcagctttggagatgtggccagccccccccaggacatgctgttcccccaggatgcccacctggtgccccaggcccgggtgcaccccagccagacagagatcagcgagaccgtggagaaggtgatcctgccccccaggcctgtgctgaatgatgtgtctgctgccctgcagaagctgtgtggggaggtgtggctgagctacccagctggccgggaggtgggccctggagaggtgaaccctgagttccctgaggccgtgcagcctgtgtgcagccccctgaaccccccaggagtcatcagcccctgggccaccatggacaccatcgtgcctgacaggaaggacttctacagcagcaatgtggtgcctgacaagacccatgaggtgggcagctacctggccgcccagatgagccccagcgaccagaccctgagcagctttgccagcatcgtggcccagtatggcaagggcctgccccaggaggtggaggagatcgtgcgggagaccatcgtgcagcccaagtctgagttcctggagttctctgctggcctggagaagctgctgaaggaggagacagagaccttccccagcaaatatgaaagtgacaccggcaacctgagccccagcaagctgattggcagcacagaggagccccggcgggccaccagcgagtgccaccctgaggagctgaaggagaccgtggagaaggccgaggcccccctcatcacagaaagtgcctttgatgctggctttgagaagctgctgaaggagatcacagaggccccaccctaccagccccaggtgtctgtgcgggaggagacccatgagaaggagagcagccagagcgagcagacccgcttcctgggcaccgtgccccacttctacagagctgccagccagaccagcgagatgaaggacaagagcaatggcctggagagccaggtgaaccagtgtgacaagatgctgggcggagatgccctggtgacagacctgctggtggacttctgtggcagccgcagcggcgtggagatccccaggaccccccagctgtatgtggcccacgagatcggcaccatcaagacagtgaccccacctgaggaccgggacagcgagagcggcgtggccggcggccagggcaccctgcaggagcccggctttggagaggccagcgaggccatctctgtgtccaggaaccggcagcccatccccctgctgatgaacaaggagaacagcaccaagaccagcaaggtggagctgaccctggccagcccctacatgaagcaggagaaggaggaggagaaggagggcttcagcgagagtgacttcagtgatggcaacaccagcagcaatgctgagagctggaggaaccccagcagcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgtgtccacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172321 - DNA, 1098 bp, Artificial Sequence
  Description of Artificial Sequence: Synthetic coding sequence
atgtctgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccattgaatatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagagaaattccttcctgggggaggtggagctggacctggagacctgggactgggacaacaagcagaacaagcagctgcgctggtaccccctgaagaggaagacagcccctgtggccctggaggccgagaacagaggagagatgaagctggccctgcagtatgtgcctgagcctgtgcctgggaagaagctgcccaccaccggggaggtgcacatctgggtgaaggaatgtctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgagaattggatttggaacaggcaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172322 - DNA, 2733 bp, Artificial Sequence
  Description of Artificial Sequence: Synthetic coding sequence
atgattgacctgtccttcctgacagaggaggagcaggaggccatcatgaaggtgctgcagagagatgctgccctgaagagagctgaggaggagcgggtgcgccacctgcctgagaagatcaaggatgaccagcagctgaagaacatgagcggccagtggttctatgaggccaaggccaagaggcaccgggacaagatccatggagctgacatcatccgggcctccatgaggaagaagaggccccagattgctgctgagcagagcaaggaccgggagaatggagccaaggagagctgggtgaacaacgtgaacaaggatgccttcctgcccccagagctggccggcgtggtggaggagcctgaggaggatgctgccccagccagccccagcagctctgtggtgaacccagccagctctgtgattgacatgagccaggagaacaccaggaagcccaacgtgtccccagagaagaggaagaaccccttcaacagcagcaagctgcctgagggccacagcagccagcagaccaagaatgagcagagcaagaatggaagaacaggcctcttccagaccagcaaggaggatgagctgtctgagagcaaggagaagagcacagtggccgacaccagcatccagaagctggagaagagcaagcagaccctgcccggcctgagcaatggcagccagatcaaggcccccatccccaaggccaggaagatgatctacaagagcacagacctgaacaaggatgacaaccagagcttcccccggcagaggacagacagcctgaaggcccggggggccccccggggcatcctgaagaggaacagcagcagcagcagcacagacagcgagaccctgcgctacaaccacaactttgagcccaagagcaagatcgtgtccccaggcctgaccatccacgagcgcatcagcgagaaggagcacagcctggaggacaacagcagccccaacagcctggagcccctgaagcacgtgcgcttctctgctgtgaaggatgagctgccccagagccctggcctcatccacggccgggaggtgggggagttctctgtgctggagagtgaccggctgaagaatggcatggaggatgctggggacacagaggagttccagagcgaccccaagcccagccagtacaggaagcccagcctcttccaccagagcaccagcagcccctacgtgtccaagtctgagacccaccagcccatgaccagcggcagcttccccatcaatggcctgcacagccacagcgaggtgctgacagcccggccccagagcatggagaacagccccaccatcaatgagcccaaggacaagagcagcgagctgacccggctggagagcgtgctgcccaggagccctgcagatgagctgagccactgtgtggagcctgagcccagccaggtgcctgggggcagcagccgggaccggcagcagggcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgatgagaagccagaccagaagcctgtgaccaatgaatgtgtgccccgcatcagcacagtgcccacccagcctgacaaccccttcagccacccagacaagctgaagaggatgagcaagtctgtgcctgccttcctgcaggatgaggtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172323 - DNA, 2733 bp, Artificial Sequence; identical to SEQ ID NO: 172322
  Description of Artificial Sequence: Synthetic coding sequence

SEQ ID NO: 172324 - DNA, 192 bp, Artificial Sequence
  Description of Artificial Sequence: Synthetic coding sequence
atgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggctag

SEQ ID NO: 172325 - DNA, 3771 bp, Artificial Sequence
  Description of Artificial Sequence: Synthetic coding sequence
atggatgagcccaatgctgagcaggtgtacaaccccagccagtttgagaacctgaggaagttctgggacctggaggccaacagcaacagcaaggacaatgacaagaacatcaccaccaccagccagaagaacagcgcccccttcaaccggcagaagcacaaggagttcagtgacatcaagctgagcggcaagaacacccatgaagctgaggtgctgctgagccccaagaaggtgatggcccgggaggagatggagaagctgaacagcaagggcatcctgcaggtgctgcctgatgagatcaccttccccctgagccccctgaggaagtacacctaccagctgcctggaaatgaaagcagcaaagaaaatgtggagaagaacacagagggcatcgtgacccctgtgttcaaggaggagaaggactacagcgagcaggagatccaggagagcatcatcaagaccaacgtgctgagcaaggactgcaaggacaccttcaatgacagcctgcagaagctgctgtctgagaccagcaccccagccatccagcccagcggcggcaaggtgcacggcaagcaggtgctggagcccagcgtgtctgagaacagaacctggccccagaagacagactttgctgacacagaggaggaggtgaagggccctgagaagatcatcaatgaacatgtggacaagacagtggtgcaccccaaggtgaagaggaacagcctgacagccagcctggacaagctgctgaaggaggccaccggcaccagccccagccccctgcaggccaagctggcccctgtgatcaccggcaccaacagcaagctggaggagggccgcttcttcggcaagggcatcgagcagagccacaacaccagcgctgacaagcgggagatcctggcccccttccctgtgagagatgagaccttcggcaacacagccctgctgaagaaggccgagagcggggagtgccagctgagcacccagaacctgatccagatggctgctgaggacagccaccccctggaccccaccagccagctgagcaggaagggcagctttggagatgtggccagccccccccaggacatgctgttcccccaggatgcccacctggtgccccaggcccgggtgcaccccagccagacagagatcagcgagaccgtggagaaggtgatcctgccccccaggcctgtgctgaatgatgtgtctgctgccctgcagaagctgtgtggggaggtgtggctgagctacccagctggccgggaggtgggccctggagaggtgaaccctgagttccctgaggccgtgcagcctgtgtgcagccccctgaaccccccaggagtcatcagcccctgggccaccatggacaccatcgtgcctgacaggaaggacttctacagcagcaatgtggtgcctgacaagacccatgaggtgggcagctacctggccgcccagatgagccccagcgaccagaccctgagcagctttgccagcatcgtggcccagtatggcaagggcctgccccaggaggtggaggagatcgtgcgggagaccatcgtgcagcccaagtctgagttcctggagttctctgctggcctggagaagctgctgaaggaggagacagagaccttccccagcaaatatgaaagtgacaccggcaacctgagccccagcaagctgattggcagcacagaggagccccggcgggccaccagcgagtgccaccctgaggagctgaaggagaccgtggagaaggccgaggcccccctcatcacagaaagtgcctttgatgctggctttgagaagctgctgaaggagatcacagaggccccaccctaccagccccaggtgtctgtgcgggaggagacccatgagaaggagagcagccagagcgagcagacccgcttcctgggcaccgtgccccacttctacagagctgccagccagaccagcgagatgaaggacaagagcaatggcctggagagccaggtgaaccagtgtgacaagatgctgggcggagatgccctggtgacagacctgctggtggacttctgtggcagccgcagcggcgtggagatccccaggaccccccagctgtatgtggcccacgagatcggcaccatcaagacagtgaccccacctgaggaccgggacagcgagagcggcgtggccggcggccagggcaccctgcaggagcccggctttggagaggccagcgaggccatctctgtgtccaggaaccggcagcccatccccctgctgatgaacaaggagaacagcaccaagaccagcaaggtggagctgaccctggccagcccctacatgaagcaggagaaggaggaggagaaggagggcttcagcgagagtgacttcagtgatggcaacaccagcagcaatgctgagagctggaggaaccccagcagcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgtgtccacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172326 - DNA, 1131 bp, Artificial Sequence
  Description of Artificial Sequence: Synthetic coding sequence
atgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172327 - DNA, 312 bp, Artificial Sequence
  Description of Artificial Sequence: Synthetic coding sequence
atgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagtag

SEQ ID NO: 172328 - DNA, 2709 bp, Artificial Sequence
  Description of Artificial Sequence: Synthetic coding sequence
atgagcggccagtggttctatgaggccaaggccaagaggcaccgggacaagatccatggagctgacatcatccgggcctccatgaggaagaagaggccccagattgctgctgagcagagcaaggaccgggagaatggagccaaggagagctgggtgaacaacgtgaacaaggatgccttcctgcccccagagctggccggcgtggtggaggagcctgaggaggatgctgccccagccagccccagcagctctgtggtgaacccagccagctctgtgattgacatgagccaggagaacaccaggaagcccaacgtgtccccagagaagaggaagaaccccttcaacagcagcaagctgcctgagggccacagcagccagcagaccaagaatgagcagagcaagaatggaagaacaggcctcttccagaccagcaaggaggatgagctgtctgagagcaaggagaagagcacagtggccgacaccagcatccagaagctggagaagagcaagcagaccctgcccggcctgagcaatggcagccagatcaaggcccccatccccaaggccaggaagatgatctacaagagcacagacctgaacaaggatgacaaccagagcttcccccggcagaggacagacagcctgaaggcccggggggccccccggggcatcctgaagaggaacagcagcagcagcagcacagacagcgagaccctgcgctacaaccacaactttgagcccaagagcaagatcgtgtccccaggcctgaccatccacgagcgcatcagcgagaaggagcacagcctggaggacaacagcagccccaacagcctggagcccctgaagcacgtgcgcttctctgctgtgaaggatgagctgccccagagccctggcctcatccacggccgggaggtgggggagttctctgtgctggagagtgaccggctgaagaatggcatggaggatgctggggacacagaggagttccagagcgaccccaagcccagccagtacaggaagcccagcctcttccaccagagcaccagcagcccctacgtgtccaagtctgagacccaccagcccatgaccagcggcagcttccccatcaatggcctgcacagccacagcgaggtgctgacagcccggccccagagcatggagaacagccccaccatcaatgagcccaaggacaagagcagcgagctgacccggctggagagcgtgctgcccaggagccctgcagatgagctgagccactgtgtggagcctgagcccagccaggtgcctgggggcagcagccgggaccggcagcagggcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgatgagaagccagaccagaagcctgtgaccaatgaatgtgtgccccgcatcagcacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172329 - DNA, 483 bp, Artificial Sequence
  Description of Artificial Sequence: Synthetic coding sequence
atgagcaagtctgtgcctgccttcctgcaggatgaggtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagtag

SEQ ID NO: 172330 - DNA, 2805 bp, Artificial Sequence
  Description of Artificial Sequence: Synthetic coding sequence
atgattgacctgtccttcctgacagaggaggagcaggaggccatcatgaaggtgctgcagagagatgctgccctgaagagagctgaggaggagcgggtgcgccacctgcctgagaagatcaaggatgaccagcagctgaagaacatgagcggccagtggttctatgaggccaaggccaagaggcaccgggacaagatccatggagctgacatcatccgggcctccatgaggaagaagaggccccagattgctgctgagcagagcaaggaccgggagaatggagccaaggagagctgggtgaacaacgtgaacaaggatgccttcctgcccccagagctggccggcgtggtggaggagcctgaggaggatgctgccccagccagccccagcagctctgtggtgaacccagccagctctgtgattgacatgagccaggagaacaccaggaagcccaacgtgtccccagagaagaggaagaaccccttcaacagcagcaagctgcctgagggccacagcagccagcagaccaagaatgagcagagcaagaatggaagaacaggcctcttccagaccagcaaggaggatgagctgtctgagagcaaggagaagagcacagtggccgacaccagcatccagaagctggagaagagcaagcagaccctgcccggcctgagcaatggcagccagatcaaggcccccatccccaaggccaggaagatgatctacaagagcacagacctgaacaaggatgacaaccagagcttcccccggcagaggacagacagcctgaaggcccggggggccccccggggcatcctgaagaggaacagcagcagcagcagcacagacagcgagaccctgcgctacaaccacaactttgagcccaagagcaagatcgtgtccccaggcctgaccatccacgagcgcatcagcgagaaggagcacagcctggaggacaacagcagccccaacagcctggagcccctgaagcacgtgcgcttctctgctgtgaaggatgagctgccccagagccctggcctcatccacggccgggaggtgggggagttctctgtgctggagagtgaccggctgaagaatggcatggaggatgctggggacacagaggagttccagagcgaccccaagcccagccagtacaggaagcccagcctcttccaccagagcaccagcagcccctacgtgtccaagtctgagacccaccagcccatgaccagcggcagcttccccatcaatggcctgcacagccacagcgaggtgctgacagcccggccccagagcatggagaacagccccaccatcaatgagcccaaggacaagagcagcgagctgacccggctggagagcgtgctgcccaggagccctgcagatgagctgagccactgtgtggagcctgagcccagccaggtgcctgggggcagcagccgggaccggcagcagggcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgtgtccacagtgcccacccagcctgacaaccccttcagccacccagacaagctgaagaggatgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172331 - DNA, 468 bp, Artificial Sequence
  Description of Artificial Sequence: Synthetic coding sequence
atgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagtag

SEQ ID NO: 172332 - DNA, 1131 bp, Artificial Sequence; identical to SEQ ID NO: 172326
  Description of Artificial Sequence: Synthetic coding sequence

SEQ ID NO: 172333 - DNA, 1956 bp, Artificial Sequence
  Description of Artificial Sequence: Synthetic coding sequence
gagaccgtggagaaggccgaggcccccctcatcacagagagcgcctttgatgctggctttgagaagctgctgaaggagatcacagaggccccaccctaccagccccaggtgtctgtgcgggaggagacccatgagaaggagagcagccagagcgagcagacccgcttcctgggcaccgtgccccacttctaccgggccgccagccagaccagcgagatgaaggacaagagcaatggcctggagagccaggtgaaccagtgtgacaagatgctgggcggagatgccctggtgacagacctgctggtggacttctgtggcagccgctctggagtggagatccccaggaccccccagctgtatgtggcccatgaaattggcaccatcaagacagtgaccccaccagaagatcgggacagcgagagcggcgtggccggcggccagggcaccctgcaggagcccggctttggagaggccagcgaggccatctctgtgtccaggaaccggcagcccatccccctgctgatgaacaaggagaacagcaccaagaccagcaaggtggagctgaccctggccagcccctacatgaagcaggagaaggaggaggagaaggagggcttcagcgagagtgacttcagtgatggcaacaccagcagcaatgctgagagctggaggaaccccagcagcagcgaggaggagcccagccctgtgctgaagaccctggagaggtctgctgccaggaagatgcccagcaagagcctggaggacatcagcagtgacagcagcaaccaggccaaggtggacaaccagcctgaggagctggtgcgctctgcagaagatgatgagaagccagaccagaagcctgtgaccaatgaatgtgtgccccgcatcagcacagtgcccacccagcctgacaaccccttcagccacccagacaagctgaagaggatgagcaagtctgtgcctgccttcctgcaggatgaggtgtctggctctgtgatgtctgtgtacagcggggactttggaaacctggaggtgaagggcaacatccagtttgccattgaatatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagagaaattccttcctgggggaggtggagctggacctggagacctgggactgggacaacaagcagaacaagcagctgcgctggtaccccctgaagaggaagacagcccctgtggccctggaggccgagaacagaggagagatgaagctggccctgcagtatgtgcctgagcctgtgcctgggaagaagctgcccaccaccggggaggtgcacatctgggtgaaggaatgtctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgagaattggatttggaacaggcaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172334 - DNA, 213 bp, Artificial Sequence
  Description of Artificial Sequence: Synthetic coding sequence
atgagcaagtctgtgcctgccttcctgcaggatgaaagtgatgaccgggagacagacacagccagcgagagcagctaccagctgagccgccacaagaagagccccagcagcctgaccaacctgagcagcagcagcggcatgaccagcctgagctctgtgtctggctctgtgatgtctgtgtacagcggggactttggaaacctggaggtgtag

SEQ ID NO: 172335 - DNA, 1011 bp, Artificial Sequence
  Description of Artificial Sequence: Synthetic coding sequence
atgagcaagtctgtgcctgccttcctgcaggatgaggtgtctggctctgtgatgtctgtgtacagcggggactttggaaacctggaggtgaagggcaacatccagtttgccatcgagtatgtggagagcctgaaggagctgcacgtgtttgtggcccagtgcaaggacctggccgctgctgatgtgaagaagcagaggagtgacccctacgtgaaggcctacctgctgcctgacaagggcaagatgggcaagaagaagaccctggtggtgaagaagaccctgaaccctgtgtacaatgagatcctgcgctacaagattgagaagcagatcctgaagacccagaagctgaacctgagcatctggcaccgggacaccttcaagaggaacagcttcctgggggaggtggagctggacctggagacctgggactgggacaacaagcagaacaagcagctgcgctggtaccccctgaagaggaagacagcccctgtggccctggaggctgaaaatagaggagagatgaagctggccctgcagtatgtgcctgagcctgtgcctgggaagaagctgcccaccactggagaggtgcacatctgggtgaaggagtgcctggacctgcccctgctgcggggcagccacctgaacagctttgtgaagtgcaccatcctgcctgacaccagcaggaagagccggcagaagaccagggctgtgggcaagaccaccaaccccatcttcaaccacaccatggtgtatgatggcttccggcctgaggacctgatggaggcctgtgtggagctgactgtgtgggaccactacaagctgaccaaccagttcctgggcggcctgcgcatcggcttcggcaccgggaagagctatggaacagaggtggactggatggacagcaccagcgaggaggtggccctgtgggagaagatggtgaacagccccaacacctggattgaggccaccctgcccctgaggatgctgctgattgccaagatcagcaagtag

SEQ ID NO: 172336 - DNA, 2016 bp, Artificial Sequence
  Description of Artificial Sequence: Synthetic coding sequence
atgtctgagctgctggacctgtccttcctgtctgaggaggagaaggacctgatcctgtctgtgctgcagagagatgaggaggtgaggaaggcagatgagaagaggatccggcggctgaagaatgagctgctggagatcaagaggaaaggagccaagaggggcagccagcactacagcgacaggacctgtgcccgctgccaggagagcctgggccgcctgagccccaagaccaacacctgccggggctgcaaccacctggtgtgccgggactgccgcatccaggagagcaatggcacctggcgctgcaaggtgtgtgccaaggagattgagctgaagaaggccactggagactggttctatgaccagaaggtgaacagatttgcctacagaactggaagtgagatcatccgcatgagcctgcggcacaagccagctgtgtccaagcgggagaccgtgggccagagcctgctgcaccagacccagatgggagacatctggccaggcaggaagatcatccaggagcggcagaaggagcccagcgtgctgtttgaggtgcccaagctgaagagcggcaagagcgccctggaggccgagagcgagagcctggacagcttcaccgctgacagcgacagcaccagccggcgggacagcctggacaagagcggcctcttccctgagtggaagaagatgtctgcccccaagagccaggtggagaaggagacccagcccggcggccagaatgtggtgtttgtggatgaaggagagatgatcttcaagaagaacaccaggaagatcctgcggcccagcgagtacaccaagagcgtcatcgacctgcggccagaagatgtggtgcatgaaagtggcagcctgggggacaggagcaagtctgtgcccggcctgaatgtggacatggaggaggaggaggaggaggaggacatcgaccacctggtgaagctgcaccggcagaagctggcccggagctccatgcagagcggcagctccatgagcaccatcggctccatgatgagcatctacagcgaggccggggactttggaaacatctttgtgacaggccgcatcgccttcagcctgaagtatgagcagcagacccagagcctggtggtgcacgtgaaggagtgccaccagctggcctatgcagatgaggccaagaagaggagcaacccctacgtgaagacctacctgctgcctgacaagagccggcagggcaagaggaagaccagcatcaagagggacaccatcaaccccctgtatgatgagaccctgcgctatgagatccctgagagcctgctggcccagaggaccctgcagttctctgtgtggcaccacggccgcttcggcaggaacaccttcctgggggaggccgagatccagatggacagctggaagctggacaagaagctggaccactgcctgcccctgcacggcaagatctctgctgagagccccaccggcctgcccagccacaagggggagctggtggtgtccctgaagtacatcccagccagcaagacccctgtgggcggggacaggaagaagagcaaaggaggagagggcggggagctgcaggtgtggatcaaggaggccaagaacctgacagctgccaaggccggcggcaccagtgacagctttgtgaagggctacctgctgcccatgaggaacaaggccagcaagaggaagacccctgtgatgaagaagaccctgaacccccactacaaccacacctttgtgtacaatggagtgcggctggaggacctgcagcacatgtgcctggagctgactgtgtgggaccgggagcccctggccagcaatgacttcctgggcggcgtgcggctgggcgtgggcaccggcatcagcaatggagaggtggtggactggatggacagcactggagaggaggtgtccctgtggcagaagatgaggcagtacccaggctcctgggccgagggcaccctgcagctgcggagctccatggccaagcagaagctgggcctgtag

SEQ ID NO: 172337 - DNA, 2016 bp, Artificial Sequence; identical to SEQ ID NO: 172336
  Description of Artificial Sequence: Synthetic coding sequence

SEQ ID NO: 172338 - DNA, 1050 bp, Artificial Sequence
  Description of Artificial Sequence: Synthetic coding sequence
atgtctgagctgctggacctgtccttcctgtctgaggaggagaaggacctgatcctgtctgtgctgcagagagatgaggaggtgaggaaggcagatgagaagaggatccggcggctgaagaatgagctgctggagatcaagaggaaaggagccaagaggggcagccagcactacagcgacaggacctgtgcccgctgccaggagagcctgggccgcctgagccccaagaccaacacctgccggggctgcaaccacctggtgtgccgggactgccgcatccaggagagcaatggcacctggcgctgcaaggtgtgtgccaaggagattgagctgaagaaggccactggagactggttctatgaccagaaggtgaacagatttgcctacagaactggaagtgagatcatccgcatgagcctgcggcacaagccagctgtgtccaagcgggagaccgtgggccagagcctgctgcaccagacccagatgggagacatctggccaggcaggaagatcatccaggagcggcagaaggagcccagcgtgctgtttgaggtgcccaagctgaagagcggcaagagcgccctggaggccgagagcgagagcctggacagcttcaccgctgacagcgacagcaccagccggcgggacagcctggacaagagcggcctcttccctgagtggaagaagatgtctgcccccaagagccaggtggagaaggagacccagcccggcggccagaatgtggtgtttgtggatgaaggagagatgatcttcaagaagaacaccaggaagatcctgcggcccagcgagtacaccaagagcgtcatcgacctgcggccagaagatgtggtgcatgaaagtggcagcctgggggacaggagcaagtctgtgcccggcctgaatgtggacatggaggaggaggaggaggaggaggacatcgaccacctggtgaagctgcaccggcagaagctggcccggagctccatgcagagcggcagctccatggtgagcagcatccgctctgtggtgacaggcatgctgggctactag

SEQ ID NO: 172339 - DNA, 2016 bp, Artificial Sequence; identical to SEQ ID NO: 172336
  Description of Artificial Sequence: Synthetic coding sequence

SEQ ID NO: 172340 - DNA, 2022 bp, Artificial Sequence
  Description of Artificial Sequence: Synthetic coding sequence
atgtctgagctgctggacctgtccttcctgtctgaggaggagaaggacctgatcctgtctgtgctgcagagagatgaggaggtgaggaaggcagatgagaagaggatccggcggctgaagaatgagctgctggagatcaagaggaaaggagccaagaggggcagccagcactacagcgacaggacctgtgcccgctgccaggagagcctgggccgcctgagccccaagaccaacacctgccggggctgcaaccacctggtgtgccgggactgccgcatccaggagagcaatggcacctggcgctgcaaggtgtgtgccaaggagattgagctgaagaaggccactggagactggttctatgaccagaaggtgaacagatttgcctacagaactggaagtgagatcatccgcatgagcctgcggcacaagccagctgtgtccaagcgggagaccgtgggccagagcctgctgcaccagacccagatgggagacatctggccaggcaggaagatcatccaggagcggcagaaggagcccagctctgtgctgtttgaggtgcccaagctgaagagcggcaagagcgccctggaggccgagagcgagagcctggacagcttcaccgctgacagcgacagcaccagcagaagagacagcctggacaagagcggcctcttccctgagtggaagaagatgtctgcccccaagagccaggtggagaaggagacccagcccggcggccagaatgtggtgtttgtggatgaaggagagatgatcttcaagaagaacaccaggaagatcctgcggcccagcgagtacaccaagtctgtgattgacctgcggccagaagatgtggtgcatgagagcggcagcctgggggacaggagcaagtctgtgcccggcctgaatgtggacatggtggaggaggaggaggaggaggaggacatcgaccacctggtgaagctgcaccggcagaagctggcccggagctccatgcagagcggcagctccatgagcaccatcggctccatgatgagcatctacagcgaggccggggactttggaaacatctttgtgacaggccgcatcgccttcagcctgaagtatgagcagcagacccagagcctggtggtgcacgtgaaggagtgccaccagctggcctatgcagatgaggccaagaagaggagcaacccctacgtgaagacctacctgctgcctgacaagagccggcagggcaagaggaagaccagcatcaagagggacaccatcaaccccctgtatgatgagaccctgcgctatgagatccctgagagcctgctggcccagaggaccctgcagttctctgtgtggcaccacggccgcttcggcaggaacaccttcctgggggaggccgagatccagatggacagctggaagctggacaagaagctggaccactgcctgcccctgcacggcaagatctctgctgagagccccaccggcctgcccagccacaagggggagctggtggtgtccctgaagtacatcccagccagcaagacccctgtgggcggggacaggaagaagagcaaaggaggagagggcggggagctgcaggtgtggatcaaggaggccaagaacctgacagctgccaaggccggcggcaccagtgacagctttgtgaagggctacctgctgcccatgaggaacaaggccagcaagaggaagacccctgtgatgaagaagaccctgaacccccactacaaccacacctttgtgtacaatggagtgcggctggaggacctgcagcacatgtgcctggagctgactgtgtgggaccgggagcccctggccagcaatgacttcctgggcggcgtgcggctgggcgtgggcaccggcatcagcaatggagaggtggtggactggatggacagcactggagaggaggtgtccctgtggcagaagatgaggcagtacccaggctcctgggccgagggcaccctgcagctgcggagctccatggccaagcagaagctgggcctgtag

SEQ ID NO: 172341 - DNA, 2016 bp, Artificial Sequence; identical to SEQ ID NO: 172336
  Description of Artificial Sequence: Synthetic coding sequence

SEQ ID NO: 172342 - DNA, 933 bp, Artificial Sequence
  Description of Artificial Sequence: Synthetic coding sequence
atgaggcgggccgccctgtggctgtggctgtgtgccctggccctgagcctgcagcctgccctgccccagatcgtggccaccaacctgcccccagaggaccaggacggcagcggagatgacagcgacaacttcagcggcagcggggccggggccctgcaggacatcaccctgagccagcagacccccagcacctggaaggacacccagctgctgacagccatccccaccagccctgagcccaccggcctggaggccacagctgccagcaccagcaccctgcctgctggggagggccccaaggagggggaggccgtggtgctgcctgaggtggagcccggcctgacagcccgggagcaggaggccaccccccggccccgggagaccacccagctgcccaccacccacctggccagcaccaccacagccaccacagcccaggagcccgccaccagccacccccaccgggacatgcagcccggccaccacgagaccagcaccccagctggccccagccaggccgacctgcacaccccccacacagaagatggcggccccagcgccacagaaagagctgctgaagatggagccagcagccagctgcctgctgctgagggcagcggggagcaggacttcacctttgagaccagcggggagaacacagctgtggtggccgtggagccagacagaagaaaccagagccctgtggaccagggcgccaccggggccagccagggcctgctggacaggaaggaggtgctgggcggcgtgattgctgggggcctggtgggcctcatctttgctgtgtgcctggtgggcttcatgctgtacaggatgaagaagaaggatgagggcagctacagcctggaggagcccaagcaggccaatggaggagcctaccagaagcccaccaagcaggaggagttctacgcctag

SEQ ID NO: 172343 - DNA, 933 bp, Artificial Sequence; identical to SEQ ID NO: 172342
  Description of Artificial Sequence: Synthetic coding sequence

SEQ ID NO: 172344 - DNA, 606 bp, Artificial Sequence
  Description of Artificial Sequence: Synthetic coding sequence
atgaggcgggcctggatcctgctgaccctgggcctggtggcctgtgtgtctgctgagagcagagctgagctgaccagtgacaaggacatgtacctggacaacagcagcattgaggaggccagcggcgtgtaccccattgatgatgatgattatgccagcgccagcggcagcggggctgatgaagatgtggagagccctgagctgaccaccagccggcccctgcccaagatcctgctgaccagcgctgcccccaaggtggagaccaccaccctgaacatccagaacaagatcccagcccagaccaagagccctgaggagacagacaaggagaaggtgcacctgagtgacagcgagaggaagatggaccctgctgaggaggacaccaacgtgtacacagagaagcacagcgacagcctcttcaagaggacagaggtgctggccgctgtgattgctggaggagtgattggcttcctgtttgccatcttcctgatcctgctgctggtgtacaggatgaggaagaaggatgagggcagctatgacctgggggagaggaagcccagcagcgctgcctaccagaaggcccccaccaaggagttctacgcctag

SEQ ID NO: 172345 - DNA, 498 bp, Artificial Sequence
  Description of Artificial Sequence: Synthetic coding sequence
atgaggcgggcctggatcctgctgaccctgggcctggtggcctgtgtgtctgctgagagcgtgcgggcagatgaagatgtggagagccctgagctgaccaccagccggcccctgcccaagatcctgctgaccagcgctgcccccaaggtggagaccaccaccctgaacatccagaacaagatcccagcccagaccaagagccctgaggagacagacaaggagaaggtgcacctgagtgacagcgagaggaagatggaccctgctgaggaggacaccaacgtgtacacagagaagcacagcgacagcctcttcaagaggacagaggtgctggccgctgtgattgctggaggagtgattggcttcctgtttgccatcttcctgatcctgctgctggtgtacaggatgaggaagaaggatgagggcagctatgacctgggggagaggaagcccagcagcgctgcctaccagaaggcccccaccaaggagttctacgcctag

SEQ ID NO: 172346 - DNA, 519 bp, Artificial Sequence
  Description of Artificial Sequence: Synthetic coding sequence
atgtacctggacaacagcagcattgaggaggccagcggcgtgtaccccattgatgatgatgattatgccagcgccagcggcagcggggctgatgaagatgtggagagccctgagctgaccaccagccggcccctgcccaagatcctgctgaccagcgctgcccccaaggtggagaccaccaccctgaacatccagaacaagatcccagcccagaccaagagccctgaggagacagacaaggagaaggtgcacctgagtgacagcgagaggaagatggaccctgctgaggaggacaccaacgtgtacacagagaagcacagcgacagcctcttcaagaggacagaggtgctggccgctgtgattgctgggggcgtcatcggcttcctgtttgccatcttcctgatcctgctgctggtgtacaggatgaggaagaaggatgagggcagctatgacctgggggagaggaagcccagcagcgctgcctaccagaaggcccccaccaaggagttctacgcctag

SEQ ID NO: 172347 - DNA, 519 bp, Artificial Sequence; identical to SEQ ID NO: 172346
  Description of Artificial Sequence: Synthetic coding sequence

SEQ ID NO: 172348 - DNA, 606 bp, Artificial Sequence; identical to SEQ ID NO: 172344
  Description of Artificial Sequence: Synthetic coding sequence

SEQ ID NO: 172349 - DNA, 576 bp, Artificial Sequence
  Description of Artificial Sequence: Synthetic coding sequence
atgagggtggcctgtgtgtctgctgagagcagagctgagctgaccagtgacaaggacatgtacctggacaacagcagcattgaggaggccagcggcgtgtaccccattgatgatgatgattatgccagcgccagcggcagcggggctgatgaagatgtggagagccctgagctgaccaccagccggcccctgcccaagatcctgctgaccagcgctgcccccaaggtggagaccaccaccctgaacatccagaacaagatcccagcccagaccaagagccctgaggagacagacaaggagaaggtgcacctgagtgacagcgagaggaagatggaccctgctgaggaggacaccaacgtgtacacagagaagcacagcgacagcctcttcaagaggacagaggtgctggccgctgtgattgctggaggagtgattggcttcctgtttgccatcttcctgatcctgctgctggtgtacaggatgaggaagaaggatgagggcagctatgacctgggggagaggaagcccagcagcgctgcctaccagaaggcccccaccaaggagttctacgcctag

SEQ ID NO: 172350 - DNA, 1155 bp, Artificial Sequence
  Description of Artificial Sequence: Synthetic coding sequence
atggccatcgcctacctgggcagcagctgccccagccagccccccagcagcctggccctgagcctgagccccacccccagcgactttgagcaggagagcggcattgaaacagccatgaggttctccccagatgtggccctggccgtgtccaccaccccagctgtgctgcccaccaccaacatccagcctgtgggcaccccatttgaggagctgcccagcgagcggcccaccctggagcccgccaccagccccctggtggtgacagaggtgcctgaggagcccagccagagggccaccaccgtgtccaccaccatggccaccacagctgccaccagcactggagaccccaccgtggccaccgtgcctgccaccgtggccacagccacccccagcaccccagctgccccacccttcaccgccaccacagctgtgatccgcaccaccggggtgcggcggctgctgcccctgcccctgaccaccgtggccacagcccgggccaccaccccagaggcccccagcccccccaccacagctgctgtgctggacacagaggcccccaccccccggctggtgtccacagccaccagccggccccgggccctgcccaggcctgccaccacccaggagccagacatccctgagaggagcaccctgcccctgggcaccacagcccctggccccacagaggtggcccagacccccaccccagagaccttcctgaccaccatcagagatgagcctgaggtgcctgtgtctgggggccccagcggggactttgagctgcctgaggaggagaccacccagcctgacacagccaatgaggtggtggccgtgggcggggccgccgccaaggccagcagccccccaggcaccctgcccaagggggcccggcccggccctggcctgctggacaatgccattgattctggcagcagcgctgcccagctgccccagaagagcatcctggagaggaaggaggtgctggtggccgtcatcgtgggcggcgtggtgggcgccctgtttgctgccttcctggtgaccctgctgatctacaggatgaagaagaaggatgagggcagctacaccctggaggagcccaagcaggcctctgtgacctaccagaagccagacaagcaggaggagttctacgcctag

SEQ ID NO: 172351 - DNA, 1329 bp, Artificial Sequence
  Description of Artificial Sequence: Synthetic coding sequence
atgaagccaggccccccccacagagctggagctgcccatggagctggagctggagctggagctgctgctggccctggggcccggggcctgctgctgccccccctgctgctgctgctgctggccggccgggctgctggggcccagcgctggaggagtgaaaattttgagaggcctgtggacctggagggcagcggagatgatgacagcttcccagatgatgagctggatgacctgtacagcggcagcggcagcggctactttgagcaggagagcggcattgaaacagccatgaggttctccccagatgtggccctggccgtgtccaccaccccagctgtgctgcccaccaccaacatccagcctgtgggcaccccatttgaggagctgcccagcgagcggcccaccctggagcccgccaccagccccctggtggtgacagaggtgcctgaggagcccagccagagggccaccaccgtgtccaccaccatggccaccacagctgccaccagcactggagaccccaccgtggccaccgtgcctgccaccgtggccacagccacccccagcaccccagctgccccacccttcaccgccaccacagctgtgatccgcaccaccggggtgcggcggctgctgcccctgcccctgaccaccgtggccacagcccgggccaccaccccagaggcccccagcccccccaccacagctgctgtgctggacacagaggcccccaccccccggctggtgtccacagccaccagccggccccgggccctgcccaggcctgccaccacccaggagccagacatccctgagaggagcaccctgcccctgggcaccacagcccctggccccacagaggtggcccagacccccaccccagagaccttcctgaccaccatcagagatgagcctgaggtgcctgtgtctgggggccccagcggggactttgagctgcctgaggaggagaccacccagcctgacacagccaatgaggtggtggccgtgggcggggccgccgccaaggccagcagccccccaggcaccctgcccaagggggcccggcccggccctggcctgctggacaatgccattgattctggcagcagcgctgcccagctgccccagaagagcatcctggagaggaaggaggtgctggtggccgtcatcgtgggcggcgtggtgggcgccctgtttgctgccttcctggtgaccctgctgatctacaggatgaagaagaaggatgagggcagctacaccctggaggagcccaagcaggcctctgtgacctaccagaagccagacaagcaggaggagttctacgcctag

SEQ ID NO: 172352 - DNA, 597 bp, Artificial Sequence
  Description of Artificial Sequence: Synthetic coding sequence
atggccccagcccggctgtttgccctgctgctcttctttgtgggcggcgtggccgagagcatccgggagacagaggtgattgacccccaggacctgctggagggccgctacttcagcggggccctgcctgatgatgaagatgtggtgggccctggccaggagagtgatgactttgagctgagcggcagcggggacctggatgacctggaggacagcatgattggccctgaggtggtgcaccccctggtgcccctggacaaccacatccctgagagagctggcagcggcagccaggtgcccacagagcccaagaagctggaggagaatgaagtcatccccaagaggatcagccctgtggaggagagtgaagatgtgagcaacaaggtgtccatgagcagcacagtgcagggcagcaacatctttgagaggacagaggtgctggccgccctgattgtgggcggcatcgtgggcatcctgtttgctgtgttcctgatcctgctgctgatgtacaggatgaagaagaaggatgagggcagctatgacctgggcaagaagcccatctacaagaaggcccccaccaatgagttctacgcctag

SEQ ID NO: 172353 - DNA, 381 bp, Artificial Sequence
  Description of Artificial Sequence: Synthetic coding sequence
atgattggccctgaggtggtgcaccccctggtgcccctggacaaccacatccctgagagagctggcagcggcagccaggtgcccacagagcccaagaagctggaggagaatgaagtcatccccaagaggatcagccctgtggaggagagtgaagatgtgagcaacaaggtgtccatgagcagcacagtgcagggcagcaacatctttgagaggacagaggtgctggccgccctgattgtgggcggcatcgtgggcatcctgtttgctgtgttcctgatcctgctgctgatgtacaggatgaagaagaaggatgagggcagctatgacctgggcaagaagcccatctacaagaaggcccccaccaatgagttctacgcctag

SEQ ID NO: 172354 - DNA, 1851 bp, Artificial Sequence
  Description of Artificial Sequence: Synthetic coding sequence
atgttcagaacagctgtgatgatggccgccagcctggccctgactggagctgtggtggcccacgcctactacctgaagcaccagttctaccccaccgtggtgtacctgaccaagagcagccccagcatggctgtgctgtacatccaggcctttgtgctggtgttcctgctgggcaaggtgatgggcaaggtgttcttcggccagctgcgggctgctgagatggagcacctgctggagaggtcctggtatgctgtgacagagacctgcctggccttcaccgtcttcagagatgacttcagccccaggtttgtggccctcttcaccctgctgctcttcctgaagtgcttccactggctggctgaagatagagtggacttcatggagaggagccccaacatctcctggctgttccactgcagaattgtgtccctgatgttcctgctgggcatcctggacttcctgtttgtgagccacgcctaccacagcatcctgaccaggggggcctctgtgcagctggtgtttggatttgaatatgccatcctgatgaccatggtgctgaccatcttcatcaagtatgtgctgcacagcgtggacctgcagagcgagaacccctgggacaacaaggctgtgtacatgctgtacacagagctgttcaccggcttcatcaaggtgctgctgtacatggccttcatgaccatcatgatcaaggtgcacaccttccccctgtttgccatccggcccatgtacctggccatgaggcagttcaagaaggctgtgacagatgccatcatgagccggcgggccatccggaacatgaacaccctgtacccagatgccaccccagaggagctgcaggccatggacaacgtgtgcatcatctgccgggaggagatggtgactggagccaagaggctgccctgcaaccacatcttccacaccagctgcctgcgctcctggttccagaggcagcagacctgccccacctgcaggatggatgtgctgcgggccagcctgcctgcccagagccccccacctcctgagcctgctgaccagggccccccaccagccccccaccccccacccctgctgccccagccccccaacttcccccagggcctgctgccccccttccccccaggcatgttccccctgtggccacccatgggccccttcccccctgtgcccccaccacccagcagcggggaggccgtggccccacccagcaccagcgctgccctgagccggcccagcggggccgccaccaccacagctgctggcaccagcgccacagctgccagcgccacagccagcggccctggcagcggcagcgcccctgaggccggccctgcccctggcttccccttccccccaccctggatgggcatgcccctgcccccaccatttgccttcccccccatgcctgtgcccccagctggctttgctggcctgaccccagaggagctgcgggccctggagggccacgagcggcagcacctggaggcccggctgcagagcctgaggaacatccacaccctgctggatgctgccatgctgcagatcaaccagtacctgactgtgctggccagcctgggcccccccaggcctgccacctctgtgaacagcacagaggagacagccaccaccgtggtggccgccgccagcagcaccagcatccccagcagcgaggccaccacccccacccctggggccagccccccagcccctgagatggagcggcccccagcccctgagagcgtgggcacagaggagatgccagaagatggagagccagatgctgctgagctgcggcggcggcggctgcagaagctggagagccctgtggcccactag

SEQ ID NO: 172355 - DNA, 1698 bp, Artificial Sequence
  Description of Artificial Sequence: Synthetic coding sequence
atgttcagaacagctgtgatgatggccgccagcctggccctgactggagctgtggtggcccacgcctactacctgaagcaccagttctaccccaccgtggtgtacctgaccaagagcagccccagcatggctgtgctgtacatccaggcctttgtgctggtgttcctgctgggcaaggtgatgggcaaggtgttcttcggccagctgcgggctgctgagatggagcacctgctggagaggtcctggtatgctgtgacagagacctgcctggccttcaccgtcttcagagatgacttcagccccaggtttgtggccctcttcaccctgctgctcttcctgaagtgcttccactggctggctgaagatagagtggacttctacgccatcctgatgaccatggtgctgaccatcttcatcaagtatgtgctgcacagcgtggacctgcagagcgagaacccctgggacaacaaggctgtgtacatgctgtacacagagctgttcaccggcttcatcaaggtgctgctgtacatggccttcatgaccatcatgatcaaggtgcacaccttccccctgtttgccatccggcccatgtacctggccatgaggcagttcaagaaggctgtgacagatgccatcatgagcagaagagccatccggaacatgaacaccctgtacccagatgccaccccagaggagctgcaggccatggacaacgtgtgcatcatctgccgggaggagatggtgactggagccaagaggctgccctgcaaccacatcttccacaccagctgcctgcgctcctggttccagaggcagcagacctgccccacctgcaggatggatgtgctgcgggccagcctgcctgcccagagccccccacctcctgagcctgctgaccagggccccccaccagccccccaccccccacccctgctgccccagccccccaacttcccccagggcctgctgccccccttccccccaggcatgttccccctgtggccacccatgggccccttcccccctgtgcccccaccacccagcagtggagaggccgtggccccacccagcaccagcgctgccctgagccggcccagcggggccgccaccaccacagctgctggcaccagcgccacagctgccagcgccacagccagcggccctggcagcggcagcgcccctgaggccggccctgcccctggcttccccttccccccaccctggatgggcatgcccctgcccccaccatttgccttcccccccatgcctgtgcccccagctggctttgctggcctgaccccagaggagctgcgggccctggagggccacgagcggcagcacctggaggcccggctgcagagcctgaggaacatccacaccctgctggatgctgccatgctgcagatcaaccagtacctgactgtgctggccagcctgggcccccccaggcctgccacctctgtgaacagcacagaggagacagccaccaccgtggtggccgccgccagcagcaccagcatccccagcagcgaggccaccacccccacccctggggccagccccccagcccctgagatggagcggcccccagcccctgagagcgtgggcacagaggagatgccagaagatggagagccagatgctgctgagctgcggcggcggcggctgcagaagctggagagccctgtggcccactag

SEQ ID NO: 172356 - DNA, 1854 bp, Artificial Sequence
  Description of Artificial Sequence: Synthetic coding sequence
atgttcagaacagctgtgatgatggccgccagcctggccctgactggagctgtggtggcccacgcctactacctgaagcaccagttctaccccaccgtggtgtacctgaccaagagcagccccagcatggctgtgctgtacatccaggcctttgtgctggtgttcctgctgggcaaggtgatgggcaaggtgttcttcggccagctgcgggctgctgagatggagcacctgctggagaggtcctggtatgctgtgacagagacctgcctggccttcaccgtcttcagagatgacttcagccccaggtttgtggccctcttcaccctgctgctcttcctgaagtgcttccactggctggctgaagatagagtggacttcatggagaggagccccaacatctcctggctgttccactgcagaattgtgtccctgatgttcctgctgggcatcctggacttcctgtttgtgagccacgcctaccacagcatcctgaccaggggggcctctgtgcagctggtgtttggatttgaatatgccatcctgatgaccatggtgctgaccatcttcatcaagtatgtgctgcacagcgtggacctgcagagcgagaacccctgggacaacaaggctgtgtacatgctgtacacagagctgttcaccggcttcatcaaggtgctgctgtacatggccttcatgaccatcatgatcaaggtgcacaccttccccctgtttgccatccggcccatgtacctggccatgaggcagttcaagaaggctgtgacagatgccatcatgagccggcgggccatccggaacatgaacaccctgtacccagatgccaccccagaggagctgcaggccatggacaacgtgtgcatcatctgccgggaggagatggtgactggagccaagaggctgccctgcaaccacatcttccacaccagctgcctgcgctcctggttccagaggcagcagacctgccccacctgcaggatggatgtgctgcgggccagcctgcctgcccagagccccccacctcctgagcctgctgaccagggccccccaccagccccccaccccccacccctgctgccccagccccccaacttcccccagggcctgctgccccccttccccccaggcatgttccccctgtggccacccatgggccccttcccccctgtgcccccaccacccagcagcggggaggccgtggccccacccagcaccagcgctgctgccctgagccggcccagcggggccgccaccaccacagctgctggcaccagcgccacagctgccagcgccacagccagcggccctggcagcggcagcgcccctgaggccggccctgcccctggcttccccttccccccaccctggatgggcatgcccctgcccccaccatttgccttcccccccatgcctgtgcccccagctggctttgctggcctgaccccagaggagctgcgggccctggagggccacgagcggcagcacctggaggcccggctgcagagcctgaggaacatccacaccctgctggatgctgccatgctgcagatcaaccagtacctgactgtgctggccagcctgggcccccccaggcctgccacctctgtgaacagcacagaggagacagccaccaccgtggtggccgccgccagcagcaccagcatccccagcagcgaggccaccacccccacccctggggccagccccccagcccctgagatggagcggcccccagcccctgagagcgtgggcacagaggagatgccagaagatggagagccagatgctgctgagctgcggcggcggcggctgcagaagctggagagccctgtggcccactag

SEQ ID NO: 172357 - DNA, 1890 bp, Artificial Sequence
  Description of Artificial Sequence: Synthetic coding sequence
atgttcagaacagctgtgatgatggccgccagcctggccctgactggagctgtggtggcccacgcctactacctgaagcaccagttctaccccaccgtggtgtacctgaccaagagcagccccagcatggctgtgctgtacatccaggcctttgtgctggtgttcctgctgggcaaggtgatgggcaaggtgttcttcggccagctgcgggctgctgagatggagcacctgctggagaggtcctggtatgctgtgacagagacctgcctggccttcaccgtcttcagagatgacttcagccccaggtttgtggccctcttcaccctgctgctcttcctgaagtgcttccactggctggctgaagatagagtggacttcatggagaggagccccaacatctcctggctgttccactgcagaattgtgtccctgatgttcctgctgggcatcctggacttcctgtttgtgagccacgcctaccacagcatcctgaccaggggggcctctgtgcagctggtgtttggatttgaatatgccatcctgatgaccatggtgctgaccatcttcatcaagtatgtgctgcacagcgtggacctgcagagcgagaacccctgggacaacaaggctgtgtacatgctgtacacagagctgttcaccggcttcatcaaggtgctgctgtacatggccttcatgaccatcatgatcaaggtgcacaccttccccctgtttgccatccggcccatgtacctggccatgaggcagttcaagaaggctgtgacagatgccatcatgagccggcgggccatccggaacatgaacaccctgtacccagatgccaccccagaggagctgcaggccatggacaacgtgtgcatcatctgccgggaggagatggtgactggagccaagaggctgccctgcaaccacatcttccacaccagctgcctgcgctcctggttccagaggcagcagacctgccccacctgcaggatggatgtgctgcgggccagcctgcctgcccagagccccccacctcctgagcctgctgaccagggccccccaccagccccccaccccccacccctgctgccccagccccccaacttcccccagggcctgctgccccccttccccccaggcatgttccccctgtggccacccatgggccccttcccccctgtgcccccaccacccagcagcggggaggccgtggccccacccagcaccagcgctgctgccctgagccggcccagcggggccgccaccaccacagctgctggcaccagcgccacagctgccagcgccacagccagcggccctggcagcggcagcgcccctgaggccggccctgcccctggcttccccttccccccaccctggatgggcatgcccctgcccccaccatttgccttcccccccatgcctgtgcccccagctggctttgctggcctgaccccagaggagctgcgggccctggagggccacgagcggcagcacctggaggcccggctgcagagcctgaggaacatccacaccctgctggatgctgccatgctgcagatcaaccagtacctgactgtgctggccagcctgggccccccaggcctgcccctgcagagcacccccctgcggcggctgcccctgcagctgctgctgctgcccccacctccagccagcctggcccagaggccccggccccagccccaggagcccccccaccagcccctgaagtggaagggcctgcagctgctgagccagtgggcccagaggcgctgcctgaggatggagagccccatgcagcagagcagcgctggggccgcctgccgctcctggagcctgctgctgcccacagacacagccccagcccagccccagcccctgctcttctag

SEQ ID NO: 172358 - DNA, 1851 bp, Artificial Sequence; identical to SEQ ID NO: 172354
  Description of Artificial Sequence: Synthetic coding sequence

SEQ ID NO: 172359 - DNA, 1191 bp, Artificial Sequence
  Description of Artificial Sequence: Synthetic coding sequence
atgtctgtggcctttgccagcgcccggccccggggcaaaggagaggtgacccagcagaccatccagaagatgctggatgagaaccaccacctgatccagtgcatcctggagtaccagagcaagggcaagacagctgagtgcacccagtaccagcagatcctgcacaggaacctggtgtacctggccaccatcgctgacagcaaccagaacatgcagagcctgctgcctgccccacccacccagaacatgaacctgggccctggggccctgacccagagcggcagcagccagggcctgcacagccagggcagcctgagtgatgccatcagcacaggcctgccccccagcagcctgctgcagggccagattggaaatggccccagccacgtgtccatgcagcagacagcccccaacaccctgcccaccacctccatgagcatcagcggccctggctacagccatgctggccctgccagccagggcgtgcccatgcagggccagggcaccatcggcaactacgtgtccaggaccaacatcaacatgcagagcaaccctgtgtccatgatgcagcagcaggccgccaccagccactacagcagcgcccagggcggcagccagcactaccagggccagagcagcatcgccatgatgggccagggcagccagggcagctccatgatgggccagaggcccatggccccctaccggcccagccagcagggcagcagccagcagtacctgggccaggaggagtactatggagagcagtacagccacagccagggcgctgctgagcccatgggccagcagtactacccagatggccacggggactatgcctaccagcagagcagctacacagagcagagctatgacaggagctttgaggagagcacccagcactactatgaaggaggcaacagccagtacagccagcagcaggccggctaccagcagggcgccgcccagcagcagacctacagccagcagcagtaccccagccagcagagctacccaggccagcagcagggctacggcagcgcccagggcgcccccagccagtacccaggctaccagcagggccagggccagcagtatggcagctaccgggccccccagacagcccccagcgcccagcagcagaggccctacggctatgagcagggccagtatggcaactaccagcagtag

SEQ ID NO: 172360 - DNA, 1200 bp, Artificial Sequence
  Description of Artificial Sequence: Synthetic coding sequence
atgcagagcctgagcacagaggcccgctacgtgccccgggtgccccagcaccgggaccagatcagccccaggagcccccagcacggcggccagatctgccccaggagccccctgcaccggggccagatctgccccaggagccccccagcccggcgctaccagcagatcctgcacaggaacctggtgtacctggccaccatcgctgacagcaaccagaacatgcagagcctgctgcctgccccacccacccagaacatgaacctgggccctggggccctgacccagagcggcagcagccagggcctgcacagccagggcagcctgagtgatgccatcagcacaggcctgccccccagcagcctgctgcagggccagattggaaatggccccagccacgtgtccatgcagcagacagcccccaacaccctgcccaccacctccatgagcatcagcggccctggctacagccacgccggccctgccagccagggcgtgcccatgcagggccagggcaccatcggcaactacgtgtccaggaccaacatcaacatgcagagcaaccctgtgtccatgatgcagcagcaggccgccaccagccactacagcagcgcccagggcggcagccagcactaccagggccagagcagcatcgccatgatgggccagggcagccagggcagctccatgatgggccagaggcccatggccccctaccggcccagccagcagggcagcagccagcagtacctgggccaggaggagtactacggggagcagtacagccacagccagggcgctgctgagcccatgggccagcagtactacccagatggccatggagactatgcctaccagcagagcagctacacagagcagagctatgacaggagctttgaggagagcacccagcactactatgagggcggcaacagccagtacagccagcagcaggccggctaccagcagggcgccgcccagcagcagacctacagccagcagcagtaccccagccagcagagctacccaggccagcagcagggctacggcagcgcccagggcgcccccagccagtacccaggctaccagcagggccagggccagcagtatggcagctaccgggccccccagacagcccccagcgcccagcagcagaggccctacggctatgagcagggccagtatggcaactaccagcagtag

SEQ ID NO: 172361 - DNA, 1191 bp, Artificial Sequence; identical to SEQ ID NO: 172359
  Description of Artificial Sequence: Synthetic coding sequence

SEQ ID NO: 172362 - DNA, 387 bp, Artificial Sequence
  Description of Artificial Sequence: Synthetic coding sequence
atgcagagcctgagcacagaggcccgctacgtgccccgggtgccccagcaccgggaccagatcagccccaggagcccccagcacggcggccagatctgccccaggagccccctgcaccggggccagatctgccccaggagccccccagcccggcgctaccagcagatcctgcacaggaacctggtgtacctggccaccatcgctgacagcaaccagaacatgcagagcctgctgcctgccccacccacccagaacatgaacctgggccctggggccctgacccagagcggcagcagccagggcctgcacagccagggcagcctgagtgatgccatcagcacaggcctgccccccagcagcctgctgcagggccagatcggcaactag

SEQ ID NO: 172363 - DNA, 234 bp, Artificial Sequence
  Description of Artificial Sequence: Synthetic coding sequence
atgtctgtggcctttgtgcctgactggctgcggggcaaggccgaggtgaaccaggagaccatccagaggctgctggaggagaatgaccagctgatccgctgcatcgtggagtaccagaacaagggcagaggaaatgaatgtgtgcagtaccagcacgtgctgcacaggaacctgatctacctggccaccatcgcagatgccagccccaccagcaccagcaaggccatggagtag

SEQ ID NO: 172364 - DNA, 234 bp, Artificial Sequence; identical to SEQ ID NO: 172363
  Description of Artificial Sequence: Synthetic coding sequence

SEQ ID NO: 172365 - DNA, 1164 bp, Artificial Sequence
  Description of Artificial Sequence: Synthetic coding sequence
atgtctgtggcctttgctgccccccggcagagaggaaaaggagagatcaccccagctgccatccagaagatgctggatgacaacaaccacctgatccagtgcatcatggacagccagaacaagggcaagaccagcgagtgcagccagtaccagcagatgctgcacaccaacctggtgtacctggccaccatcgctgacagcaaccagaacatgcagagcctgctgcctgccccacccacccagaacatgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctacagaccaccccagcagggccccccccagcagtacagcggccaggaggactactatggagaccagtacagccatggaggccagggccccccagagggcatgaaccagcagtactacccagatggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172366 - DNA, 1257 bp, Artificial Sequence
  Description of Artificial Sequence: Synthetic coding sequence
atgtctgtggcctttgctgccccccggcagagaggaaaaggagagatcaccccagctgccatccagaagatgctggatgacaacaaccacctgatccagtgcatcatggacagccagaacaagggcaagaccagcgagtgcagccagtaccagcagatgctgcacaccaacctggtgtacctggccaccatcgctgacagcaaccagaacatgcagagcctgctgcctgccccacccacccagaacatgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctacagaccaccccagcagggccccccccagcagtacagcggccaggaggactactatggagaccagtacagccatggaggccagggccccccagagggcatgaaccagcagtactacccagatggccacaatgactatggctaccagcagcccagctacccagagcagggctatgaccggccctatgaggacagcagccagcactactatgagggcggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172367 - DNA, 1266 bp, Artificial Sequence
  Description of Artificial Sequence: Synthetic coding sequence
gggggcaacatgtctgtggcctttgctgccccccggcagaggggcaagggggagatcaccccagctgccatccagaagatgctggatgacaacaaccacctgatccagtgcatcatggacagccagaacaagggcaagaccagtgaatgttcccagtaccagcagatgctgcacaccaacctggtgtacctggccaccatcgctgacagcaaccagaacatgcagagcctgctgcctgccccacccacccagaacatgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctaccggcccccccagcagggccccccccagcagtacagcggccaggaggactactacggggaccagtacagccacggcggccagggccccccagagggcatgaaccagcagtactacccagatggccacaatgactatggctaccagcagcccagctacccagagcagggctatgaccggccctatgaggacagcagccagcactactatgaaggaggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172368 - DNA, 399 bp, Artificial Sequence
  Description of Artificial Sequence: Synthetic coding sequence
atgaaccagcagtactacccagatggccacaatgactatggctaccagcagcccagctacccagagcagggctatgaccggccctatgaggacagcagccagcactactatgaaggaggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagaacagccgctggacagtgtgctag

SEQ ID NO: 172369 - DNA, 1011 bp, Artificial Sequence
  Description of Artificial Sequence: Synthetic coding sequence
atgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctacagaccaccccagcagggccccccccagcagtacagcggccaggaggactactatggagaccagtacagccatggaggccagggccccccagagggcatgaaccagcagtactacccagatggccacaatgactatggctaccagcagcccagctacccagagcagggctatgaccggccctatgaggacagcagccagcactactatgagggcggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172370 - DNA, 1188 bp, Artificial Sequence
  Description of Artificial Sequence: Synthetic coding sequence
atgctggatgacaacaaccacctgatccagtgcatcatggacagccagaacaagggcaagaccagtgaatgttcccagtaccagcagatgctgcacaccaacctggtgtacctggccaccatcgctgacagcaaccagaacatgcagagcctgctgcctgccccacccacccagaacatgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctaccggcccccccagcagggccccccccagcagtacagcggccaggaggactactacggggaccagtacagccacggcggccagggccccccagagggcatgaaccagcagtactacccagatggccacaatgactatggctaccagcagcccagctacccagagcagggctatgaccggccctatgaggacagcagccagcactactatgaaggaggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172371 - DNA, 1008 bp, Artificial Sequence
  Description of Artificial Sequence: Synthetic coding sequence
atgctgcacaccaacctggtgtacctggccaccatcgctgacagcaaccagaacatgcagagcctgctgcctgccccacccacccagaacatgcccatgggccctgggggcatgaaccagagcggccccccacctccacccaggagccacaacatgcccagtgatggcatggtgggcggcggccccccagccccccacatgcagaaccagatgaatggccagatgcctggccccaaccacatgcccatgcagggccctggccccaaccagctgaacatgaccaacagctccatgaacatgcccagcagcagccacggctccatgggcggctacaaccacagcgtgcccagcagccagagcatgcctgtgcagaaccagatgaccatgagccagggccagcccatgggcaactacggcccccggcccaacatgtccatgcagcccaaccagggccccatgatgcaccagcagccccccagccagcagtacaacatgccccagggcggcggccagcactaccagggccagcagccccccatgggcatgatgggccaggtgaaccagggcaaccacatgatgggccagaggcagatccccccctacagaccaccccagcagggccccccccagcagtacagcggccaggaggactactatggagaccagtacagccatggaggccagggccccccagagggcatgaaccagcagtactacccagatggcaacagccagtatggccagcagcaggatgcctaccagggccccccaccccagcagggctacccaccccagcagcagcagtacccaggccagcagggctacccaggccagcagcagggctacggccccagccagggcggccctggcccccagtaccccaactacccccagggccagggccagcagtatggaggctaccggcccacccagcccggccccccccagcccccccagcagaggccctacggctatgaccagggccagtatggcaactaccagcagtag

SEQ ID NO: 172372 - DNA, 1008 bp, Artificial Sequence; identical to SEQ ID NO: 172371
  Description of Artificial Sequence: Synthetic coding sequence

SEQ ID NO: 172373 - DNA, 567 bp, Artificial Sequence
  Description of Artificial Sequence: Synthetic coding sequence
atgaatggagatgacacctttgccaagaggcccagagatgatgccaaggccagcgagaagaggagcaaggcctttgatgacatcgccacctacttcagcaagaaggagtggaagaagatgaagtacagcgagaagatctcctatgtgtacatgaagaggaactacaaggccatgaccaagctgggcttcaaggtgaccctgccccccttcatgtgcaacaagcaggccacagacttccagggcaatgactttgacaatgaccacaacagacgcatccaggtggagcacccccagatgaccttcggccgcctgcaccgcatcatccccaagatcatgcccaagaagccagcagaagatgaaaatgacagcaagggcgtgtctgaggccagcggcccccagaatgatggcaagcagctgcaccccccaggcaaggccaacatcagcgagaagatcaacaagaggagcggccccaagaggggcaagcacgcctggacccaccggctgcgggagaggaagcagctggtgatctatgaggagatcagtgaccctgaagaagatgatgaatag

SEQ ID NO: 172374 - DNA, 672 bp, Artificial Sequence
  Description of Artificial Sequence: Synthetic coding sequence
atgaatggagatgatgcctttgcccggcggcccaccgtgggcgcccagatccctgagaagatccagaaggcctttgatgacatcgccaagtacttcagcaaggaggagtgggagaagatgaaggccagcgagaagatcttctacgtgtacatgaagaggaaatatgaggccatgaccaagctgggcttcaaggccaccctgccccccttcatgtgcaacaagagagctgaggacttccagggcaatgacctggacaatgaccccaacagaggcaaccaggtggagcggccccagatgaccttcggccgcctgcagggcatcagccccaagatcatgcccaagaagccagctgaggagggcaatgattctgaggaggtgcctgaggccagcggcccccagaatgatggcaaggagctgtgccccccaggcaagcccaccaccagcgagaagatccacgagaggagcggcaaccgggaggcccaggagaaggaggagcggcggggcacagcccaccgctggagcagccagaacacccacaacatcggccgcttcagcctgagcacctccatgggcgctgtgcacggcacccccaagaccatcacccacaacagagaccccaagggcggcaacatgcctggccccacagactgtgtgcgggagaacagctggtag

SEQ ID NO: 172375 - DNA, 567 bp, Artificial Sequence
  Description of Artificial Sequence: Synthetic coding sequence
atgaatggagatgatgcctttgcccggcggcccaccgtgggcgcccagatccctgagaagatccagaaggcctttgatgacatcgccaagtacttcagcaaggaggagtgggagaagatgaaggccagcgagaagatcttctacgtgtacatgaagaggaaatatgaggccatgaccaagctgggcttcaaggccaccctgccccccttcatgtgcaacaagagagctgaggacttccagggcaatgacctggacaatgaccccaacagaggcaaccaggtggagcggccccagatgaccttcggccgcctgcagggcatcagccccaagatcatgcccaagaagccagctgaggagggcaatgattctgaggaggtgcctgaggccagcggcccccagaatgatggcaaggagctgtgccccccaggcaagcccaccaccagcgagaagatccacgagaggagcggccccaagagaggagagcacgcctggacccaccggctgcgggagaggaagcagctggtgatctatgaggagatcagtgaccctgaagaagatgatgaatag

SEQ ID NO: 172376 - DNA, 567 bp, Artificial Sequence
  Description of Artificial Sequence: Synthetic coding sequence
atgaatggagatgacacctttgcccggcggcccaccgtgggcgcccagatccctgagaagatccagaaggcctttgatgacatcgccaagtacttcagcaaggaggagtgggagaagatgaaggtgtctgagaagatcgtgtatgtgtacatgaagaggaaatatgaggccatgaccaagctgggcttcaaggccatcctgcccagcttcatgaggaacaagagggtgacagacttccagggcaatgactttgacaatgaccccaacagaggcaaccaggtgcagaggccccagatgaccttcggccgcctgcagggcatcttccccaagatcatgcccaagaagccagctgaggagggcaatgtgtccaaggaggtgcctgaggccagcggcccccagaatgatggcaagcagctgtgccccccaggcaagcccaccaccagcgagaagatcaacatgatcagcggccccaagagaggagagcacgcctggacccaccggctgcgggagaggaagcagctggtgatctatgaggagatcagtgaccctgaagaagatgatgaatag

SEQ ID NO: 172377 - DNA, 513 bp, Artificial Sequence
  Description of Artificial Sequence: Synthetic coding sequence
atgaatggagatgacacctttgcccggcggcccaccgtgggcgcccagatccctgagaagatccagaaggcctttgatgacatcgccaagtacttcagcaaggaggagtgggagaagatgaaggtgtctgagaagatcgtgtatgtgtacatgaagaggaaatatgaggccatgaccaagctgggcttcaaggccatcctgcccagcttcatgaggaacaagagggtgacagacttccagggcaatgactttgacaatgaccccaacagaggcaaccaggtgcagaggccccagatgaccttcggccgcctgcagggcatcttccccaagatcatgcccaagaagccagctgaggagggcaatgtgtccaaggaggtgcctgaggccagcggcccccagaatgatggcaagcagctgtgccccccaggcaagcccaccaccagcgagaagatcaacatgatctctggagtgctgcagcgctactgccgcttcggcagccggcccctgcagtag

SEQ ID NO: 172378 - DNA, 303 bp, Artificial Sequence
  Description of Artificial Sequence: Synthetic coding sequence
atgtacagcctgtctgtgcagaggccccagatgaccttcggccgcctgcagggcatcttccccaagatcatgcccaagaagccagctgaggagggcaatgtgtccaaggaggtgcctgaggccagcggcccccagaatgatggcaagcagctgtgccccccaggcaagcccaccaccagcgagaagatcaacatgatcagcggccccaagagaggagagcacgcctggacccaccggctgcgggagaggaagcagctggtgatctatgaggagatcagtgaccctgaagaagatgatgaatag

SEQ ID NO: 172379 - DNA, 462 bp, Artificial Sequence
  Description of Artificial Sequence: Synthetic coding sequence
atgaatggagatgatgcctttgcccggcggcccagagatgatgcccagatcagcgagaagctgaggaaggcctttgatgacatcgccaagtacttcagcaagaaggagtgggagaagatgaagagcagcgagaagatcgtgtatgtgtacatgaagctgaactatgaggtgatgaccaagctgggcttcaaggtgaccctgccccccttcatgaggagcaagagagctgctgacttccacggcaatgactttggaaatgacaggaaccacaggaaccaggtggagcggccccagatgaccttcggcagcctgcagaggatcttccccaaggaccccaagggcggcaacatgcctggccccacagactgtgtgcgggagagctcctggtggttcatgaagaggtctgccaccctgaggaagatgaccagcaacagcccccggggctatgacacctgcccctag

SEQ ID NO: 172380 - DNA, 567 bp, Artificial Sequence
  Description of Artificial Sequence: Synthetic coding sequence
atgaatggagatgatgcctttgcccggcggcccagagatgatgcccagatcagcgagaagctgaggaaggcctttgatgacatcgccaagtacttcagcaagaaggagtgggagaagatgaagagcagcgagaagatcgtgtatgtgtacatgaagctgaactatgaggtgatgaccaagctgggcttcaaggtgaccctgccccccttcatgaggagcaagagagctgctgacttccacggcaatgactttggaaatgacaggaaccacaggaaccaggtggagcggccccagatgaccttcggcagcctgcagaggatcttccccaagatcatgcccaagaagccagctgaggaggagaatggcctgaaggaggtgcctgaggccagcggcccccagaatgatggcaagcagctgtgccccccaggcaaccccagcaccctggagaagatcaacaagaccagcggccccaagaggggcaagcacgcctggacccaccggctgcgggagaggaagcagctggtggtgtatgaggagatcagtgaccctgaagaagatgatgaatag

SEQ ID NO: 172381 - DNA, 1992 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgagaagaagtggccgctacatgagctgtggagaaaatcatggagtgcggccccccaaccctgagcagtacctgacccccctgcagcagaaggaggtgacagtgcgccacctgaagaccaagctgaaggagagcgagcggcggctgcacgagcgggagagcgagatcgtggagctgaagagccagctggccaggatgagggaggactggattgaggaggagtgccaccgggtggaggcccagctggccctgaaggaggccaggaaggagatcaagcagctgaagcaggtgattgagaccatgaggagcagcctggccgacaaggacaagggcatccagaagtactttgtggacatcaacatccagaacaagaagctggagagcctgctgcagagcatggagatggcccacagcggcagcctgagagatgagctgtgcctggacttcccctgtgacagccctgagaagagcctgaccctgaacccccccctggacaccatggctgatggcctgagcctggaggagcaggtgactggagagggcgctgaccgggagctgctggtgggggacagcatcgccaacagcacagacctgtttgatgaaattgtgacagccaccaccacagaaagtggggacctggagctggtgcacagcacccctggggccaacgtgctggagctgctgcccatcgtgatgggccaggaggagggctctgtggtggtggagagagctgtgcagacagatgtggtgccctacagccctgccatcagcgagctgatccagagcgtgctgcagaagctgcaggacccctgccccagcagcctggccagcccagatgagagcgagccagacagcatggagagcttccctgagagcctgagcgccctggtggtggacctgacccccaggaaccccaacagcgccatcctgctgagccctgtggagaccccctatgccaacgtggatgctgaggtgcacgccaaccggctgatgagggagctggactttgctgcctgtgtggaggagcggctggatggagtcatccccctggcccggggcggcgtggtgcggcagtactggagcagcagcttcctggtggacctgctggccgtggccgcccctgtggtgcccaccgtgctgtgggccttcagcacccagagaggaggaacagatcctgtgtacaacattggagccctgctgcggggctgctgcgtggtggccctgcacagcctgcggaggacagccttccgcatcaagacctag

SEQ ID NO: 172382 - DNA, 1983 bp, Artificial Sequence
  Description of Artificial Sequence: Synthetic coding sequence
atgagcaactttgagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgaggaggagcggccgctacatgagctgtggggagaaccacggcgtgcggccccccaaccctgagcagtacctgacccccctgcagcagaaggaggtgacagtgcgccacctgaagaccaagctgaaggagagcgagcggcggctgcacgagcgggagagcgagatcgtggagctgaagagccagctggccaggatgagggaggactggattgaggaggagtgccaccgggtggaggcccagctggccctgaaggaggccaggaaggagatcaagcagctgaagcaggtgattgagaccatgaggagcagcctggccgacaaggacaagggcatccagaagtactttgtggacatcaacatccagaacaagaagctggagagcctgctgcagagcatggagatggcccacagcggcagcctgagagatgagctgtgcctggacttcccctgtgacagccctgagaagagcctgaccctgaacccccccctggacaccatggctgatggcctgagcctggaggagcaggtgactggagagggcgctgaccgggagctgctggtgggggacagcatcgccaacagcacagacctgtttgatgagatcgtgacagccaccaccacagagagcggggacctggagctggtgcacagcacccctggggccaacgtgctggagctgctgcccatcgtgatgggccaggaggagggctctgtggtggtggagagagctgtgcagacagatgtggtgccctacagccctgccatcagcgagctgatccagagcgtgctgcagaagctgcaggacccctgccccagcagcctggccagcccagatgaaagtgagccagacagcatggagagcttccctgagagcctgagcgccctggtggtggacctgaccccaagaaaccccaacagcgccatcctgctgagccctgtggagaccccctatgccaacgtggatgctgaggtgcacgccaaccggctgatgagggagctggactttgctgcctgtgtggaggagcggctggatggagtcatccccctggcccggggcggcgtggtgcggcagtactggagcagcagcttcctggtggacctgctggccgtggccgcccctgtggtgcccaccgtgctgtgggccttcagcacccagaggggcggcacagatcctgtgtacaacatcggggccctgctgcggggctgctgcgtggtggccctgcacagcctgcggaggacagccttccgcatcaagacctag

SEQ ID NO: 172383 - DNA, 1635 bp, Artificial Sequence
  Description of Artificial Sequence: Synthetic coding sequence
atggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgaggaggagcggccgctacatgagctgtggggagaaccacggcgtgcggccccccaaccctgagcagtacctgacccccctgcagcagaaggaggtgacagtgcgccacctgaagaccaagctgaaggagagcgagcggcggctgcacgagcgggagagcgagatcgtggagctgaagagccagctggccaggatgagggaggactggattgaggaggagtgccaccgggtggaggcccagctggccctgaaggaggccaggaaggagatcaagcagctgaagcaggtgattgagaccatgaggagcagcctggccgacaaggacaagggcatccagaagtactttgtggacatcaacatccagaacaagaagctggagagcctgctgcagagcatggagatggcccacagcggcagcctgagagatgagctgtgcctggacttcccctgtgacagccctgagaagagcctgaccctgaacccccccctggacaccatggctgatggcctgagcctggaggagcaggtgactggagagggcgctgaccgggagctgctggtgggggacagcatcgccaacagcacagacctgtttgatgagatcgtgacagccaccaccacagagagcggggacctggagctggtgcacagcacccctggggccaacgtgctggagctgctgcccatcgtgatgggccaggaggagggctctgtggtggtggagagagctgtgcagacagatgtggtgccctacagccctgccatcagcgagctgatccagagcgtgctgcagaagctgcaggacccctgccccagcagcctggccagcccagatgaaagtgagccagacagcatggagagcttccctgagagcctgagcgccctggtggtggacctgaccccaagaaaccccaacagcgccatcctgctgagccctgtggagaccccctatgccaacgtggatgctgaggtgcacgccaaccggctgatgagggagctggactttgctgcctgtgtggaggagcggctggatggagtcatccccctggcccggggcggcgtggtgcggcagtactggagcagcagcttcctggtggacctgctggccgtggccgcccctgtggtgcccaccgtgctgtgggccttcagcacccagaggggcggcacagatcctgtgtacaacatcggggccctgctgcggggctgctgcgtggtggccctgcacagcctgcggaggacagccttccgcatcaagacctag

SEQ ID NO: 172384 - DNA, 1992 bp, Artificial Sequence; identical to SEQ ID NO: 172381
  Description of Artificial Sequence: Synthetic coding sequence

SEQ ID NO: 172385 - DNA, 1989 bp, Artificial Sequence
  Description of Artificial Sequence: Synthetic coding sequence
atgggccccctgcgggagagcaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgaggaggagcggccgctacatgagctgtggggagaaccacggcgtgcggccccccaaccctgagcagtacctgacccccctgcagcagaaggaggtgacagtgcgccacctgaagaccaagctgaaggagagcgagcggcggctgcacgagcgggagagcgagatcgtggagctgaagagccagctggccaggatgagggaggactggattgaggaggagtgccaccgggtggaggcccagctggccctgaaggaggccaggaaggagatcaagcagctgaagcaggtgattgagaccatgaggagcagcctggccgacaaggacaagggcatccagaagtactttgtggacatcaacatccagaacaagaagctggagagcctgctgcagagcatggagatggcccacagcggcagcctgagagatgagctgtgcctggacttcccctgtgacagccctgagaagagcctgaccctgaacccccccctggacaccatggctgatggcctgagcctggaggagcaggtgactggagagggcgctgaccgggagctgctggtgggggacagcatcgccaacagcacagacctgtttgatgagatcgtgacagccaccaccacagagagcggggacctggagctggtgcacagcacccctggggccaacgtgctggagctgctgcccatcgtgatgggccaggaggagggctctgtggtggtggagagagctgtgcagacagatgtggtgccctacagccctgccatcagcgagctgatccagagcgtgctgcagaagctgcaggacccctgccccagcagcctggccagcccagatgaaagtgagccagacagcatggagagcttccctgagagcctgagcgccctggtggtggacctgaccccaagaaaccccaacagcgccatcctgctgagccctgtggagaccccctatgccaacgtggatgctgaggtgcacgccaaccggctgatgagggagctggactttgctgcctgtgtggaggagcggctggatggagtcatccccctggcccggggcggcgtggtgcggcagtactggagcagcagcttcctggtggacctgctggccgtggccgcccctgtggtgcccaccgtgctgtgggccttcagcacccagaggggcggcacagatcctgtgtacaacatcggggccctgctgcggggctgctgcgtggtggccctgcacagcctgcggaggacagccttccgcatcaagacctag

SEQ ID NO: 172386 - DNA, 1992 bp, Artificial Sequence; identical to SEQ ID NO: 172381
  Description of Artificial Sequence: Synthetic coding sequence

SEQ ID NO: 172387 - DNA, 1992 bp, Artificial Sequence; identical to SEQ ID NO: 172381
  Description of Artificial Sequence: Synthetic coding sequence

SEQ ID NO: 172388 - DNA, 1992 bp, Artificial Sequence; identical to SEQ ID NO: 172381
  Description of Artificial Sequence: Synthetic coding sequence

SEQ ID NO: 172389 - DNA, 1989 bp, Artificial Sequence; identical to SEQ ID NO: 172385
  Description of Artificial Sequence: Synthetic coding sequence

SEQ ID NO: 172390 - DNA, 414 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagctag

SEQ ID NO: 172391 - DNA, 231 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagctag

SEQ ID NO: 172392 - DNA, 222 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagctag

SEQ ID NO: 172393 - DNA, 378 bp, Artificial Sequence
  Description of Artificial Sequence: Synthetic coding sequence
atggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgtag

SEQ ID NO: 172394 - DNA, 1635 bp, Artificial Sequence; identical to SEQ ID NO: 172383
  Description of Artificial Sequence: Synthetic coding sequence

SEQ ID NO: 172395 - DNA, 243 bp, Artificial Sequence
  Description of Artificial Sequence: Synthetic coding sequence
atggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccctag

SEQ ID NO: 172396 - DNA, 1989 bp, Artificial Sequence; identical to SEQ ID NO: 172385
  Description of Artificial Sequence: Synthetic coding sequence

SEQ ID NO: 172397 - DNA, 288 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagcgactag

SEQ ID NO: 172398 - DNA, 615 bp, Artificial Sequence
  Description of Artificial Sequence: Synthetic coding sequence
atgggccccctgcgggagagcaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtag

SEQ ID NO: 172399 - DNA, 108 bp, Artificial Sequence
  Description of Artificial Sequence: Synthetic coding sequence
atggtgggggagggcagcatccagagcagccgctacaagaaggagagcaagagcggcctggtgaagccaggcagcgaggccgacttcagcagcagcagcagcacctag

SEQ ID NO: 172400 - DNA, 105 bp, Artificial Sequence
  Description of Artificial Sequence: Synthetic coding sequence
atggtgggggagggcagcatccagagcagccgctacaagaaggagagcaagagcggcctggtgaagccaggcagcgaggccgacttcagcagcagcagcagctag

SEQ ID NO: 172401 - DNA, 243 bp, Artificial Sequence; identical to SEQ ID NO: 172395
  Description of Artificial Sequence: Synthetic coding sequence

SEQ ID NO: 172402 - DNA, 1788 bp, Artificial Sequence
  Description of Artificial Sequence: Synthetic coding sequence
atgggccccttctgggccaggaaggatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcacatgagcacagctggcagcaagaggagcagcagcagcaggaacagaggcccccacggccgcagcaatggagccagcagccacaagccaggcagcagccccagcagcccccgggagaaggacctgctgtccatgctgtgcaggaaccagctgagccctgtgaacatccaccccagctatgcccccagcagccccagcagcagcaacagcggcagctacaagggcagtgactgcagccccatcatgagaagaagtggccgctacatgagctgtggagaaaatcatggagtgcggccccccaaccctgagcagtacctgacccccctgcagcagaaggaggtgacagtgcgccacctgaagaccaagctgaaggagagcgagcggcggctgcacgagcgggagagcgagatcgtggagctgaagagccagctggccaggatgagggaggactggattgaggaggagtgccaccgggtggaggcccagctggccctgaaggaggccaggaaggagatcaagcagctgaagcaggtgattgagaccatgaggagcagcctggccgacaaggacaagggcatccagaagtactttgtggacatcaacatccagaacaagaagctggagagcctgctgcagagcatggagatggcccacagcggcagcctgagagatgagctgtgcctggacttcccctgtgacagccctgagaagagcctgaccctgaacccccccctggacaccatggctgatggcctgagcctggaggagcaggtgactggagagggcgctgaccgggagctgctggtgggggacagcatcgccaacagcacagacctgtttgatgaaattgtgacagccaccaccacagaaagtggggacctggagctggtgcacagcacccctggggccaacgtgctggagctgctgcccatcgtgatgggccaggaggagggctctgtggtggtggagagagctgtgcagacagatgtggtgccctacagccctgccatcagcgagctgatccagagcgtgctgcagaagctgcaggacccctgccccagcagcctggccagcccagatgagagcgagccagacagcatggagagcttccctgagagcctgagcgccctggtggtggacctgacccccaggaaccccaacagcgccatcctgctgagccctgtggagaccccctatgccaacgtggatgctgaggtgcacgccaaccggctgatgagggagctggactttgctgcctgtgtggaggagcggctggatggagtcatccccctggcccggggcggcgtggtgcggcagtactggagcagcagcttcctggtggacctgctggccgtggccgcccctgtggtgcccaccgtgctgtgggccttcagcacccagagaggaggaacagatcctgtgtacaacattggagccctgctgcggggctgctgcgtggtggccctgcacagcctgcggaggacagccttccgcatcaagacctag

SEQ ID NO: 172403 - DNA, 1635 bp, Artificial Sequence; identical to SEQ ID NO: 172383
  Description of Artificial Sequence: Synthetic coding sequence

SEQ ID NO: 172404 - DNA, 1992 bp, Artificial Sequence; identical to SEQ ID NO: 172381
  Description of Artificial Sequence: Synthetic coding sequence

SEQ ID NO: 172405 - DNA, 489 bp, Artificial Sequence
  Description of Artificial Sequence: Synthetic coding sequence
atgggccccctgcgggagagcaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagcagcagcacaggcagcatcagcgcccctgaggtgcactag

SEQ ID NO: 172406 - DNA, 1989 bp, Artificial Sequence; identical to SEQ ID NO: 172385
  Description of Artificial Sequence: Synthetic coding sequence

SEQ ID NO: 172407 - DNA, 315 bp, Artificial Sequence
  Description of Artificial Sequence: Synthetic coding sequence
atgggccccctgcgggagagcaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgcccctag

SEQ ID NO: 172408 - DNA, 456 bp, Artificial Sequence
  Description of Artificial Sequence: Synthetic coding sequence
atgggccccctgcgggagagcaagaaggagcaccgggtgcagcaccacgacaaggagatcagccgcagccgcatccccaggctcatcctgcggccccacatgccccagcagcagcacaaggtgtccccagccagcgagagccccttcagcgaggaggagagccgggagttcaaccccagcagcagcggccgcagcgccaggacagtgagcagcaacagcttctgcagtgatgacaccggctgccccagcagccagagcgtgtcccctgtgaagacccccagtgatgctggcaacagccccatcggcttctgccccggcagtgatgagggcttcaccaggaagaagtgcaccatcggcatggtgggggagggcagcatccagagcagccgctacaagaaggagagcaagagcggcctggtgaagccaggcagcgaggccgacttcagcagcagctag

SEQ ID NO: 172409 - DNA, 231 bp, Artificial Sequence; identical to SEQ ID NO: 172391
  Description of Artificial Sequence: Synthetic coding sequence

SEQ ID NO: 172410 - DNA, 1617 bp, Artificial Sequence
  Description of Artificial Sequence: Synthetic coding sequence
atgcctggcagcggccccagcgagaggatgacctggccaggccctgccctgtctgctggcccccccacccggcccctgagcagcgcccctggcatcccccccatcccccccctgaccaggacccacagcctgatggccatgagcctgcccggcagcaggaggaccagcgctggcagcagaagaaggaccagcccccctgtgtctgtgagagatgcctacggcaccagcagcctgagcagcagcagcaacagcggcagctacaagggcagtgacagcagccccaccccaagaagatccatgaagtacaccctgtgcagcgacaaccacggcatcaagccacccaccccagagcagtacctgacccccctgcagcagaaggaggtgtgcatccgccacctgaaggcccggctgaaggacacccaggaccggctgcaggaccgggacacagaaattgatgacctgaagacccagctgagcaggatgcaggaggactggattgaggaggagtgccaccgggtggaggcccagctggccctgaaggaggccaggaaggagatcaagcagctgaagcaggtgattgacacagtgaagaacaacctgattgacaaggacaagggcctgcagaagtactttgtggacatcaacatccagaacaagaagctggagaccctgctgcacagcatggaggtggcccagaatggcatggccaaggaggatggcactggagagagcgctgggggcagccctgcccggagcctgaccaggagcagcacctacaccaagctgagtgaccctgctgtgtgtggggaccggcagcccggggaccccagcagcggcagcgcagaagatggagctgacagcggctttgctgctgctgatgacaccctgagcaggacagatgccctggaggccagcagcctgctgagcagcggcgtggactgtggcacagaggagaccagcctgcacagcagctttggcctgggcccccgcttccctgccagcaacacctatgagaagctgctgtgtggcatggaggccggcgtgcaggccagctgcatgcaggagcgggccatccagacagactttgtgcagtaccagcctgacctggacaccatcctggagaaggtgacccaggcccaggtgtgtggcacagatcctgagagcggggaccgctgcccagagctggatgcccaccccagcggcccccgggaccccaacagcgctgtggtggtgacagtgggagatgagctggaggcccctgagcccatcacccggggccccaccccccagaggcctggggccaaccccaaccctggccagagcgtgtctgtggtgtgccccatggaggaggaggaggaggccgctgtggccgagaaggagcccaagagctactggagccgccactacatcgtggacctgctggccgtggtggtgcctgctgtgcccaccgtggcctggctgtgccgcagccagaggcggcagggccagcccatctacaacatcagcagcctgctgcggggctgctgcaccgtggccctgcacagcatccgccgcatcagctgccgcagcctgagccagcccagccccagccctgctgggggcggcagccagctgtag

SEQ ID NO: 172411 - DNA, 1485 bp, Artificial Sequence
  Description of Artificial Sequence: Synthetic coding sequence
atggccatgagcctgcccggcagcaggaggaccagcgctggcagcagaagaaggaccagcccccctgtgtctgtgagagatgcctacggcaccagcagcctgagcagcagcagcaacagcggcagctacaagggcagtgacagcagccccaccccaagaagatccatgaagtacaccctgtgcagcgacaaccacggcatcaagccacccaccccagagcagtacctgacccccctgcagcagaaggaggtgtgcatccgccacctgaaggcccggctgaaggacacccaggaccggctgcaggaccgggacacagaaattgatgacctgaagacccagctgagcaggatgcaggaggactggattgaggaggagtgccaccgggtggaggcccagctggccctgaaggaggccaggaaggagatcaagcagctgaagcaggtgattgacacagtgaagaacaacctgattgacaaggacaagggcctgcagaagtactttgtggacatcaacatccagaacaagaagctggagaccctgctgcacagcatggaggtggcccagaatggcatggccaaggaggatggcactggagagagcgctgggggcagccctgcccggagcctgaccaggagcagcacctacaccaagctgagtgaccctgctgtgtgtggggaccggcagcccggggaccccagcagcggcagcgcagaagatggagctgacagcggctttgctgctgctgatgacaccctgagcaggacagatgccctggaggccagcagcctgctgagcagcggcgtggactgtggcacagaggagaccagcctgcacagcagctttggcctgggcccccgcttccctgccagcaacacctatgagaagctgctgtgtggcatggaggccggcgtgcaggccagctgcatgcaggagcgggccatccagacagactttgtgcagtaccagcctgacctggacaccatcctggagaaggtgacccaggcccaggtgtgtggcacagatcctgagagcggggaccgctgcccagagctggatgcccaccccagcggcccccgggaccccaacagcgctgtggtggtgacagtgggagatgagctggaggcccctgagcccatcacccggggccccaccccccagaggcctggggccaaccccaaccctggccagagcgtgtctgtggtgtgccccatggaggaggaggaggaggccgctgtggccgagaaggagcccaagagctactggagccgccactacatcgtggacctgctggccgtggtggtgcctgctgtgcccaccgtggcctggctgtgccgcagccagaggcggcagggccagcccatctacaacatcagcagcctgctgcggggctgctgcaccgtggccctgcacagcatccgccgcatcagctgccgcagcctgagccagcccagccccagccctgctgggggcggcagccagctgtag

SEQ ID NO: 172412 - DNA, 864 bp, Artificial Sequence
  Description of Artificial Sequence: Synthetic coding sequence
atgaaggaccggctggccgagctgctggacctgagcaagcagtatgaccagcagttcccagatggagatgatgaatttgacagcccccatgaagatattgtgtttgaaacagaccacatcctggagagcctgtacagagacatccgggacatccaggatgagaaccagctgctggtggctgatgtgaagaggctgggcaagcagaatgcccgcttcctgacctccatgaggcggctgagcagcatcaagagggacaccaacagcatcgccaaggccatcaaggcccggggggaggtgatccactgcaagctgcgggccatgaaggagctgtctgaggccgctgaggcccagcacggcccccacagcgctgtggcccgcatcagccgggcccagtacaatgccctgaccctgaccttccagagggccatgcatgactacaaccaggccgagatgaagcagagggacaactgcaagatccgcatccagaggcagctggagatcatgggcaaggaggtgtctggggaccagatcgaggacatgtttgagcagggcaagtgggatgtgttttctgagaacctgctggctgatgtgaagggggcccgggccgccctgaatgaaattgagagccgccaccgggagctgctgcggctggagagccgcatcagagatgtgcatgagctgttcctgcagatggctgtgctggtggagaagcaggccgacaccctgaatgtgattgagctgaatgtgcagaagacagtggactacacaggccaggccaaggcccaggtgaggaaggctgtgcagtatgaggagaagaacccctgcaggaccctgtgctgcttctgctgcccctgcctgaagtag

SEQ ID NO: 172413 - DNA, 615 bp, Artificial Sequence
  Description of Artificial Sequence: Synthetic coding sequence
atggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgtag

SEQ ID NO: 172414 - DNA, 927 bp, Artificial Sequence
  Description of Artificial Sequence: Synthetic coding sequence
atggccacccggcggctgacagatgccttcctgctgctgaggaacaacagcatccagaaccggcagctgctggccgagcaggagctggatgagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctcttcgtcatcatcatcgtgctgattgtggtgctggtgggcgtgaagagcaggtag

SEQ ID NO: 172415 - DNA, 966 bp, Artificial Sequence
  Description of Artificial Sequence: Synthetic coding sequence
atggccacccggcggctgacagatgccttcctgctgctgaggaacaacagcatccagaaccggcagctgctggccgagcaggtgagcagccacatcaccagcagccccctgcacagccgcagcattgctgccctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctgtttgtgatcatcatcgtgctgattgtggtgctggtgggcgtgaagagcaggtag

SEQ ID NO: 172416 - DNA, 756 bp, Artificial Sequence
  Description of Artificial Sequence: Synthetic coding sequence
atggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgtag

SEQ ID NO: 172417 - DNA, 927 bp, Artificial Sequence
  Description of Artificial Sequence: Synthetic coding sequence
atggccacccggcggctgacagatgccttcctgctgctgaggaacaacagcatccagaaccggcagctgctggccgagcagcagctgagcaagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctcttcgtcatcatcatcgtgctgattgtggtgctggtgggcgtgaagagcaggtag

SEQ ID NO: 172418 - DNA, 978 bp, Artificial Sequence
  Description of Artificial Sequence: Synthetic coding sequence
atggccacccggcggctgacagatgccttcctgctgctgaggaacaacagcatccagaaccggcagctgctggccgagcaggtgagcagccacatcaccagcagccccctgcacagccgcagcattgctgctgccctggatgagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctgtttgtgatcatcatcgtgctgattgtggtgctggtgggcgtgaagagcaggtag

SEQ ID NO: 172419 - DNA, 915 bp, Artificial Sequence
  Description of Artificial Sequence: Synthetic coding sequence
atggccacccggcggctgacagatgccttcctgctgctgaggaacaacagcatccagaaccggcagctgctggccgagcagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctcttcgtcatcatcatcgtgctgattgtggtgctggtgggcgtgaagagcaggtag

SEQ ID NO: 172420 - DNA, 819 bp, Artificial Sequence
  Description of Artificial Sequence: Synthetic coding sequence
atggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctcttcgtcatcatcatcgtgctgattgtggtgctggtgggcgtgaagagcaggtag

SEQ ID NO: 172421 - DNA, 978 bp, Artificial Sequence
  Description of Artificial Sequence: Synthetic coding sequence
atggccacccggcggctgacagatgccttcctgctgctgaggaacaacagcatccagaaccggcagctgctggccgagcaggtgagcagccacatcaccagcagccccctgcacagccgcagcattgctgctgagctggatgagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctgtttgtgatcatcatcgtgctgattgtggtgctggtgggcgtgaagagcaggtag

SEQ ID NO: 172422 - DNA, 366 bp, Artificial Sequence
  Description of Artificial Sequence: Synthetic coding sequence
atggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcacctag

SEQ ID NO: 172423 - DNA, 420 bp, Artificial Sequence
  Description of Artificial Sequence: Synthetic coding sequence
atgaagaaccgggaggagaggagccagcacttctttgacacctctgtgcccctgatggatgatggagatgacaacaccctgtaccaccggggcttcacagaggaccagctggtgctggtggagcagaacaccctgatggtggaggagcgggagcgggagatccggcagatcgtgcagagcatcagtgacctgaatgagatcttccgggacctgggcgccatgattgtggagcagggcaccgtgctggacagaattgactacaacgtggagcagagctgcatcaagacagaagatggcctgaagcagctgcacaaggccgagcagtaccagaagaagaacaggaagatgctggtgatcctgatcctgtttgtgatcatcatcgtgctgattgtggtgctggtgggcgtgaagagcaggtag

SEQ ID NO: 172424 - DNA, 660 bp, Artificial Sequence
  Description of Artificial Sequence: Synthetic coding sequence
ggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccaccggggcaccgtgctggacagaattgactacaacgtggagcagagctgcatcaagacagaagatggcctgaagcagctgcacaaggccgagcagtaccagaagaagaacaggaagatgctggtgatcctgatcctgtttgtgatcatcatcgtgctgattgtggtgctggtgggcgtgaagagcaggtag

SEQ ID NO: 172425 - DNA, 369 bp, Artificial Sequence
  Description of Artificial Sequence: Synthetic coding sequence
atggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagctag

SEQ ID NO: 172426 - DNA, 609 bp, Artificial Sequence
  Description of Artificial Sequence: Synthetic coding sequence
atggccacccggcggctgacagatgccttcctgctgctgaggaacaacagcatccagaaccggcagctgctggccgagcaggagctggatgagctggctgatgacaggatggccctggtgtctggcatcagcctggaccctgaggccgccatcggcgtgaccaagaggcccccacccaagtgggtggatggagtggatgagatccagtatgatgtgggccgcatcaagcagaagatgaaggagctggccagcctgcatgacaagcacctgaaccggcccaccctggatgacagcagcgaggaggagcacgccatcgagatcaccacccaggagatcacccagctgttccaccgctgccagagagctgtgcaggccctgcccagccgggcccgggcctgcagcgagcaggagggccgcctgctgggcaatgtggtggccagcctggcccaggccctgcaggagctgagcaccagcttcagacatgcccagagcggctacctgaagaggatgaagaaccgggaggagaggagccagcacttctttgacacctctgtgcccctgatggatgatggagatgacaacaccctgtaccacaggaggaccagctag

SEQ ID NO: 172427 - DNA, 909 bp, Artificial Sequence
  Description of Artificial Sequence: Synthetic coding sequence
atgtctgaagatgaggagaaggtgaagctgcggcggctggagcccgccatccagaagttcatcaagatcgtcatccccacagacctggagcggctgaggaagcaccagatcaacatcgagaagtaccagcgctgccgcatctgggacaagctgcacgaggagcacatcaatgccggccgcacagtgcagcagctgcggagcaacatccgggagattgagaagctgtgcctgaaggtgaggaaggatgacctggtgctgctgaagaggatgattgatcctgtgaaggaggaggccagcgctgccacagctgagttcctgcagctgcacctggagagcgtggaggagctgaagaagcagttcaatgatgaggagaccctgctgcagccccccctgaccaggtccatgacagtgggcggggccttccacaccacagaggccgaggccagcagccagagcctgacccagatctatgccctgcctgagatcccccaggaccagaatgctgctgagagctgggagaccctggaggccgacctgattgagctgagccagctggtgacagacttcagcctgctggtgaacagccagcaggagaagattgacagcattgctgaccacgtgaacagcgctgctgtgaatgtggaggagggcaccaagaacctgggcaaggccgccaagtacaagctggccgccctgcctgtggccggggccctgattggaggcatggtgggcggccccatcggcctgctggccggcttcaaggtggccggcattgctgctgccctgggcggcggcgtgctgggcttcaccggcggcaagctgatccagaggaagaagcagaagatgatggagaagctgaccagcagctgcccagacctgcccagccagacagacaagaagtgcagctag

SEQ ID NO: 172428 - DNA, 909 bp, Artificial Sequence; identical to SEQ ID NO: 172427
  Description of Artificial Sequence: Synthetic coding sequence

SEQ ID NO: 172429 - DNA, 126 bp, Artificial Sequence
  Description of Artificial Sequence: Synthetic coding sequence
atgtctgaagatgaggagaaggtgaagctgcggcggctggagcccgccatccagaagttcatcaagatcgtcatccccacagacctggagcggctgaggaagcaccagatcaacatcgagaagtag

SEQ ID NO: 172430 - DNA, 126 bp, Artificial Sequence; identical to SEQ ID NO: 172429
  Description of Artificial Sequence: Synthetic coding sequence

SEQ ID NO: 172431 - DNA, 909 bp, Artificial Sequence; identical to SEQ ID NO: 172427
  Description of Artificial Sequence: Synthetic coding sequence

SEQ ID NO: 172432 - DNA, 636 bp, Artificial Sequence
  Description of Artificial Sequence: Synthetic coding sequence
atgaggctcttcctgtggaatgctgtgctgaccctgtttgtgaccagcctcatcggggccctgatccctgagcctgaggtgaagattgaggtgctgcagaagcccttcatctgccacaggaagaccaagggcggggacctgatgctggtgcactatgagggctacctggagaaggatggcagcctcttccacagcacccacaagcacaacaacggccagcccatctggttcaccctgggcatcctggaggccctgaagggctgggaccagggcctgaagggcatgtgtgtgggggagaagaggaagctgatcatccccccagccctgggctacggcaaggagggcaagggcaagatccccccagagagcaccctcatcttcaacatcgacctgctggagatcagaaatggccccaggagccatgagagcttccaggagatggacctgaatgatgactggaagctgagcaaggatgaggtgaaggcctacctgaagaaggagtttgagaagcatggagctgtggtgaatgaaagccaccatgatgccctggtggaggacatctttgacaaggaggatgaggacaaggatggcttcatcagcgcccgggagttcacctacaagcatgatgagctgtag

SEQ ID NO: 172433 - DNA, 783 bp, Artificial Sequence
  Description of Artificial Sequence: Synthetic coding sequence
atgaaggacaggacccaggagctgaggacagccaaggacagtgatgatgatgatgatgtggccgtgacagtggaccgggaccgcttcatggatgagttctttgagcaggtggaggagatccggggcttcatcgacaagattgctgaaaatgtggaggaggtgaagaggaagcacagcgccatcctggccagccccaacccagatgagaagaccaaggaggagctggaggagctgatgtctgacatcaagaagacagccaacaaggtgcgcagcaagctgaagagcattgagcagagcattgagcaggaggagggcctgaacagaagcagcgctgacctgcgcatcaggaagacccagcacagcaccctgagcaggaagtttgtggaggtgatgtctgagtacaatgccacccagagcgactaccgggagcgctgcaagggccgcatccagaggcagctggagatcaccggccgcaccaccaccagcgaggagctggaggacatgctggagagcggcaacccagccatctttgccagcggcatcatcatggacagcagcatcagcaagcaggccctgtctgaaattgagaccaggcacagcgagatcatcaagctggagaacagcatccgggagctgcatgacatgttcatggacatggccatgctggtggagagccagccccagggcgccttcctgaagagctgcccagagccccagcccaaccctgaggagggcgccctgtggagcagcggggcccctggccctgctggaagagatgactag

SEQ ID NO: 172434 - DNA, 516 bp, Artificial Sequence
  Description of Artificial Sequence: Synthetic coding sequence
atgaaggacaggacccaggagctgaggacagccaaggacagtgatgatgatgatgatgtggccgtgacagtggaccgggaccgcttcatggatgagttctttgagcaggtggaggtgatgtctgagtacaatgccacccagagcgactaccgggagcgctgcaagggccgcatccagaggcagctggagatcactggaagaaccaccaccagcgaggagctggaggacatgctggagagcggcaacccagccatctttgccagcggcatcatcatggacagcagcatcagcaagcaggccctgtctgaaattgagaccaggcacagcgagatcatcaagctggagattgagtacaacgtggagcacgctgtggactatgtggagagagctgtgtctgacaccaagaaggctgtgaagtaccagagcaaggcccggaggaagaagatcatgatcatcatctgctgcgtcatcctgggcatcgtcatcgccagcacagtgggcggcatctttgcctag

SEQ ID NO: 172435 - DNA, 756 bp, Artificial Sequence
  Description of Artificial Sequence: Synthetic coding sequence
atgaaggacaggacccaggagctgaggacagccaaggacagtgatgatgatgatgatgtggccgtgacagtggaccgggaccgcttcatggatgagttctttgagcaggtggaggagatccggggcttcatcgacaagattgctgaaaatgtggaggaggtgaagaggaagcacagcgccatcctggccagccccaacccagatgagaagaccaaggaggagctggaggagctgatgtctgacatcaagaagacagccaacaaggtgcgcagcaagctgaagagcattgagcagagcattgagcaggaggagggcctgaacagaagcagcgctgacctgcgcatcaggaagacccagcacagcaccctgagcaggaagtttgtggaggtgatgtctgagtacaatgccacccagagcgactaccgggagcgctgcaagggccgcatccagaggcagctggagatcaccggccgcaccaccaccagcgaggagctggaggacatgctggagagcggcaacccagccatctttgccagcggcatcatcatggacagcagcatcagcaagcaggccctgtctgaaattgagaccaggcacagcgagatcatcaagctggagaacagcatccgggagctgcatgacatgttcatggacatggccatgctggtggagagccagaccatgtggaggggcccctgcctgaccccaagaagacccagcagcacccgggccaggagagctggcaggaagagctag

SEQ ID NO: 172436 - DNA, 1053 bp, Artificial Sequence
  Description of Artificial Sequence: Synthetic coding sequence
atgttcatcaagggccgggccccccgggccccaccccgggagcggcggcgggccacccggggcggcctgcggcaggtggtggccccaccccgggccctgggcagcaccagccggccccacttccggcgggcctctgtgtgcagaagacgctgcaggaagagcggcggcctgctggccgccagcaggaagatggctgctgctgctgtgaatggagctgctggcttcagcagcagcggccctgctgccaccagcggggctgtgctgcaggccgccaccggcatgtatgagcagctgaagggggagtggaacaggaagagccccaacctgagcaaatgtggggaggagctgggccgcctgaagctggtgctgctggagctgaacttcctgcccaccaccggcaccaagctgaccaagcagcagctgatcctggcccgggacatcctggagatcggggcccagtggagcatcctgaggaaggacatccccagctttgagcgctacatggcccagctgaagtgctactactttgactacaaggagcagctgcctgagagcgcctacatgcaccagctgctgggcctgaacctgctcttcctgctgagccagaacagagtggccgagttccacacagagctggagcggctgcctgccaaggacatccagaccaacgtgtacatcaagcaccctgtgtccctggagcagtacctgatggagggcagctacaacaaggtgttcctggccaagggcaacatcccagctgagagctacaccttcttcatcgacatcctgctggacaccatcagagatgaaattgctggctgcatcgagaaggcctatgagaagatcctcttcacagaggccacccgcatcctcttcttcaacacccccaagaagatgacagattatgccaagaagaggggctgggtgctgggccccaacaactactacagctttgccagccagcagcagaagccagaggacaccaccatccccagcacagagctggccaagcaggtgattgaatatgcccggcagctggagatgattgtgtag

SEQ ID NO: 172437 - DNA, 864 bp, Artificial Sequence
  Description of Artificial Sequence: Synthetic coding sequence
atgagggaccggctgcctgacctgacagcctgcaggaagaatgatgatggagacacagtggtggtggtggagaaggaccacttcatggatgacttcttccaccaggtggaggagatccggaacagcattgacaagatcacccagtatgtggaggaggtgaagaagaaccacagcatcatcctgagcgcccccaaccctgagggcaagatcaaggaggagctggaggacctgaacaaggagatcaagaagacagccaacaagatccgggccaagctgaaggccatcgagcagagctttgaccaggatgagagcggcaacagaacatctgtggacctgcgcatccggaggacccagcacagcgtgctgagcaggaagtttgtggaggccatggccgagtacaatgaggcccagaccctcttccgggagaggagcaagggccgcatccagaggcagctggagatcactggaagaaccaccacagatgatgagctggaggagatgctggagagcggcaagcccagcatcttcaccagtgacatcatcagtgacagccagatcacccggcaggccctgaatgaaattgagagccgccacaaggacatcatgaagctggagaccagcatccgggagctgcacgagatgttcatggacatggccatgtttgtggagacccagggcgagatgatcaacaacatcgagagaaatgtgatgaatgccacagattatgtggagcacgccaaggaggagaccaagaaggccatcaagtaccagagcaaggcccggaggaagctgatgttcatcatcatctgtgtgattgtgctgctggtgatcctgggcatcatcctggccaccaccctgtcctag

SEQ ID NO: 172438 - DNA, 867 bp, Artificial Sequence
  Description of Artificial Sequence: Synthetic coding sequence
atgagggaccggctgcctgacctgacagcctgcaggaagaatgatgatggagacacagtggtggtggtggagaaggaccacttcatggatgacttcttccaccaggtggaggagatccggaacagcattgacaagatcacccagtatgtggaggaggtgaagaagaaccacagcatcatcctgagcgcccccaaccctgagggcaagatcaaggaggagctggaggacctgaacaaggagatcaagaagacagccaacaagatccgggccaagctgaaggccatcgagcagagctttgaccaggatgagagcggcaacagaacatctgtggacctgcgcatccggaggacccagcacagcgtgctgagcaggaagtttgtggaggccatggccgagtacaatgaggcccagaccctcttccgggagaggagcaagggccgcatccagaggcagctggagatcactggaagaaccaccacagatgatgagctggaggagatgctggagagcggcaagcccagcatcttcaccagtgacatcatcagtgacagccagatcacccggcaggccctgaatgaaattgagagccgccacaaggacatcatgaagctggagaccagcatccgggagctgcacgagatgttcatggacatggccatgtttgtggagacccagggcgagatgatcaacaacatcgagagaaatgtgatgaatgccacagattatgtggagcacgccaaggaggagaccaagaaggccatcaagtaccagagcaaggcccggaggaagaagtggatcatcatcgctgtgtctgtggtgctggtggccatcatcgccctgatcatcggcctgtctgtgggcaagtag

SEQ ID NO: 172439 - DNA, 777 bp, Artificial Sequence
  Description of Artificial Sequence: Synthetic coding sequence
atggatgagttcttcagcgagattgaggagacccggctgaacatcgacaagatcagcgagcacgtggaggaggccaagaagctgtacagcatcatcctgagcgcccccatccctgagcccaagaccaaggatgacctggagcagctgaccacagagatcaagaagagggccaacaacgtgaggaacaagctgaagtccatggagaagcacattgaagaagatgaggtgcgcagcagcgctgacctgcgcatcaggaagagccagcacagcgtgctgagcaggaagtttgtggaggtgatgaccaagtacaatgaggcccaggtggacttccgggagaggagcaagggccgcatccagaggcagctggagatcaccgggaagaagaccacagatgaggagctggaggagatgctggagagcggcaacccagccatcttcaccagcggcatcatcgacagccagatcagcaagcaggccctgtctgaaattgagggccgccacaaggacatcgtgcggctggagagcagcatcaaggagctgcatgacatgttcatggacatcgccatgctggtggagaaccagggcgagatgctggacaacatcgagctgaatgtgatgcacacagtggaccacgtggagaaggccagagatgagaccaagaaggctgtgaagtaccagagccaggccaggaagaagctgatcatcatcatcgtgctggtggtggtgctgctgggcatcctggccctgatcatcggcctgtctgtgggcctgaactag

SEQ ID NO: 172440 - DNA, 870 bp, Artificial Sequence
  Description of Artificial Sequence: Synthetic coding sequence
atgaaggaccggctggagcagctgaaggccaagcagctgacccaggatgatgacacagatgctgtggagatcgccatcgacaacacagccttcatggatgagttcttcagcgagattgaggagacccggctgaacatcgacaagatcagcgagcacgtggaggaggccaagaagctgtacagcatcatcctgagcgcccccatccctgagcccaagaccaaggatgacctggagcagctgaccacagagatcaagaagagggccaacaacgtgaggaacaagctgaagtccatggagaagcacatcgaggaggatgaggtgcgcagcagcgctgacctgcgcatcaggaagagccagcacagcgtgctgagcaggaagtttgtggaggtgatgaccaagtacaatgaggcccaggtggacttccgggagaggagcaagggccgcatccagaggcagctggagatcaccgggaagaagaccacagatgaggagctggaggagatgctggagagcggcaacccagccatcttcaccagcggcatcatcgacagccagatcagcaagcaggccctgtctgaaattgagggccgccacaaggacatcgtgcggctggagagcagcatcaaggagctgcatgacatgttcatggacatcgccatgctggtggagaaccagggcgagatgctggacaacatcgagctgaatgtgatgcacacagtggaccacgtggagaaggccagagatgagaccaagaaggctgtgaagtaccagagccaggccaggaagaagctgatcatcatcatcgtgctggtggtggtgctgctgggcatcctggccctgatcatcggcctgtctgtgggcctgaactag

SEQ ID NO: 172441 - DNA, 543 bp, Artificial Sequence
  Description of Artificial Sequence: Synthetic coding sequence
atggagaagcacattgaagaagatgaggtgcgcagcagcgctgacctgcgcatcaggaagagccagcacagcgtgctgagcaggaagtttgtggaggtgatgaccaagtacaatgaggcccaggtggacttccgggagaggagcaagggccgcatccagaggcagctggagatcaccgggaagaagaccacagatgaggagctggaggagatgctggagagcggcaacccagccatcttcaccagcggcatcatcgacagccagatcagcaagcaggccctgtctgaaattgagggccgccacaaggacatcgtgcggctggagagcagcatcaaggagctgcatgacatgttcatggacatcgccatgctggtggagaaccagggctccatgattgacagaattgagaacaacatggaccagagcgtgggctttgtggagagagctgtggccgacaccaagaaggctgtgaagtaccagagcgaggcccggaggaagctgatcagcctgcagacaggagtggccaccctggtgttcagatag

SEQ ID NO: 172442 - DNA, 834 bp, Artificial Sequence
  Description of Artificial Sequence: Synthetic coding sequence
atgaaggaccggctggagcagctgaaggccaagcagctgacccaggatgatgacacagatgctgtggagatcgccatcgacaacacagccttcatggatgagttcttcagcgagattgaggagacccggctgaacatcgacaagatcagcgagcacgtggaggaggccaagaagctgtacagcatcatcctgagcgcccccatccctgagcccaagaccaaggatgacctggagcagctgaccacagagatcaagaagagggccaacaacgtgaggaacaagctgaagtccatggagaagcacatcgaggaggatgaggtgcgcagcagcgctgacctgcgcatcaggaagagccagcacagcgtgctgagcaggaagtttgtggaggtgatgaccaagtacaatgaggcccaggtggacttccgggagaggagcaagggccgcatccagaggcagctggagatcaccgggaagaagaccacagatgaggagctggaggagatgctggagagcggcaacccagccatcttcaccagcggcatcatcgacagccagatcagcaagcaggccctgtctgaaattgagggccgccacaaggacatcgtgcggctggagagcagcatcaaggagctgcatgacatgttcatggacatcgccatgctggtggagaaccagggcgagatgctggacaacatcgagctgaatgtgatgcacacagtggaccacgtggagaaggccagagatgagaccaagaaggctgtgaagtaccagagccaggccaggaagaagctgatcagcctgcagacaggagtggccaccctggtgttcagatag

SEQ ID NO: 172443 - DNA, 231 bp, Artificial Sequence
  Description of Artificial Sequence: Synthetic coding sequence
atgttcatggacatcgccatgctggtggagaaccagggcgagatgctggacaacatcgagctgaatgtgatgcacacagtggaccacgtggagaaggccagagatgagaccaagaaggctgtgaagtaccagagccaggccaggaagaagctgatcatcatcatcgtgctggtggtggtgctgctgggcatcctggccctgatcatcggcctgtctgtgggcctgaactag

SEQ ID NO: 172444 - DNA, 759 bp, Artificial Sequence
  Description of Artificial Sequence: Synthetic coding sequence
atgaaggaccggctggagcagctgaaggccaagcagctgacccaggatgatgacacagatgctgtggagatcgccatcgacaacacagccttcatggatgagttcttcagcgagattgaggagacccggctgaacatcgacaagatcagcgagcacgtggaggaggccaagaagctgtacagcatcatcctgagcgcccccatccctgagcccaagaccaaggatgacctggagcagctgaccacagagatcaagaagagggccaacaacgtgaggaacaagctgaagtccatggagaagcacatcgaggaggatgaggtgcgcagcagcgctgacctgcgcatcaggaagagccagcacagcgtgctgagcaggaagtttgtggaggtgatgaccaagtacaatgaggcccaggtggacttccgggagaggagcaagggccgcatccagaggcagctggagatcaccgggaagaagaccacagatgaggagctggaggagatgctggagagcggcaacccagccatcttcaccagcggcatcatcgacagccagatcagcaagcaggccctgtctgaaattgagggccgccacaaggacatcgtgcggctggagagcagcatcaaggagctgcatgacatgttcatggacatcgccatgctggtggagaaccagaagctgatcatcatcatcgtgctggtggtggtgctgctgggcatcctggccctgatcatcggcctgtctgtgggcctgaactag

SEQ ID NO: 172445 - DNA, 894 bp, Artificial Sequence
  Description of Artificial Sequence: Synthetic coding sequence
atgagggacaggacccatgagctgcggcagggagatgacagcagtgatgaggaggacaaggagcgggtggccctggtggtgcaccctggaacagcccggctgggcagcccagatgaggagttcttccacaaggtgaggaccatccggcagaccatcgtgaagctgggcaacaaggtgcaggagctggagaagcagcaggtgaccatcctggccacccccctgcctgaggagagcatgaagcaggagctgcagaacctgagagatgagatcaagcagctgggccgggagatccggctgcagctgaaggccatcgagccccagaaggaggaggctgatgagaactacaacagcgtgaacaccaggatgaggaagacccagcacggcgtgctgagccagcagtttgtggagctgatcaacaagtgcaacagcatgcagagcgagtaccgggagaagaatgtggagcgcatccggcggcagctgaagatcaccaatgccggcatggtgtctgatgaggagctggagcagatgctggacagcggccagagcgaggtgtttgtgagcaacatcctgaaggacacccaggtgacccggcaggccctgaatgagatcagcgcccggcacagcgagatccagcagctggagaggagcatccgggagctgcatgacatcttcaccttcctggccacagaggtggagatgcagggcgagatgatcaacagaattgagaagaacatcctgagcagcgctgactatgtggagcggggccaggagcacgtgaagacagccctggagaaccagaagaaggccaggaagaagaaggtgctgattgccatctgtgtgtccatcaccgtggtgctgctggccgtcatcattggagtgacagtggtgggctag

SEQ ID NO: 172446 - DNA, 888 bp, Artificial Sequence
  Description of Artificial Sequence: Synthetic coding sequence
atgggcatgacagcccggaccaagaggaccaggagcggcagccgctggtggtgcacccgggcccggcacggctggggcgcccggaccaggagcagcagcaccagccccctgggccaccccccccaggtgaggaccatccggcagaccatcgtgaagctgggcaacaaggtgcaggagctggagaagcagcaggtgaccatcctggccacccccctgcctgaggagagcatgaagcaggagctgcagaacctgagagatgagatcaagcagctgggccgggagatccggctgcagctgaaggccatcgagccccagaaggaggaggctgatgagaactacaacagcgtgaacaccaggatgaggaagacccagcacggcgtgctgagccagcagtttgtggagctgatcaacaagtgcaacagcatgcagagcgagtaccgggagaagaatgtggagcgcatccggcggcagctgaagatcaccaatgccggcatggtgtctgatgaggagctggagcagatgctggacagcggccagagcgaggtgtttgtgagcaacatcctgaaggacacccaggtgacccggcaggccctgaatgagatcagcgcccggcacagcgagatccagcagctggagaggagcatccgggagctgcatgacatcttcaccttcctggccacagaggtggagatgcagggcgagatgatcaacagaattgagaagaacatcctgagcagcgctgactatgtggagcggggccaggagcacgtgaagacagccctggagaaccagaagaaggccaggaagaagaaggtgctgattgccatctgtgtgtccatcaccgtggtgctgctggccgtcatcattggagtgacagtggtgggctag

SEQ ID NO: 172447 - DNA, 1068 bp, Artificial Sequence
  Description of Artificial Sequence: Synthetic coding sequence
atgatccccaggaagagatatggcagcaagaacacagaccagggcgtgtacctgggcctgagcaagacccaggtgctgagccctgccacagctggcagcagcagcagtgacatcgcccccctgcccccacctgtgaccctggtgcccccacctccagacaccatgagctgccgggacaggacccaggagttcctgagcgcctgcaagagcctgcagacccggcagaatggcatccagaccaacaagccagccctgcgggctgtgcggcagaggtctgagttcaccctgatggccaagagaattggcaaggacctgagcaacacctttgccaagctggagaagctgaccatcctggccaagaggaagagcctgtttgatgacaaggctgtggagattgaggagctgacctacatcatcaagcaggacatcaacagcctgaacaagcagatcgcccagctgcaggactttgtgcgggccaagggcagccagagcggccgccacctgcagacccacagcaacaccatcgtggtgtccctgcagagcaagctggcctccatgagcaatgacttcaagtctgtgctggaggtgaggacagagaacctgaagcagcagaggagcagaagagagcagttcagccgggcccctgtgtctgccctgcccctggcccccaaccacctgggcggcggcgctgtggtgctgggcgctgagagccacgccagcaaggatgtggccatcgacatgatggacagcaggaccagccagcagctgcagctgattgatgagcaggacagctacatccagagcagagctgacaccatgcagaacatcgagagcaccatcgtggagctgggcagcatcttccagcagctggcccacatggtgaaggagcaggaggagaccatccagagaattgatgaaaatgtgctgggcgcccagctggatgtggaggccgcccacagcgagatcctgaagtacttccagagcgtgaccagcaaccgctggctgatggtgaagatcttcctgatcctgattgtgttcttcatcatctttgtggtgttcctggcctag

SEQ ID NO: 172448 - DNA, 966 bp, Artificial Sequence
  Description of Artificial Sequence: Synthetic coding sequence
atgatccccaggaagagatatggcagcaagaacacagaccagggcgtgtacctgggcctgagcaagacccaggtgctgagccctgccacagctggcagcagcagcagtgacatcgcccccctgcccccacctgtgaccctggtgcccccacctccagacaccatgagctgccgggacaggacccaggagttcctgagcgcctgcaagagcctgcagacccggcagaatggcatccagaccaacaagccagccctgcgggctgtgcggcagaggtctgagttcaccctgatggccaagagaattggcaaggacctgagcaacacctttgccaagctggagaagctgaccatcctggccaagaggaagagcctgtttgatgacaaggctgtggagattgaggagctgacctacatcatcaagcaggacatcaacagcctgaacaagcagatcgcccagctgcaggactttgtgcgggccaagggcagccagagcggccgccacctgcagacccacagcaacaccatcgtggtgtccctgcagagcaagctggcctccatgagcaatgacttcaagtctgtgctggaggtgaggacagagaacctgaagcagcagaggagcagaagagagcagttcagccgggcccctgtgtctgccctgcccctggcccccaaccacctgggcggcggcgctgtggtgctgggcgctgagagccacgccagcaaggatgtggccatcgacatgatggacagcaggaccagccagcagctgcagctgattgatgagcaggacagctacatccagagcagagctgacaccatgcagaacatcgagagcaccatcgtggagctgggcagcatcttccagcagctggcccacatggtgaaggagcaggaggagaccatccagagcgtgctgctcttccccctgctgcctgccctgagccctggcagcaccaggacctgctag

SEQ ID NO: 172449 - DNA, 906 bp, Artificial Sequence
  Description of Artificial Sequence: Synthetic coding sequence
atgagctgccgggacaggacccaggagttcctgagcgcctgcaagagcctgcagacccggcagaatggcatccagaccaacaagccagccctgcgggctgtgcggcagaggtctgagttcaccctgatggccaagagaattggcaaggacctgagcaacacctttgccaagctggagaagctgaccatcctggccaagaggaagagcctgtttgatgacaaggctgtggagattgaggagctgacctacatcatcaagcaggacatcaacagcctgaacaagcagatcgcccagctgcaggactttgtgcgggccaagggcagccagagcggccgccacctgcagacccacagcaacaccatcgtggtgtccctgcagagcaagctggcctccatgagcaatgacttcaagtctgtgctggaggtgaggacagagaacctgaagcagcagaggagcagaagagagcagttcagccgggcccctgtgtctgccctgcccctggcccccaaccacctgggcggcggcgctgtggtgctgggcgctgagagccacgccagcaaggatgtggccatcgacatgatggacagcaggaccagccagcagctgcagctgattgatgagcaggacagctacatccagagcagagctgacaccatgcagaacatcgagagcaccatcgtggagctgggcagcatcttccagcagctggcccacatggtgaaggagcaggaggagaccatccagagaattgatgaaaatgtgctgggcgcccagctggatgtggaggccgcccacagcgagatcctgaagtacttccagagcgtgaccagcaaccgctggctgatggtgaagatcttcctgatcctgattgtgttcttcatcatctttgtggtgttcctggcctag

SEQ ID NO: 172450 - DNA, 780 bp, Artificial Sequence
  Description of Artificial Sequence: Synthetic coding sequence
atggccaagagaattggcaaggacctgagcaacacctttgccaagctggagaagctgaccatcctggccaagaggaagagcctgtttgatgacaaggctgtggagattgaggagctgacctacatcatcaagcaggacatcaacagcctgaacaagcagatcgcccagctgcaggactttgtgcgggccaagggcagccagagcggccgccacctgcagacccacagcaacaccatcgtggtgtccctgcagagcaagctggcctccatgagcaatgacttcaagtctgtgctggaggtgaggacagagaacctgaagcagcagaggagcagaagagagcagttcagccgggcccctgtgtctgccctgcccctggcccccaaccacctgggcggcggcgctgtggtgctgggcgctgagagccacgccagcaaggatgtggccatcgacatgatggacagcaggaccagccagcagctgcagctgattgatgagcaggacagctacatccagagcagagctgacaccatgcagaacatcgagagcaccatcgtggagctgggcagcatcttccagcagctggcccacatggtgaaggagcaggaggagaccatccagagaattgatgaaaatgtgctgggcgcccagctggatgtggaggccgcccacagcgagatcctgaagtacttccagagcgtgaccagcaaccgctggctgatggtgaagatcttcctgatcctgattgtgttcttcatcatctttgtggtgttcctggcctag

SEQ ID NO: 172451 - DNA, 720 bp, Artificial Sequence
  Description of Artificial Sequence: Synthetic coding sequence
atgagctacaccccaggagtgggcggggaccctgcccagctggcccagaggatcagcagcaacatccagaagatcacccagtgcagcgtggagatccagaggaccctgaaccagctgggcaccccccaggacagccctgagctgcggcagcagctgcagcagaagcagcagtacaccaaccagctggccaaggagacagacaagtacatcaaggagtttggcagcctgcccaccaccccatctgagcagaggcagaggaagatccagaaggaccggctggtggccgagttcaccaccagcctgaccaacttccagaaggtgcagaggcaggccgctgagcgggagaaggagtttgtggcccgggtgcgggccagcagccgggtgtctggcagcttccctgaggacagcagcaaggagaggaacctggtgtcctgggagagccagacccagccccaggtgcaggtgcaggatgaggagatcacagaagatgacctgcggctcatccacgagcgggagagcagcatccggcagctggaggccgacatcatggacatcaatgagatcttcaaggacctgggcatgatgattcatgagcagggagatgtgattgacagcattgaggccaacgtggagaatgctgaggtgcacgtgcagcaggccaaccagcagctgagcagagctgctgactaccagaagaaggacagctgcatgctgatgtag

SEQ ID NO: 172452 - DNA, 786 bp, Artificial Sequence
  Description of Artificial Sequence: Synthetic coding sequence
atgagctacaccccaggagtgggcggggaccctgcccagctggcccagaggatcagcagcaacatccagaagatcacccagtgcagcgtggagatccagaggaccctgaaccagctgggcaccccccaggacagccctgagctgcggcagcagctgcagcagaagcagcagtacaccaaccagctggccaaggagacagacaagtacatcaaggagtttggcagcctgcccaccaccccatctgagcagaggcagaggaagatccagaaggaccggctggtggccgagttcaccaccagcctgaccaacttccagaaggtgcagaggcaggccgctgagcgggagaaggagtttgtggcccgggtgcgggccagcagccgggtgtctggcagcttccctgaggacagcagcaaggagaggaacctggtgtcctgggagagccagacccagccccaggtgcaggtgcaggatgaggagatcacagaagatgacctgcggctcatccacgagcgggagagcagcatccggcagctggaggccgacatcatggacatcaatgagatcttcaaggacctgggcatgatgattcatgagcagggagatgtgattgacagcattgaggccaacgtggagaatgctgaggtgcacgtgcagcaggccaaccagcagctgagcagagctgctgactaccagaggaagagcaggaagaccctgtgcatcatcatcctgatcctggtgattggagtggccatcatcagcctcatcatctggggcctgaaccactag

SEQ ID NO: 172453 - DNA, 786 bp, Artificial Sequence; identical to SEQ ID NO: 172452
  Description of Artificial Sequence: Synthetic coding sequence

SEQ ID NO: 172454 - DNA, 711 bp, Artificial Sequence
  Description of Artificial Sequence: Synthetic coding sequence
atggccccagacccctggttcagcacctatgacagcacctgccagatcgcccaggagattgctgagaagatccagcagaggaaccagtatgaaagaaaaggagagaaggcccccaagctgactgtgaccatccgggccctgctgcagaacctgaaggagaagatcgccctgctgaaggacctgctgctgcgggctgtgtccacccaccagatcacccagctggagggggaccggcggcagaacctgctggatgacctggtgacccgggagcggctgctgctggccagcttcaagaatgaaggagctgagccagacctgatccgcagcagcctgatgtctgaggaggccaagagaggagcccccaacccctggctgtttgaggagcctgaggagacccggggcctgggctttgatgagatccggcagcagcagcagaagatcatccaggagcaggatgctggcctggatgccctgagcagcatcatcagccggcagaagcagatgggccaggagattggaaatgagctggatgagcagaatgagatcattgatgacctggccaacctggtggagaacacagatgagaagctgagaaatgagacccggcgggtgaacatggtggacaggaagagcgccagctgtggcatgatcatggtgatcctgctgctgctggtggccatcgtggtggtggccgtgtggcccaccaactag

SEQ ID NO: 172455 - DNA, 1785 bp, Artificial Sequence
  Description of Artificial Sequence: Synthetic coding sequence
atggcccccatcggcctgaaggctgtggtgggggagaagatcatgcatgatgtgatcaagaaggtgaagaagaagggggagtggaaggtgctggtggtggaccagctgtccatgaggatgctgagcagctgctgcaagatgacagacatcatgacagagggcatcaccatcgtggaggacatcaacaagaggcgggagcccctgcccagcctggaggccgtgtacctgatcacccccagcgagaagtctgtgcacagcctcatcagtgacttcaaggaccccccaacagccaagtacagagctgcccacgtgttcttcacagacagctgcccagatgccctcttcaatgagctggtgaagagcagagctgccaaggtgatcaagaccctgacagagatcaacatcgccttcctgccctatgagagccaggtgtacagcctggacagcgctgacagcttccagagcttctacagcccccacaaggcccagatgaagaaccccatcctggagcggctggccgagcagatcgccaccctgtgtgccaccctgaaggagtacccagctgtgcgctacagaggagagtacaaggacaatgccctgctggcccagctgatccaggacaagctggatgcctacaaggcagatgaccccaccatgggagagggccctgacaaggcccggagccagctgctgatcctggaccggggctttgaccccagcagccctgtgctgcacgagctgaccttccaggccatgtcctatgacctgctgcccattgaaaatgatgtgtacaagtatgagaccagcggcattggagaggcccgggtgaaggaggtgctgctggatgaagatgatgacctgtggatcgccctgcggcacaagcacatcgccgaggtgtcccaggaggtgaccaggagcctgaaggacttcagcagcagcaagaggatgaacacaggagagaagaccaccatgagggacctgagccagatgctgaagaagatgccccagtaccagaaggagctgagcaagtacagcacccacctgcacctggccgaggactgcatgaagcactaccagggcaccgtggacaagctgtgccgggtggagcaggacctggccatgggcacagatgctgagggggagaagatcaaggaccccatgagggccatcgtgcccatcctgctggatgccaacgtgtccacctatgacaagatccgcatcatcctgctgtacatcttcctgaagaatggcatcacagaggagaacctgaacaagctgatccagcacgcccagatccccccagaagattctgagatcatcaccaacatggcccacctgggcgtgcccatcgtgacagacagcaccctgcggcggcgcagcaagccagagaggaaggagcgcatcagcgagcagacctaccagctgagccgctggacccccatcatcaaggacatcatggaggacaccatcgaggacaagctggacaccaagcactacccctacatcagcaccaggagcagcgccagcttcagcaccacagctgtgtctgcccgctatggccactggcacaagaacaaggcccctggagagtacagaagtggccccaggctcatcatcttcatcctgggcggcgtgtccctgaatgagatgagatgtgcctatgaggtgacccaggccaacgggaagtgggaggtgctgattggcagcacccacatcctgaccccccagaagctgctggacaccctgaagaagctgaacaagacagatgaggagatcagcagctag

SEQ ID NO: 172456 - DNA, 1674 bp, Artificial Sequence
  Description of Artificial Sequence: Synthetic coding sequence
atgacagacatcatgacagagggcatcaccatcgtggaggacatcaacaagaggcgggagcccctgcccagcctggaggccgtgtacctgatcacccccagcgagaagtctgtgcacagcctcatcagtgacttcaaggaccccccaacagccaagtacagagctgcccacgtgttcttcacagacagctgcccagatgccctcttcaatgagctggtgaagagcagagctgccaaggtgatcaagaccctgacagagatcaacatcgccttcctgccctatgagagccaggtgtacagcctggacagcgctgacagcttccagagcttctacagcccccacaaggcccagatgaagaaccccatcctggagcggctggccgagcagatcgccaccctgtgtgccaccctgaaggagtacccagctgtgcgctacagaggagagtacaaggacaatgccctgctggcccagctgatccaggacaagctggatgcctacaaggcagatgaccccaccatgggagagggccctgacaaggcccggagccagctgctgatcctggaccggggctttgaccccagcagccctgtgctgcacgagctgaccttccaggccatgtcctatgacctgctgcccattgaaaatgatgtgtacaagtatgagaccagcggcattggagaggcccgggtgaaggaggtgctgctggatgaagatgatgacctgtggatcgccctgcggcacaagcacatcgccgaggtgtcccaggaggtgaccaggagcctgaaggacttcagcagcagcaagaggatgaacacaggagagaagaccaccatgagggacctgagccagatgctgaagaagatgccccagtaccagaaggagctgagcaagtacagcacccacctgcacctggccgaggactgcatgaagcactaccagggcaccgtggacaagctgtgccgggtggagcaggacctggccatgggcacagatgctgagggggagaagatcaaggaccccatgagggccatcgtgcccatcctgctggatgccaacgtgtccacctatgacaagatccgcatcatcctgctgtacatcttcctgaagaatggcatcacagaggagaacctgaacaagctgatccagcacgcccagatccccccagaagattctgagatcatcaccaacatggcccacctgggcgtgcccatcgtgacagacagcaccctgcggcggcgcagcaagccagagaggaaggagcgcatcagcgagcagacctaccagctgagccgctggacccccatcatcaaggacatcatggaggacaccatcgaggacaagctggacaccaagcactacccctacatcagcaccaggagcagcgccagcttcagcaccacagctgtgtctgcccgctatggccactggcacaagaacaaggcccctggagagtacagaagtggccccaggctcatcatcttcatcctgggcggcgtgtccctgaatgagatgagatgtgcctatgaggtgacccaggccaacgggaagtgggaggtgctgattggcagcacccacatcctgacccccaccaagttcctgatggacctgcggcacccagacttccgggagagcagccgggtgtcctttgaggaccaggcccccaccatggagtag

SEQ ID NO: 172457 - DNA, 1308 bp, Artificial Sequence
  Description of Artificial Sequence: Synthetic coding sequence
atggcccccatcggcctgaaggctgtggtgggggagaagatcatgcatgatgtgatcaagaaggtgaagaagaagggggagtggaaggtgctggtggtggaccagctgtccatgaggatgctgagcagctgctgcaagatgacagacatcatgacagagggccctgacaaggcccggagccagctgctgatcctggaccggggctttgaccccagcagccctgtgctgcacgagctgaccttccaggccatgtcctatgacctgctgcccattgaaaatgatgtgtacaagtatgagaccagcggcattggagaggcccgggtgaaggaggtgctgctggatgaagatgatgacctgtggatcgccctgcggcacaagcacatcgccgaggtgtcccaggaggtgaccaggagcctgaaggacttcagcagcagcaagaggatgaacacaggagagaagaccaccatgagggacctgagccagatgctgaagaagatgccccagtaccagaaggagctgagcaagtacagcacccacctgcacctggccgaggactgcatgaagcactaccagggcaccgtggacaagctgtgccgggtggagcaggacctggccatgggcacagatgctgagggggagaagatcaaggaccccatgagggccatcgtgcccatcctgctggatgccaacgtgtccacctatgacaagatccgcatcatcctgctgtacatcttcctgaagaatggcatcacagaggagaacctgaacaagctgatccagcacgcccagatccccccagaagattctgagatcatcaccaacatggcccacctgggcgtgcccatcgtgacagacagcaccctgcggcggcgcagcaagccagagaggaaggagcgcatcagcgagcagacctaccagctgagccgctggacccccatcatcaaggacatcatggaggacaccatcgaggacaagctggacaccaagcactacccctacatcagcaccaggagcagcgccagcttcagcaccacagctgtgtctgcccgctatggccactggcacaagaacaaggcccctggagagtacagaagtggccccaggctcatcatcttcatcctgggcggcgtgtccctgaatgagatgagatgtgcctatgaggtgacccaggccaacgggaagtgggaggtgctgattggcagcacccacatcctgacccccaccaagttcctgatggacctgcggcacccagacttccgggagagcagccgggtgtcctttgaggaccaggcccccaccatggagtag

SEQ ID NO: 172458 - DNA, 1812 bp, Artificial Sequence
  Description of Artificial Sequence: Synthetic coding sequence
atggcccccatcggcctgaaggctgtggtgggggagaagatcatgcatgatgtgatcaagaaggtgaagaagaagggggagtggaaggtgctggtggtggaccagctgtccatgaggatgctgagcagctgctgcaagatgacagacatcatgacagagggcatcaccatcgtggaggacatcaacaagaggcgggagcccctgcccagcctggaggccgtgtacctgatcacccccagcgagaagtctgtgcacagcctcatcagtgacttcaaggaccccccaacagccaagtacagagctgcccacgtgttcttcacagacagctgcccagatgccctcttcaatgagctggtgaagagcagagctgccaaggtgatcaagaccctgacagagatcaacatcgccttcctgccctatgagagccaggtgtacagcctggacagcgctgacagcttccagagcttctacagcccccacaaggcccagatgaagaaccccatcctggagcggctggccgagcagatcgccaccctgtgtgccaccctgaaggagtacccagctgtgcgctacagaggagagtacaaggacaatgccctgctggcccagctgatccaggacaagctggatgcctacaaggcagatgaccccaccatgggagagggccctgacaaggcccggagccagctgctgatcctggaccggggctttgaccccagcagccctgtgctgcacgagctgaccttccaggccatgtcctatgacctgctgcccattgaaaatgatgtgtacaagtatgagaccagcggcattggagaggcccgggtgaaggaggtgctgctggatgaagatgatgacctgtggatcgccctgcggcacaagcacatcgccgaggtgtcccaggaggtgaccaggagcctgaaggacttcagcagcagcaagaggatgaacacaggagagaagaccaccatgagggacctgagccagatgctgaagaagatgccccagtaccagaaggagctgagcaagtacagcacccacctgcacctggccgaggactgcatgaagcactaccagggcaccgtggacaagctgtgccgggtggagcaggacctggccatgggcacagatgctgagggggagaagatcaaggaccccatgagggccatcgtgcccatcctgctggatgccaacgtgtccacctatgacaagatccgcatcatcctgctgtacatcttcctgaagaatggcatcacagaggagaacctgaacaagctgatccagcacgcccagatccccccagaagattctgagatcatcaccaacatggcccacctgggcgtgcccatcgtgacagacagcaccctgcggcggcgcagcaagccagagaggaaggagcgcatcagcgagcagacctaccagctgagccgctggacccccatcatcaaggacatcatggaggacaccatcgaggacaagctggacaccaagcactacccctacatcagcaccaggagcagcgccagcttcagcaccacagctgtgtctgcccgctatggccactggcacaagaacaaggcccctggagagtacagaagtggccccaggctcatcatcttcatcctgggcggcgtgtccctgaatgagatgagatgtgcctatgaggtgacccaggccaacgggaagtgggaggtgctgattggcagcacccacatcctgacccccaccaagttcctgatggacctgcggcacccagacttccgggagagcagccgggtgtcctttgaggaccaggcccccaccatggagtag

SEQ ID NO: 172459 - DNA, 1389 bp, Artificial Sequence
  Description of Artificial Sequence: Synthetic coding sequence
atggcccccaccatccagacccaggcccagcgggaggatggccacaggtctggagtggtgtgccgggtgaagtactgcaacagcctgcctgacatcccctttgaccccaagttcatcacctacccctttgaccagaacagatttgtgcagtacaaggccaccagcctggagaagcagcacaagcatgacctgctgacagagccagacctgggcgtgaccatcgacctgatcaacccagacacctacagaattgaccccaacgtgctgctggaccctgcagatgagaagctgctggaggaggagatccaggcccccaccagcagcaagaggagccagcagcacgccaaggtggtgccctggatgaggaagacagagtacatcagcacagagttcaacagatatggcatcagcaatgagaagccagaggtgaagattggagtgtctgtgaagcagcagttcacagaggaggagatctacaaggaccgggacagccagatcacagccatcgagaagacctttgaagatgcccagaagtccatgtggatcaacccctgtgcccaggtgatctttgacagcgaccctgcccccaaggacaccagcggggctgctgccctggagatgatgagccaggccatgatccggggcatgatggatgaggagggcaaccagtttgtggcctacttcctgcctgtggaggagaccctgaagaagaggaagagggaccaggaggaggagatggactatgccccagatgatgtgtatgactacaagatcgcccgggagtacaactggaatgtgaagaacaaggccagcaagggctatgaggagaactacttcttcatcttccgggagggagatggagtgtactacaatgagctggagaccagggtgcggctgagcaagaggcgggccaaggccggcgtgcagagcggcaccaatgccctgctggtggtgaagcaccgggacatgaatgagaaggagctggaggcccaggaggccaggaaggcccagctggagaaccacgagcctgaggaggaggaggaggaggagatggagacagaggagaaggaggccggcggctctgtgatgctgatcctgcggaccatgcccaccctgatgatgaggacagaagatcggcccaaggtggccgtgaccatgatccagacagctgctgccatgggcgtggccagcggggccggggccacagctgctgcccctgtgcccagccctgtggccgccagcacccggcccaggaggatggctgtgaagctgcagctgctgatccctgtgaagctgattgtgacagtgacagagagccagggcatccagggctggttccgccaccactactgtgagcagcagagcaccttcctggtggtgtgcctgtag

SEQ ID NO: 172460 - DNA, 1197 bp, Artificial Sequence
  Description of Artificial Sequence: Synthetic coding sequence
atgtgcatccgggtgcacgtgtccatgtgcatgtgcatgtgtgtgcacgtgtgtgtgcacctgtgcatgcacgtgtgtgctgtgtgcatgtgtgtgtatgtgtgtgtgtgtgtgcacgtgcacgtgtgtgcctctgtgtgtgcctttgtgtgcatgtgtgtgtgtgtgtgtgtgtgtggctctgtgtgtgcctttgtgtctgtgcacgtgtgcatgagggtgtatgtgtgtgtgtgcatctgtgtgcacctgtatgtgtgtgtgtgtgtgtgcctgtgtgcctgtgtgtatgcctgtgtgtgcatgtgcctgcggctgtgtgtgcggctgtgtgtgtctgtgtgtgcctgtgtgtatgcctgcatctgcatgtgcatctgtgtgcacgtgtccatgtatgtgtgtgcctctgtgtgtgcctgtgtgtgtgtgtgtgtgtgtgtgtgtgtgtgcatgagggtgtgtgcccaccagtgcctgcacgtgtgcatctgtgtgtatgtgtgtgcccgcatctgtgtgtgtgcctgtgtgtatgtgtgtgtgtgcatctctgtgtgtgcctgtgtgtatgtgtgtgtgcacctgtgtgtgtgtgcctgtgtgcacgcctgtgtgtgtgtgtgtgcctgtgtgcacctgtgtgtgtgtgcctgtgcccacgtgggcgccaccctggtgtgcatctgcacctacacctgcccccggcccagcatgtttgcccacggcggccgctggggcgtggccggccggccccggcagcccatgagcctgggcgtgcaggcccaggcccagagggtcatccacctgccccagagcgtgcaggccctgatcaaggacttccagggcacccccaccttcacctacaaggccgcccacatcttcttcacagacacctgcccagagcccctcttcagcgagctgggccgcagccggctggccaaggtggtgaagaccctgaaggagatccacctggccttcctgccctatgaggcccaggtgcggcccggcctcatcctgggccggggctggggctttgtgaccaagtgccccctcttcccccagaagcagaccctgcggctgggcgctgtggcccacacctgcaaccccagcgctgtgggcggccagggccgccgcatcacctggggccaggagtttgagaccagcctgggcacagagcaggaccctgtgtcctag

SEQ ID NO: 172461 - DNA, 1773 bp, Artificial Sequence
  Description of Artificial Sequence: Synthetic coding sequence
atggcccccagcggcctgaaggctgtggtgggggagaagatcctgagcggggtcatccgctctgtgaagaaggatggagagtggaaggtgctgatcatggaccaccccagcatgaggatcctgagcagctgctgcaagatgtctgacatcctggccgagggcatcaccatcgtggaggacatcaacaagaggcgggagcccatccccagcctggaggccatctacctgctgagccccacagagaaggccctgatcaaggacttccagggcacccccaccttcacctacaaggccgcccacatcttcttcacagacacctgcccagagcccctcttcagcgagctgggccgcagccggctggccaaggtggtgaagaccctgaaggagatccacctggccttcctgccctatgaggcccaggtgttcagcctggatgccccccacagcacctacaacctgtactgccccttccgggcagaggagaggacccggcagctggaggtgctggcccagcagatcgccaccctgtgtgccaccctgcaggagtacccagccatccgctacaggaagggccctgaggacacagcccagctggcccatgctgtgctggccaagctgaatgccttcaaggctgacacccccagcctgggggagggccctgagaagaccaggagccagctgctgatcatggacagagctgctgaccctgtgagccccctgctgcacgagctgaccttccaggccatggcctatgacctgctggacatcgagcaggacacctaccgctatgagaccaccggcctgtctgaggcccgggagaaggctgtgctgctggatgaagatgatgacctgtgggtggagctgcggcacatgcacatcgcagatgtgtccaagaaggtgacagagctgctgcggaccttctgtgagagcaagaggctgaccacagacaaggccaacatcaaggacctgagccagatcctgaagaagatgccccagtaccagaaggagctgaacaagtacagcacccacctgcacctggctgatgactgcatgaagcacttcaagggctctgtggagaagctgtgcagcgtggagcaggacctggccatgggcagtgatgctgagggggagaagatcaaggacagcatgaagctgattgtgcctgtgctgctggatgctgctgtgcctgcctatgacaagatccgggtgctgctgctgtacatcctgctgagaaatggagtgtctgaggagaacctggccaagctgatccagcacgccaacgtgcaggcccacagcagcctcatccggaacctggagcagctgggcggcaccgtgaccaaccctgggggcagcggcaccagcagccggctggagccccgggagaggatggagcccacctaccagctgagccgctggacccctgtgatcaaggatgtgatggaggatgctgtggaggaccggctggacaggaacctgtggccctttgtgtctgaccctgcccccacagccagcagccaggccgctgtgtctgccaggtttggccactggcacaagaacaaggccggcatcgaggcccgggccggccccaggctcatcgtgtatgtgatgggcggcgtggccatgtctgagatgagagctgcctatgaggtgacccgggccacagagggcaagtgggaggtgctgattggcagcagccacatcctgacccccacccgcttcctggatgacctgaaggccctggacaagaagctggaggacatcgccctgccctag

SEQ ID NO: 172462 - DNA, 1815 bp, Artificial Sequence
  Description of Artificial Sequence: Synthetic coding sequence
atggcccccagcggcctgaaggctgtggtgggggagaagatcctgagcggggtcatccgctctgtgaagaaggatggagagtggaaggtgctgatcatggaccaccccagcatgaggatcctgagcagctgctgcaagatgtctgacatcctggccgagggcatcaccatcgtggaggacatcaacaagaggcgggagcccatccccagcctggaggccatctacctgctgagccccacagagaaggcccaggcccagagggtcatccacctgccccagagcgtgcaggccctgatcaaggacttccagggcacccccaccttcacctacaaggccgcccacatcttcttcacagacacctgcccagagcccctcttcagcgagctgggccgcagccggctggccaaggtggtgaagaccctgaaggagatccacctggccttcctgccctatgaggcccaggtgttcagcctggatgccccccacagcacctacaacctgtactgccccttccgggcagaggagaggacccggcagctggaggtgctggcccagcagatcgccaccctgtgtgccaccctgcaggagtacccagccatccgctacaggaagggccctgaggacacagcccagctggcccatgctgtgctggccaagctgaatgccttcaaggctgacacccccagcctgggggagggccctgagaagaccaggagccagctgctgatcatggacagagctgctgaccctgtgagccccctgctgcacgagctgaccttccaggccatggcctatgacctgctggacatcgagcaggacacctaccgctatgagaccaccggcctgtctgaggcccgggagaaggctgtgctgctggatgaagatgatgacctgtgggtggagctgcggcacatgcacatcgcagatgtgtccaagaaggtgacagagctgctgcggaccttctgtgagagcaagaggctgaccacagacaaggccaacatcaaggacctgagccagatcctgaagaagatgccccagtaccagaaggagctgaacaagtacagcacccacctgcacctggctgatgactgcatgaagcacttcaagggctctgtggagaagctgtgcagcgtggagcaggacctggccatgggcagtgatgctgagggggagaagatcaaggacagcatgaagctgattgtgcctgtgctgctggatgctgctgtgcctgcctatgacaagatccgggtgctgctgctgtacatcctgctgagaaatggagtgtctgaggagaacctggccaagctgatccagcacgccaacgtgcaggcccacagcagcctcatccggaacctggagcagctgggcggcaccgtgaccaaccctgggggcagcggcaccagcagccggctggagccccgggagaggatggagcccacctaccagctgagccgctggacccctgtgatcaaggatgtgatggaggatgctgtggaggaccggctggacaggaacctgtggccctttgtgtctgaccctgcccccacagccagcagccaggccgctgtgtctgccaggtttggccactggcacaagaacaaggccggcatcgaggcccgggccggccccaggctcatcgtgtatgtgatgggcggcgtggccatgtctgagatgagagctgcctatgaggtgacccgggccacagagggcaagtgggaggtgctgattggcagcagccacatcctgacccccacccgcttcctggatgacctgaaggccctggacaagaagctggaggacatcgccctgccctag

SEQ ID NO: 172463 - DNA, 1740 bp, Artificial Sequence
  Description of Artificial Sequence: Synthetic coding sequence
atggcccccagcggcctgaaggctgtggtgggggagaagatcctgagcggggtcatccgctctgtgaagaaggatggagagtggaaggtgctgatcatggaccaccccagcatgaggatcctgagcagctgctgcaagatgtctgacatcctggccgagggcatcaccatcgtggaggacatcaacaagaggcgggagcccatccccagcctggaggccatctacctgctgagccccacagagaagtctgtgcaggccctgatcaaggacttccagggcacccccaccttcacctacaaggccgcccacatcttcttcacagacacctgcccagagcccctcttcagcgagctgggccgcagccggctggccaaggtggtgaagaccctgaaggagatccacctggccttcctgccctatgaggcccaggtgttcagcctggatgccccccacagcacctacaacctgtactgccccttccgggcagaggagaggacccggcagctggaggtgctggcccagcagatcgccaccctgtgtgccaccctgcaggagtacccagccatccgctacagaaaaggacctgaggacacagcccagctggcccatgctgtgctggccaagctgaatgccttcaaggctgacacccccagcctgggggagggccctgagaagaccaggagccagctgctgatcatggacagagctgctgaccctgtgagccccctgctgcacgagctgaccttccaggccatggcctatgacctgctggacatcgagcaggacacctaccgctatgagaccaccggcctgtctgaggcccgggagaaggctgtgctgctggatgaagatgatgacctgtgggtggagctgcggcacatgcacatcgcagatgtgtccaagaaggtgacagagctgctgcggaccttctgtgagagcaagaggctgaccacagacaaggccaacatcaaggacctgagccagatcctgaagaagatgccccagtaccagaaggagctgaacaagtacagcacccacctgcacctggctgatgactgcatgaagcacttcaagggctctgtggagaagctgtgcagcgtggagcaggacctggccatgggcagtgatgctgagggggagaagatcaaggacagcatgaagctgattgtgcctgtgctgctggatgctgctgtgcctgcctatgacaagatccgggtgctgctgctgtacatcctgctgagaaatggagtgtctgaggagaacctggccaagctgatccagcacgccaacgtgcaggcccacagcagcctcatccggaacctggagcagctgggcggcaccgtgaccaaccctgggggcagcggcaccagcagccggctggagccccgggagaggatggagcccacctaccagctgagccgctggacccctgtgatcaaggatgtgatggaggatgctgtggaggaccggctggacaggaacctgtggccctttgtgtctgaccctgcccccacagccagcagccaggccgctgtgtctgcccgcttcggccactggcacaagaacaaggccggcatcgaggcccgggccggcccccggctgattgtgtatgtgatgggcggcgtggccatgtctgagatgagagctgcctatgaggtgacccgggccacagagggcagcggccgctgcagcctggccccccacaccagcagccccaggcctgcctcctggatgacctag

SEQ ID NO: 172464 - DNA, 2421 bp, Artificial Sequence
  Description of Artificial Sequence: Synthetic coding sequence
atgcacggcaagagcacagctgtgctggagatggactacagcatcgtggacttcctgaccctgtgtgagaccccctacccaaatgacttccaggagccctatgctgtggtggtgctgctggagaaggacctggtgctgattgacctggcccagaatggctaccccatctttgagaacccctaccccctgagcatccacgagagccctgtgacctgctgtgagtactttgctgactgccctgtggacctgatcccagccctgtacagcgtgggcgcccggcagaagaggcagggctacagcaagaaggagtggcccatcaatggaggcaactggggcctgggcgcccagagctacccagagatcatcatcaccggccatgctgatggctctgtgaagttctgggatgccagcgccatcaccctgcaggtgctgtacaagctgaagaccagcaaggtgtttgagaagagcaggaacaaggatgaccggcccaacacagacatcgtggatgaggacccctatgccatccagatcatctcctggtgcccagagagcaggatgctgtgcatcgccggcgtgtctgcccacgtgatcatctaccgcttcagcaagcaggaggtgatcacagaggtgatccccatgctggaggtgcggctgctgtatgagatcaatgatgtggagaccccagagggggagcagcccccacccctgcccacccctgtgggcggcagcaacccccagcccatccccccccagagccaccccagcaccagcagcagcagcagtgatggcctgcgggacaacgtgccctgcctgaaggtgaagaacagccccctgaagcagagccctggctaccagacagagctggtgatccagctggtgtgggtgggcggggagcccccccagcagatcaccagcctggccgtgaacagcagctatggcctggtggtgtttggaaactgcaatggaattgccatggtggactacctgcagaaggctgtgctgctgaacctgggcaccatcgagctgtatggcagcaatgacccctaccgccgggagcccaggagccccaggaagagccggcagcccagcggggccggcctgtgtgacatcagcgagggcaccgtggtgcctgaggaccgctgcaagagccccaccagcggcagcagcagcccccacaacagtgatgatgagcagaagatgaacaacttcatcgagaaggccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcctgtgattgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagagaagacctgtgtctgtgagccccagcagcagccaggagatcagcgagaaccagtatgctgtgatctgcagcgagaagcaggccaaggtgatcagcctgcccacccagaactgtgcctacaagcagaacatcacagagaccagctttgtgctgcggggggacatcgtggccctgagcaacagcatctgcctggcctgcttctgtgccaacggccacatcatgaccttcagcctgcccagcctgcggcccctgctggatgtgtactacctgcccctgaccaacatgagaattgcccggaccttctgcttcaccaacaacggccaggccctgtacctggtgagccccacagagatccagaggctgacctacagccaggagacctgtgagaacctgcaggagatgctgggggagctgttcacccctgtggagaccccagaggcccccaacagaggcttcttcaagggcctgtttggaggaggagcccagagcctggaccgggaggagctgtttggagagagcagcagcggcaaggccagccgcagcctggcccagcacatccctggccctgggggcatcgagggcgtgaagggggccgccagcggcgtggtgggggagctggcccgggcccggctggccctggatgagcggggccagaagctgggggacctggaggagaggacagctgccatgctgagcagcgctgagagcttcagcaagcacgcccacgagatcatgctgaagtacaaggacaagaagtggtaccagttctag

SEQ ID NO: 172465 - DNA, 3456 bp, Artificial Sequence
  Description of Artificial Sequence: Synthetic coding sequence
atgaggaagttcaacatcaggaaggtgctggatggcctgacagctggcagcagcagcgccagccagcagcagcagcagcagcaccccccaggcaaccgggagcctgagatccaggagaccctgcagagcgagcacttccagctgtgcaagacagtgcgccacggcttcccctaccagcccagcgccctggcctttgatcctgtgcagaagatcctggccgtgggcacccagacaggagccctgcggctgtttggccggcctggggtggagtgctactgccagcatgattctggagctgctgtgatccagctgcagttcctgatcaatgaaggagccctggtgtctgccctggctgatgacaccctgcacctgtggaacctgcggcagaagaggcctgccatcctgcacagcctgaagttctgccgggagcgggtgaccttctgccacctgcccttccagagcaagtggctgtatgtgggcacagagcggggcaacatccacatcgtgaatgtggagagcttcaccctgagcggctacgtgatcatgtggaacaaggccatcgagctgagcagcaagagccaccctggccctgtggtgcacatcagtgacaaccccatggatgagggcaagctgctgattggatttgaaagtggcaccgtggtgctgtgggacctgaagagcaagaaggctgactaccgctacacctatgatgaggccatccacagcgtggcctggcaccacgagggcaagcagttcatctgcagccacagtgatggcaccctgaccatctggaatgtgcgcagccctgccaagcctgtgcagaccatcacccctcatggcaagcagctgaaggatggcaagaagccagagccctgcaagcccatcctgaaggtggagttcaagaccaccaggtctggagagcccttcatcatcctgagcggcggcctgtcctatgacacagtgggcagaagaccctgcctgactgtgatgcacggcaagagcacagctgtgctggagatggactacagcatcgtggacttcctgaccctgtgtgagaccccctacccaaatgacttccaggagccctatgctgtggtggtgctgctggagaaggacctggtgctgattgacctggcccagaatggctaccccatctttgagaacccctaccccctgagcatccacgagagccctgtgacctgctgtgagtactttgctgactgccctgtggacctgatcccagccctgtacagcgtgggcgcccggcagaagaggcagggctacagcaagaaggagtggcccatcaatggaggcaactggggcctgggcgcccagagctacccagagatcatcatcactggacatgctgatggctctgtgaagttctgggatgccagcgccatcaccctgcaggtgctgtacaagctgaagaccagcaaggtgtttgagaagagcaggaacaaggatgaccggcccaacacagacatcgtggatgaggacccctatgccatccagatcatctcctggtgcccagagagcaggatgctgtgcatcgccggcgtgtctgcccacgtgatcatctaccgcttcagcaagcaggaggtgatcacagaggtgatccccatgctggaggtgcggctgctgtatgagatcaatgatgtggagaccccagagggggagcagcccccacccctgcccacccctgtgggcggcagcaacccccagcccatccccccccagagccaccccagcaccagcagcagcagcagtgatggcctgcgggacaacgtgccctgcctgaaggtgaagaacagccccctgaagcagagccctggctaccagacagagctggtgatccagctggtgtgggtgggcggggagcccccccagcagatcaccagcctggccgtgaacagcagctatggcctggtggtgtttggaaactgcaatggcatcgccatggtggactacctgcagaaggctgtgctgctgaacctgggcaccatcgagctgtatggcagcaatgacccctacagaagagagcccaggagccccaggaagagccggcagcccagcggggccggcctgtgtgacatcagcgagggcaccgtggtgcctgaagatcgctgcaagagccccaccagcggcagcagcagcccccacaacagtgatgatgagcagaagatgaacaacttcatcgagaaggtgaagaccaagagcaggaagttcagcaagatggtggccaatgacatcgccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcccgtcatcgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagaggaggcctgtgtctgtgagccccagcagcagccaggagatcagcgagaaccagtatgctgtgatctgcagcgagaagcaggccaaggtgatcagcctgcccacccagaactgtgcctacaagcagaacatcacagagaccagctttgtgctgcggggggacatcgtggccctgagcaacagcatctgcctggcctgcttctgtgccaacggccacatcatgaccttcagcctgcccagcctgcggcccctgctggatgtgtactacctgcccctgaccaacatgagaattgcccggaccttctgcttcaccaacaacggccaggccctgtacctggtgagccccacagagatccagaggctgacctacagccaggagacctgtgagaacctgcaggagatgctgggggagctgttcacccctgtggagaccccagaggcccccaacagaggcttcttcaagggcctgtttggaggaggagcccagagcctggaccgggaggagctgtttggagagagcagcagcggcaaggccagccgcagcctggcccagcacatccctggccctgggggcattgaaggagtgaagggagctgccagcggcgtggtgggggagctggcccgggcccggctggccctggatgagcggggccagaagctgggggacctggaggagaggacagctgccatgctgagcagcgctgagagcttcagcaagcacgcccacgagatcatgctgaagtacaaggacaagaagtggtaccagttctag

SEQ ID NO: 172466 - DNA, 525 bp, Artificial Sequence
  Description of Artificial Sequence: Synthetic coding sequence
tgaaaagctgtgctgctgaacctgggcaccatcgagctgtatggcagcaatgacccctacagaagagagcccaggagccccaggaagagccggcagcccagcggggccggcctgtgtgacatcagcgagggcaccgtggtgcctgaagatcgctgcaagagccccaccagcggcagcagcagcccccacaacagtgatgatgagcagaagatgaacaacttcatcgagaaggccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcccgtcatcgtgagccccagctag

SEQ ID NO: 172467 - DNA, 840 bp, Artificial Sequence
  Description of Artificial Sequence: Synthetic coding sequence
atggtggactacctgcagaaggctgtgctgctgaacctgggcaccatcgagctgtatggcagcaatgacccctaccgccgggagcccaggagccccaggaagagccggcagcccagcggaggagtgctgattgtgaccagctgcatgtgtggcctgagcagcctgtacagcgagagcatgaagaagctgcggagcagcttcctgaccggcctgtgtgacatcagcgagggcaccgtggtgcctgaggaccgctgcaagagccccaccagcgccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcctgtgattgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagagaagacctgtgtctgtgagccccagcagcagccaggagatcagcgagaaccagtatgctgtgatctgcagcgagaagcaggccaaggtgatcagcctgcccacccagaactgtgcctacaagcagaacatcacctag

SEQ ID NO: 172468 - DNA, 3297 bp, Artificial Sequence
  Description of Artificial Sequence: Synthetic coding sequence
atgaggaagttcaacatcaggaaggtgctggatggcctgacagctggcagcagcagcgccagccagcagcagcagcagcagcaccccccaggcaaccgggagcctgagatccaggagaccctgcagagcgagcacttccagctgtgcaagacagtgcgccacggcttcccctaccagcccagcgccctggcctttgatcctgtgcagaagatcctggccgtgggcacccagacaggagccctgcggctgtttggccggcctggggtggagtgctactgccagcatgattctggagctgctgtgatccagctgcagttcctgatcaatgaaggagccctggtgtctgccctggctgatgacaccctgcacctgtggaacctgcggcagaagaggcctgccatcctgcacagcctgaagttctgccgggagcgggtgaccttctgccacctgcccttccagagcaagtggctgtatgtgggcacagagcggggcaacatccacatcgtgaatgtggagagcttcaccctgagcggctacgtgatcatgtggaacaaggccatcgagctgagcagcaagagccaccctggccctgtggtgcacatcagtgacaaccccatggatgagggcaagctgctgattggatttgaaagtggcaccgtggtgctgtgggacctgaagagcaagaaggctgactaccgctacacctatgatgaggccatccacagcgtggcctggcaccacgagggcaagcagttcatctgcagccacagtgatggcaccctgaccatctggaatgtgcgcagccctgccaagcctgtgcagaccatcacccctcatggcaagcagctgaaggatggcaagaagccagagccctgcaagcccatcctgaaggtggagttcaagaccaccaggtctggagagcccttcatcatcctgagcggcggcctgtcctatgacacagtgggcagaagaccctgcctgactgtgatgcacggcaagagcacagctgtgctggagatggactacagcatcgtggacttcctgaccctgtgtgagaccccctacccaaatgacttccaggagccctatgctgtggtggtgctgctggagaaggacctggtgctgattgacctggcccagaatggctaccccatctttgagaacccctaccccctgagcatccacgagagccctgtgacctgctgtgagtactttgctgactgccctgtggacctgatcccagccctgtacagcgtgggcgcccggcagaagaggcagggctacagcaagaaggagtggcccatcaatggaggcaactggggcctgggcgcccagagctacccagagatcatcatcactggacatgctgatggctctgtgaagttctgggatgccagcgccatcaccctgcaggtgctgtacaagctgaagaccagcaaggtgtttgagaagagcaggaacaaggatgaccggcccaacacagacatcgtggatgaggacccctatgccatccagatcatctcctggtgcccagagagcaggatgctgtgcatcgccggcgtgtctgcccacgtgatcatctaccgcttcagcaagcaggaggtgatcacagaggtgatccccatgctggaggtgcggctgctgtatgagatcaatgatgtggagaccccagagggggagcagcccccacccctgcccacccctgtgggcggcagcaacccccagcccatccccccccagagccaccccagcaccagcagcagcagcagtgatggcctgcgggacaacgtgccctgcctgaaggtgaagaacagccccctgaagcagagccctggctaccagacagagctggtgatccagctggtgtgggtgggcggggagcccccccagcagatcaccagcctggccgtgaacagcagctatggcctggtggtgtttggaaactgcaatggcatcgccatggtggactacctgcagaaggctgtgctgctgaacctgggcaccatcgagctgtatggcagcaatgacccctacagaagagagcccaggagccccaggaagagccggcagcccagcggggccggcctgtgtgacatcagcgagggcaccgtggtgcctgaagatcgctgcaagagccccaccagtgatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcctgtgattgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagagaagacctgtgtctgtgagccccagcagcagccaggagatcagcgagaaccagtatgctgtgatctgcagcgagaagcaggccaaggtgatcagcctgcccacccagaactgtgcctacaagcagaacatcacagagaccagctttgtgctgcggggggacatcgtggccctgagcaacagcatctgcctggcctgcttctgtgccaacggccacatcatgaccttcagcctgcccagcctgcggcccctgctggatgtgtactacctgcccctgaccaacatgagaattgcccggaccttctgcttcaccaacaacggccaggccctgtacctggtgagccccacagagatccagaggctgacctacagccaggagacctgtgagaacctgcaggagatgctgggggagctgttcacccctgtggagaccccagaggcccccaacagaggcttcttcaagggcctgtttggaggaggagcccagagcctggaccgggaggagctgtttggagagagcagcagcggcaaggccagccgcagcctggcccagcacatccctggccctgggggcatcgagggcgtgaagggggccgccagcggcgtggtgggggagctggcccgggcccggctggccctggatgagcggggccagaagctgggggacctggaggagaggacagctgccatgctgagcagcgctgagagcttcagcaagcacgcccacgagatcatgctgaagtacaaggacaagaagtggtaccagttctag

SEQ ID NO: 172469 - DNA, 3348 bp, Artificial Sequence
  Description of Artificial Sequence: Synthetic coding sequence
atgaggaagttcaacatcaggaaggtgctggatggcctgacagctggcagcagcagcgccagccagcagcagcagcagcagcaccccccaggcaaccgggagcctgagatccaggagaccctgcagagcgagcacttccagctgtgcaagacagtgcgccacggcttcccctaccagcccagcgccctggcctttgatcctgtgcagaagatcctggccgtgggcacccagacaggagccctgcggctgtttggccggcctggggtggagtgctactgccagcatgattctggagctgctgtgatccagctgcagttcctgatcaatgaaggagccctggtgtctgccctggctgatgacaccctgcacctgtggaacctgcggcagaagaggcctgccatcctgcacagcctgaagttctgccgggagcgggtgaccttctgccacctgcccttccagagcaagtggctgtatgtgggcacagagcggggcaacatccacatcgtgaatgtggagagcttcaccctgagcggctacgtgatcatgtggaacaaggccatcgagctgagcagcaagagccaccctggccctgtggtgcacatcagtgacaaccccatggatgagggcaagctgctgattggatttgaaagtggcaccgtggtgctgtgggacctgaagagcaagaaggctgactaccgctacacctatgatgaggccatccacagcgtggcctggcaccacgagggcaagcagttcatctgcagccacagtgatggcaccctgaccatctggaatgtgcgcagccctgccaagcctgtgcagaccatcacccctcatggcaagcagctgaaggatggcaagaagccagagccctgcaagcccatcctgaaggtggagttcaagaccaccaggtctggagagcccttcatcatcctgagcggcggcctgtcctatgacacagtgggcagaagaccctgcctgactgtgatgcacggcaagagcacagctgtgctggagatggactacagcatcgtggacttcctgaccctgtgtgagaccccctacccaaatgacttccaggagccctatgctgtggtggtgctgctggagaaggacctggtgctgattgacctggcccagaatggctaccccatctttgagaacccctaccccctgagcatccacgagagccctgtgacctgctgtgagtactttgctgactgccctgtggacctgatcccagccctgtacagcgtgggcgcccggcagaagaggcagggctacagcaagaaggagtggcccatcaatggaggcaactggggcctgggcgcccagagctacccagagatcatcatcactggacatgctgatggctctgtgaagttctgggatgccagcgccatcaccctgcaggtgctgtacaagctgaagaccagcaaggtgtttgagaagagcaggaacaaggatgaccggcccaacacagacatcgtggatgaggacccctatgccatccagatcatctcctggtgcccagagagcaggatgctgtgcatcgccggcgtgtctgcccacgtgatcatctaccgcttcagcaagcaggaggtgatcacagaggtgatccccatgctggaggtgcggctgctgtatgagatcaatgatgtggagaccccagagggggagcagcccccacccctgcccacccctgtgggcggcagcaacccccagcccatccccccccagagccaccccagcaccagcagcagcagcagtgatggcctgcgggacaacgtgccctgcctgaaggtgaagaacagccccctgaagcagagccctggctaccagacagagctggtgatccagctggtgtgggtgggcggggagcccccccagcagatcaccagcctggccgtgaacagcagctatggcctggtggtgtttggaaactgcaatggcatcgccatggtggactacctgcagaaggctgtgctgctgaacctgggcaccatcgagctgtatggcagcaatgacccctacagaagagagcccaggagccccaggaagagccggcagcccagcggggccggcctgtgtgacatcagcgagggcaccgtggtgcctgaagatcgctgcaagagccccaccagcgccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcccgtcatcgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagaggaggcctgtgtctgtgagccccagcagcagccaggagatcagcgagaaccagtatgctgtgatctgcagcgagaagcaggccaaggtgatcagcctgcccacccagaactgtgcctacaagcagaacatcacagagaccagctttgtgctgcggggggacatcgtggccctgagcaacagcatctgcctggcctgcttctgtgccaacggccacatcatgaccttcagcctgcccagcctgcggcccctgctggatgtgtactacctgcccctgaccaacatgagaattgcccggaccttctgcttcaccaacaacggccaggccctgtacctggtgagccccacagagatccagaggctgacctacagccaggagacctgtgagaacctgcaggagatgctgggggagctgttcacccctgtggagaccccagaggcccccaacagaggcttcttcaagggcctgtttggaggaggagcccagagcctggaccgggaggagctgtttggagagagcagcagcggcaaggccagccgcagcctggcccagcacatccctggccctgggggcattgaaggagtgaagggagctgccagcggcgtggtgggggagctggcccgggcccggctggccctggatgagcggggccagaagctgggggacctggaggagaggacagctgccatgctgagcagcgctgagagcttcagcaagcacgcccacgagatcatgctgaagtacaaggacaagaagtggtaccagttctag

SEQ ID NO: 172470 - DNA, 795 bp, Artificial Sequence
  Description of Artificial Sequence: Synthetic coding sequence
attgagctgtatggcagcaatgacccctacagaagagagcccaggagccccaggaagagccggcagcccagcggcggcgtgctgattgtgaccagctgcatgtgtggcctgagcagcctgtacagcgagagcatgaagaagctgcggagcagcttcctgaccggcctgtgtgacatcagcgagggcaccgtggtgcctgaagatcgctgcaagagccccaccagcgccaagatgagcaggaagctgagcctgcccacagacctgaagccagacctggatgtgaaggacaacagcttcagccgcagccgcagcagctctgtgaccagcattgacaaggagagccgggaggccatcagcgccctgcacttctgtgagaccttcaccaggaagacagacagcagccccagcccctgcctgtgggtgggcaccaccctgggcaccgtgctggtgattgccctgaacctgcccccaggaggagagcagaggctgctgcagcccgtcatcgtgagccccagcggcaccatcctgcggctgaagggggccatcctgaggatggccttcctggacaccaccggctgcctgatccccccagcctatgagccctggagggagcacaacgtgcctgaggagaaggatgagaaggagaagctgaagaagaggaggcctgtgtctgtgagccccagcagcagccaggagatcagcgagaaccagtatgctgtgatctgcagcgagaagcaggccaaggtgatcagcctgcccacccagaactgtgcctacaagcagaacatcacctag

SEQ ID NO: 172471 - DNA, 927 bp, Artificial Sequence
  Description of Artificial Sequence: Synthetic coding sequence
atgaggaagttcaacatcaggaaggtgctggatggcctgacagctggcagcagcagcgccagccagcagcagcagcagcagcaccccccaggcaaccgggagcctgagatccaggagaccctgcagagcgagcacttccagctgtgcaagacagtgcgccacggcttcccctaccagcccagcgccctggcctttgatcctgtgcagaagatcctggccgtgggcacccagacaggagccctgcggctgtttggccggcctggggtggagtgctactgccagcatgattctggagctgctgtgatccagctgcagttcctgatcaatgaaggagccctggtgtctgccctggctgatgacaccctgcacctgtggaacctgcggcagaagaggcctgccatcctgcacagcctgaagttctgccgggagcgggtgaccttctgccacctgcccttccagagcaagtggctgtatgtgggcacagagcggggcaacatccacatcgtgaatgtggagagcttcaccctgagcggctacgtgatcatgtggaacaaggccatcgagctgagcagcaagagccaccctggccctgtggtgcacatcagtgacaaccccatggatgagggcaagctgctgattggatttgaaagtggcaccgtggtgctgtgggacctgaagagcaagaaggctgactaccgctacacctatgatgaggccatccacagcgtggcctggcaccacgagggcaagcagttcatctgcagccacagtgatggcaccctgaccatctggaatgtgcgcagccctgccaagcctgtgcagaccatcacccctcatggcaagcagctgaaggatggcaagaagccagagccctgcaagcccatcctgaaggtggagttcaagaccaccaggtctggagtgtgctag

SEQ ID NO: 172472 - DNA, 3561 bp, Artificial Sequence
  Description of Artificial Sequence: Synthetic coding sequence
atgaagaagttcaacttcaggaaggtgctggatggcctgacagccagcagccctggcagcggcagcagcagcggcagcaacagcggcggcggggccggcagcggctctgtgcaccctgctggaacagctggggtgctgcgggaggagatccaggagaccctgaccagcgagtacttccagatctgcaagacagtgagacatggcttcccccaccagcccacagccctggcctttgatcctgtgcagaagatcctggccatcggcaccaggactggagccatccgcatcctgggccggcctggggtggactgctactgccagcacgagagcggggctgctgtgctgcagctgcagttcctgatcaatgaaggagccctggtgtctgccagcagtgatgacaccctgcacctgtggaacctgcggcagaagaggcctgccatcctgcacagcctgaagttcaaccgggagcgcatcacctactgccacctgcccttccagagcaagtggctgtatgtgggcacagagcggggcaacacccacatcgtgaacatcgagagcttcatcctgagcggctacgtgatcatgtggaacaaggccatcgagctgagcaccaagacccaccctggccctgtggtgcacctgagtgacagccccagagatgagggcaagctgctgattggctatgaaaatggcaccgtggtgttctgggacctgaagagcaagagagctgagctgcgggtgtactatgatgaggccatccacagcattgactggcaccacgagggcaagcagttcatgtgcagccacagtgatggcagcctgaccctgtggaacctgaagagccccagccggcccttccagaccaccatcccccacggcaagagccagcgggagggcaggaagtctgagagctgcaagcccatcctgaaggtggagtacaagacctgcaagaacagcgagcccttcatcatcttcagcggcggcctgtcctatgacaaggcctgccggcggcccagcctgaccatcatgcacggcaaggccatcaccgtgctggagatggaccaccccatcgtggagttcctgaccctgtgtgagaccccctacccaaatgagttccaggagccctatgctgtggtggtgctgctggagaaggacctgattgtggtggacctgacccagagcaacttccccatctttgagaacccctaccccatggacatccacgagagccctgtgacctgcacagcctactttgctgactgccccccagacctgatcctggtgctgtacagcattggagtgaagcacaagaagcagggctacagcaacaaggagtggcccatctctggaggagcctggaacctgggcgcccagacctacccagagatcatcatcaccggccatgctgatggcagcatcaagttctgggatgccagcgccatcaccctgcagatgctgtacaagctgaagaccagcaaggtgtttgagaagcagaaggtgggggagggcaagcagacctgtgaaattgtggaggaggacccctttgccatccagatgatctactggtgcccagagagccgcatcttctgtgtgtctggagtgtctgcctacgtgatcatctacaagttcagcagacatgagatcaccacagagatcgtgtccctggaggtgcggctgcagtatgatgtggaggacatcatcaccccagagcctgagaccagcccccccttcccagacctgagcgcccagctgcccagcagccgcagcctgagcggcagcaccaacacagtggccagcgagggcgtgaccaaggacagcatcccctgcctgaatgtgaagaccaggcctgtgaggatgcctcctggctaccaggccgagctggtgatccagctggtgtgggtggatggagagcccccccagcagatcaccagcctggccgtgtcctctgcctatggaattgtggccttcggcaactgcaatggcctggccgtggtggacttcatccagaagacagtgctgctgtccatgggcaccatcgacctgtaccgcagcagtgacctgtaccagaggcagcccaggagccccaggaagaacaagcagttcatcgctgacaacttctgcatgaggggcctgagcaacttctacccagacctgaccaagaggatccgcaccagctaccagagcctgacagagctgaatgacagccctgtgcccctggagctggagcgctgcaagagccccaccagtgaccacgtgaatggccactgcaccagccccaccagccagagctgcagcagcggcaagaggctgagcagcgcagatgtgtccaaggtgaaccgctggggccctggccggccccccttcaggaaggcccagagcgctgcctgcatggagatcagcctgcctgtgaccacagaagaaaatcgggagaacagctacaacagaagccgcagcagcagcatcagcagcattgacaaggacagcaaggaggccatcacagccctgtacttcatggacagctttgccaggaagaatgacagcaccatcagcccctgcctgtttgtgggcaccagcctgggcatggtgctgatcatcagcctgaacctgcccctggctgatgagcagcgcttcacagagcctgtgatggtgctgcccagcggcaccttcctgagcctgaagggagctgtgctgaccttcagctgcatggacaggatgggcggcctgatgcagcccccctatgaggtgtggagggaccccaacaacattgatgaaaatgagaagtcctggaggaggaaggtggtgatgaacagcagcagcgccagccaggagatcggggaccaccagtacaccatcatctgcagcgagaagcaggccaaggtgttcagcctgcccagccagacctgcctgtatgtgcacaacatcacagagaccagcttcatcctgcaggccaacgtggtggtgatgtgcagcagcgcctgcctggcctgcttctgtgccaacggccacatcatgatcatgagcctgcccagcctgcggcccatgctggatgtgaactacctgcccctgacagacatgagaattgcccggaccttctgcttcaccaatgaaggccaggccctgtacctggtgagccccacagagatccagaggctgacctacagccaggagatgtgtgacaacctgcaggacatgctgggggacctcttcacccccatcgagaccccagaggcccagaacagaggcttcctgaagggcctgtttggaggcagcggccagacctttgaccgggaggagctgtttggagaggccagcgctgggaaggccagccgcagcctggcccagcacatccctggccctggcagcattgagggcatgaagggagctgctggaggagtgatgggagagctgacccgggccagaattgccctggatgagcggggccagaggctgggggagctggaggagaagacagctggcatgatgaccagcgctgaggccttcagcaagcacgcccacgagctgatgctgaagtacaaggacaagaagtggtaccagttctag

SEQ ID NO: 172473 - DNA, 384 bp, Artificial Sequence
  Description of Artificial Sequence: Synthetic coding sequence
atgaagaagttcaacttcaggaaggtgctggatggcctgacagccagcagccctggcagcggcagcagcagcggcagcaacagcggcggcggggccggcagcggctctgtgcaccctgctggaacagctggggtgctgcgggaggagatccaggagaccctgaccagcgagtacttccagatctgcaagacagtgagacatggcttcccccaccagcccacagccctggcctttgatcctgtgcagaagatcctggccatcggcaccaggactggagccatccgcatcctgggccggcctggggtggactgctactgccagcacgagagcggggctgctgtgctgcagctgcagttcctgatcaatgaaggagccctggtgtag

SEQ ID NO: 172474 - DNA, 633 bp, Artificial Sequence
  Description of Artificial Sequence: Synthetic coding sequence
atgtctgccaagagcgccatcagcaaggagatctttgcccccctggatgagaggatgctgggcgctgtgcaggtgaagaggaggaccaagaagaagatccccttcctggccaccggcggccagggcgagtacctgacctacatctgcctgtctgtgaccaacaagaagcccacccaggccagcatcaccaaggtgaagcagtttgagggcagcaccagctttgtgcggcgcagccagtggatgctggagcagctgcggcaggtgaatggaattgaccccaacggggacagcgctgagtttgacctgctgtttgaaaatgcctttgaccagtgggtggccagcacagccagcgagaagtgcaccttcttccagatcctgcaccacacctgccagcgctacctgacagacaggaagccagagttcatcaactgccagagcaagatcatgggcggcaacagcatcctgcacagcgctgctgacagcgtgaccagcgctgtgcagaaggccagccaggccctgaatgaaagaggagagcggctgggccgggcagaggagaagacagaggacctgaagaacagcgcccagcagtttgctgagacagcccacaagctggccatgaagcacaagtgctag

SEQ ID NO: 172475 - DNA, 633 bp, Artificial Sequence
  Description of Artificial Sequence: Synthetic coding sequence
atgtctgccaagagcgccatcagcaaggagatctttgcccccctggatgagaggatgctgggcgctgtgcaggtgaagaggaggaccaagaagaagatccccttcctggccaccggcggccagggcgagtacctgacctacatctgcctgtctgtgaccaacaagaagcccacccaggccagcatcaccaaggtgaagcagtttgagggcagcaccagctttgtgcggcgcagccagtggatgctggagcagctgcggcaggtgaatggaattgaccccaacggggacagcgctgagtttgacctgctgtttgaaaatgcctttgaccagtgggtggccagcacagccagcgagaagtgcaccttcttccagatcctgcaccacacctgccagcgctacctgacagacaggaagccagagttcatcaactgccagagcaagatcatgggcggcaacagcatcctgcacagcgctgctgacagcgtgaccagcgctgtgcagaaggccagccaggccctgaatgaaagaggagagcggctgggccgggcagaggagaagacagaggacctgaagaacagcgcccagcagtttgctgagacagcccacaaggtgaccttccggggcaggaagtag

SEQ ID NO: 172476 - DNA, 633 bp, Artificial Sequence; identical to SEQ ID NO: 172474
  Description of Artificial Sequence: Synthetic coding sequence

SEQ ID NO: 172477 - DNA, 633 bp, Artificial Sequence; identical to SEQ ID NO: 172474
  Description of Artificial Sequence: Synthetic coding sequence

SEQ ID NO: 172478 - DNA, 633 bp, Artificial Sequence; identical to SEQ ID NO: 172474
  Description of Artificial Sequence: Synthetic coding sequence

SEQ ID NO: 172479 - DNA, 327 bp, Artificial Sequence
  Description of Artificial Sequence: Synthetic coding sequence
atgtctgcctgcttcctggacaccaggagagctgccttcctgcagtgtgacctgcccagcagctaccgcatcctgaccctgcctgagagcggccactgcggcagcgctgagcctgtgtctgatgccccagccctgctgctgagcggcaacagcatcctgcacagcgctgctgacagcgtgaccagcgctgtgcagaaggccagccaggccctgaatgaaagaggagagcggctgggccgggcagaggagaagacagaggacctgaagaacagcgcccagcagtttgctgagacagcccacaagctggccatgaagcacaagtgctag

SEQ ID NO: 172480 - DNA, 633 bp, Artificial Sequence; identical to SEQ ID NO: 172474
  Description of Artificial Sequence: Synthetic coding sequence

SEQ ID NO: 172481 - DNA, 633 bp, Artificial Sequence; identical to SEQ ID NO: 172474
  Description of Artificial Sequence: Synthetic coding sequence

SEQ ID NO: 172482 - DNA, 1617 bp, Artificial Sequence
  Description of Artificial Sequence: Synthetic coding sequence
atggctgtggccgctgctgctgctgctgctggccctgctggagctgggggcggccgggcccagaggagcggcctgctggaggtgctggtgcgggaccgctggcacaaggtgctggtgaacctgtctgaagatgccctggtgctgagcagcgaggagggcgctgctgcctacaacggcatcggcacagccaccaacggcagcttctgccgcggggccggggccggccaccctggagctggaggagcccagcccccagacagccctgctggggtgaggacagccttcacagacctgcctgagcaggtgcctgagagcatcagcaaccagaagaggggcgtgaaggtgctgaagcaggagctgggcggcctgggcatcagcatcaagggcggcaaggagaacaagatgcccatcctgatcagcaagatcttcaagggcctggccgctgaccagacccaggccctgtatgtgggagatgccatcctgtctgtgaatggagctgacctgagagatgccacccatgatgaggccgtgcaggccctgaagagagctgggaaggaggtgctgctggaggtgaagtacatgagggaggccaccccctacgtgaagaagggcagccctgtgtctgagatcggctgggagaccccacctcctgagagcccccggctgggcggcagcaccagtgacccccccagcagccagagcttctccttccaccgggacaggaagagcatccccctgaagatgtgctacgtgaccaggtccatggccctggccgaccctgaaaatcggcagctggagatccacagcccagatgccaagcacacagtcatcctgcggagcaaggacagcgccacagcccaggcctggttcagcgccatccacagcaatgtgaatgacctgctgaccagggtgattgctgaggtgcgggagcagctgggcaagacaggaattgctggcagccgggagatccgccacctgggctggctggccgagaaggtgcctggagagagcaagaagcagtggaagccagccctggtggtgctgacagagaaggacctgctgatctatgacagcatgcccaggaggaaggaggcctggttcagccctgtgcacacctaccccctgctggccacccggctggtgcacagcggccctgggaagggcagcccccaggccggcgtggacctgagctttgccaccaggacaggcacccggcagggcatcgagacccacctgttccgggcagagaccagccgggacctgagccactggaccaggagcatcgtgcagggctgccacaacagcgctgagctgattgctgagatcagcacagcctgcacctacaagaaccaggagtgccgcctgaccatccactatgaaaatggcttcagcatcaccacagagccccaggagggcgccttccccaagaccatcatccagagcccctatgagaagctgaagatgagcagtgatgatggcatccgcatgctgtacctggactttggaggcaaggatggagagatccagctggacctgcacagctgccccaagcccatcgtgttcatcatccacagcttcctgagcgccaagatcacccggctgggcctggtggcctag

SEQ ID NO: 172483 - DNA, 1617 bp, Artificial Sequence; identical to SEQ ID NO: 172482
  Description of Artificial Sequence: Synthetic coding sequence

SEQ ID NO: 172484 - DNA, 87 bp, Artificial Sequence
  Description of Artificial Sequence: Synthetic coding sequence
atggctgtggccgctgctgctgctgctgctggccctgctggagctgggggcggccgggcccagaggagcggcctgctggaggtgtag

SEQ ID NO: 172485 - DNA, 1623 bp, Artificial Sequence
  Description of Artificial Sequence: Synthetic coding sequence
atgagggtggccgccgccacagctgctgctggggccggccctgccatggctgtgtggacccgggccaccaaggccggcctggtggagctgctgctgcgggagcgctgggtgcgggtggtggccgagctgagcggggagagcctgagcctgactggagatgctgctgctgctgagctggagcccgccctgggccctgctgctgctgccttcaacggcctgcccaatggaggaggagctggggacagcctgcccggcagccccagccggggcctgggcccccccagccccccagccccaccccggggccctgctggggaggccggggccagcccccctgtgcggcgggtgcgggtggtgaagcaggaggccggcggcctgggcatcagcatcaagggcggcagagaaaataggatgcccatcctgatcagcaagatcttccctggcctggccgctgaccagagccgggccctgcggctgggagatgccatcctgtctgtgaatggaacagacctgcggcaggccacccatgaccaggccgtgcaggccctgaagagagctgggaaggaggtgctgctggaggtgaagttcatccgggaggtgaccccctacatcaagaagcccagcctggtgtctgacctgccctgggagggcgccgccccccagagccccagcttcagcggctctgaagattctggcagccccaagcaccagaacagcaccaaggacaggaagatcatccccctgaagatgtgctttgctgccaggaacctgtccatgccagacctggagaaccggctgattgagctgcacagcccagacagcaggaacaccctcatcctgcgctgcaaggacacagccacagcccacagctggtttgtggccatccacaccaacatcatggccctgctgccccaggtgctggccgagctgaatgccatgctgggcgccaccagcacagctgggggcagcaaggaggtgaagcacatcgcctggctggccgagcaggccaagctggatggcggccggcagcagtggaggcctgtgctgatggctgtgacagagaaggacctgctgctgtatgactgcatgccctggaccagagatgcctgggccagcccctgccacagctaccccctggtggccacccggctggtgcacagcggcagcggctgccgcagccccagcctgggcagtgacctgacctttgccaccaggacaggcagccggcagggcatcgagatgcacctgttccgggtggagacccaccgggacctgagctcctggacccgcatcctggtgcagggctgccacgccgctgctgagctgatcaaggaggtgtccctgggctgcatgctgaatggccaggaggtgcggctgaccatccactatgaaaatggcttcaccatcagccgggagaatggaggcagcagcagcatcctgtaccgctacccctttgagcggctgaagatgtctgcagatgatggcatccggaacctgtacctggactttggaggccctgagggggagctgaccatggacctgcacagctgccccaagcccatcgtgtttgtgctgcacaccttcctgagcgccaaggtgaccaggatgggcctgctggtgtag

SEQ ID NO: 172486 - DNA, 1443 bp, Artificial Sequence
  Description of Artificial Sequence: Synthetic coding sequence
atggacttcagaacagcctgtgaggagaccaagacaggcatctgcctgctgcaggacggcaaccaggagcccttcaaggtgcggctgcacctggccaaggacatcctgatgatccaggagcaggacgtcatctgtgtgtctggagagcccttctacagcggggagaggacagtgaccatccggcggcagacagtgggcggcttcggcctgagcatcaagggcggcgctgagcacaacatccctgtggtggtgtccaagatcagcaaggagcagagagctgagctgagcggcctgctcttcatcggagatgccatcctgcagatcaatggcatcaacgtgaggaaatgtagacatgaggaggtggtgcaggtgctgagaaatgctggggaggaggtgaccctgactgtgtccttcctgaagagggccccagccttcctgaagctgcccctgaatgaagactgtgcctgtgcccccagcgaccagagcagcggcaccagcagccccctgtgtgacagcggcctgcacctgaactaccaccccaacaacacagacaccctgagctgcagctcctggcccaccagccctggcctgcgctgggagaagcgctggtgtgacctgcggctcatccccctgctgcacagccgcttcagccagtatgtgcctggaacagacctgagccggcagaatgccttccaggtgattgctgtggatggagtgtgcaccggcatcatccagtgcctgtctgctgaggactgtgtggactggctgcaggccatcgccaccaacatcagcaacctgaccaagcacaacatcaagaagatcaacagaaacttccctgtgaaccagcagatcgtgtacatgggctggtgtgaggcccgggagcaggaccccctgcaggacagagtgtacagccccaccttcctggccctgcggggcagctgcctgtacaagttcctggcccctcctgtgaccacctgggactggaccagggctgagaagaccttctctgtgtatgagatcatgtgcaagatcctgaaggacagcgacctgctggacaggaggaagcagtgcttcaccgtgcagagcgagagcggggaggacctgtacttctctgtggagctggagagtgacctggcccagtgggagcgggccttccagacagccaccttcctggaggtggagcgcatccagtgcaagacctacgcctgtgtgctggagagccacctgatgggcctgaccatcgacttcagcacaggcttcatctgctttgatgctgccaccaaggagctggagttcagcaacctgtttgctgtgctgcactgcatccacagcttctttgctgccaaggtggcctgcctggaccccctcttcctgggcaaccaggccacagccagcacagctgccagcagcgccaccaccagcaaggccaagtacaccacctag

SEQ ID NO: 172487 - DNA, 1443 bp, Artificial Sequence; identical to SEQ ID NO: 172486
  Description of Artificial Sequence: Synthetic coding sequence

SEQ ID NO: 172488 - DNA, 1554 bp, Artificial Sequence
  Description of Artificial Sequence: Synthetic coding sequence
atggacttcagaacagcctgtgaggagaccaagacaggcatctgcctgctgcaggacggcaaccaggagcccttcaaggtgcggctgcacctggccaaggacatcctgatgatccaggagcaggacgtcatctgtgtgtctggagagcccttctacagcggggagaggacagtgaccatccggcggcagacagtgggcggcttcggcctgagcatcaagggcggcgctgagcacaacatccctgtggtggtgtccaagatcagcaaggagcagagagctgagctgagcggcctgctcttcatcggagatgccatcctgcagatcaatggcatcaacgtgaggaaatgtagacatgaggaggtggtgcaggtgctgagaaatgctggggaggaggtgaccctgactgtgtccttcctgaagagggccccagccttcctgaagctgcccctgaatgaagactgtgcctgtgcccccagcgaccagagcagcggcaccagcagccccctgtgtgacagcggcctgcacctgaactaccaccccaacaacacagacaccctgagctgcagctcctggcccaccagccctggcctgcgctgggagaagcgctggtgtgacctgcggctcatccccctgctgcacagccgcttcagccagtatgtgcctggaacagacctgagccggcagaatgccttccaggtgattgctgtggatggagtgtgcaccggcatcatccagtgcctgtctgctgaggactgtgtggactggctgcaggccatcgccaccaacatcagcaacctgaccaagcacaacatcaagaagatcaacagaaacttccctgtgaaccagcagatcgtgtacatgggctggtgtgaggcccgggagcaggaccccctgcaggacagagtgtacagccccaccttcctggccctgcggggcagctgcctgtacaagttcctggcccctcctgtgaccacctgggactggaccagggctgagaagaccttctctgtgtatgagatcatgtgcaagatcctgaaggacagcgacctgctggacaggaggaagcagtgcttcaccgtgcagagcgagagcggggaggacctgtacttctctgtggagctggagagtgacctggcccagtgggagcgggccttccagacagccaccttcctggaggtggagcgcatccagtgcaagacctacgcctgtgtgctggagagccacctgatgggcctgaccatcgacttcagcacaggcttcatctgctttgatgctgccaccaaggctgtgctgtggagatacaagttcagccagctgaagggcagcagtgatgatggcaagagcaagatcaagttcctgttccagaacccagacaccaagcagatcgaggccaaggagctggagttcagcaacctgtttgctgtgctgcactgcatccacagcttctttgctgccaaggtggcctgcctggaccccctcttcctgggcaaccaggccacagccagcacagctgccagcagcgccaccaccagcaaggccaagtacaccacctag

SEQ ID NO: 172489 - DNA, 1554 bp, Artificial Sequence; identical to SEQ ID NO: 172488
  Description of Artificial Sequence: Synthetic coding sequence

SEQ ID NO: 172490 - DNA, 279 bp, Artificial Sequence
  Description of Artificial Sequence: Synthetic coding sequence
atggacttcagaacagcctgtgaggagaccaagacaggcatctgcctgctgcaggacggcaaccaggagcccttcaaggtgcggctgcacctggccaaggacatcctgatgatccaggagcaggacgtcatctgtgtgtctggagagcccttctacagcggggagaggacagtgaccatccggcggcagacagtgggcggcttcggcctgagcatcaagggcggcgctgagcacaacatccctgtggtggtgtccaagatcagcaaggagcagaggtag

SEQ ID NO: 172491 - DNA, 423 bp, Artificial Sequence
  Description of Artificial Sequence: Synthetic coding sequence
atggatgtgttcatgaagggcctgagcaaggccaaggagggcgtggtggccgctgctgagaagaccaagcagggcgtggccgaggccgccggcaagaccaaggagggcgtgctgtatgtgggcagcaagaccaaggagggcgtggtgcacggcgtggccaccgtggccgagaagaccaaggagcaggtgaccaacgtgggcggcgctgtggtgactggagtgacagctgtggcccagaagacagtggagggcgccggcagcattgctgctgccaccggctttgtgaagaaggaccagctgggcaagaatgaggagggcgccccccaggagggcatcctggaggacatgcctgtggaccctgacaatgaggcctatgagatgcccagcgaggagggctaccaggactatgagcctgaggcctag

SEQ ID NO: 172492 - DNA, 339 bp, Artificial Sequence
  Description of Artificial Sequence: Synthetic coding sequence
atggatgtgttcatgaagggcctgagcaaggccaaggagggcgtggtggccgctgctgagaagaccaagcagggcgtggccgaggccgccggcaagaccaaggagggcgtgctgtatgtgggcagcaagaccaaggagggcgtggtgcacggcgtggccaccgtggccgagaagaccaaggagcaggtgaccaacgtgggcggcgctgtggtgactggagtgacagctgtggcccagaagacagtggagggcgccggcagcattgctgctgccaccggctttgtgaagaaggaccagctgggcaaggagggctaccaggactatgagcctgaggcctag

SEQ ID NO: 172493 - DNA, 423 bp, Artificial Sequence; identical to SEQ ID NO: 172491
  Description of Artificial Sequence: Synthetic coding sequence

SEQ ID NO: 172494 - DNA, 381 bp, Artificial Sequence
  Description of Artificial Sequence: Synthetic coding sequence
atggatgtgttcatgaagggcctgagcaaggccaaggagggcgtggtggccgctgctgagaagaccaagcagggcgtggccgaggccgccggcaagaccaaggagggcgtgctgtatgtggtggccgagaagaccaaggagcaggtgaccaacgtgggcggcgctgtggtgactggagtgacagctgtggcccagaagacagtggagggcgccggcagcattgctgctgccaccggctttgtgaagaaggaccagctgggcaagaatgaggagggcgccccccaggagggcatcctggaggacatgcctgtggaccctgacaatgaggcctatgagatgcccagcgaggagggctaccaggactatgagcctgaggcctag

SEQ ID NO: 172495 - DNA, 423 bp, Artificial Sequence; identical to SEQ ID NO: 172491
  Description of Artificial Sequence: Synthetic coding sequence

SEQ ID NO: 172496 - DNA, 339 bp, Artificial Sequence; identical to SEQ ID NO: 172492
  Description of Artificial Sequence: Synthetic coding sequence

SEQ ID NO: 172497 - DNA, 348 bp, Artificial Sequence
  Description of Artificial Sequence: Synthetic coding sequence
atggatgtgttcatgaagggcctgagcaaggccaaggagggcgtggtggccgctgctgagaagaccaagcagggcgtggccgaggccgccggcaagaccaaggagggcgtgctgtatgtgggcagcaagaccaaggagggcgtggtgcacggcgtggccaccgtggccgagaagaccaaggagcaggtgaccaacgtgggcggcgctgtggtgactggagtgacagctgtggcccagaagacagtggagggcgccggcagcattgctgctgccaccggctttgtgaagaaggaccagctgggcaaggtgtggctgtgcaccttctgtgtgaccttcatctcctggtag

SEQ ID NO: 172498 - DNA, 381 bp, Artificial Sequence; identical to SEQ ID NO: 172494
  Description of Artificial Sequence: Synthetic coding sequence

SEQ ID NO: 172499 - DNA, 423 bp, Artificial Sequence; identical to SEQ ID NO: 172491
  Description of Artificial Sequence: Synthetic coding sequence

SEQ ID NO: 172500 - DNA, 204 bp, Artificial Sequence
  Description of Artificial Sequence: Synthetic coding sequence
atggatgtgttcatgaagggcctgagcaaggccaaggagggcgtggtggccgctgctgagaagaccaagcagggcgtggccgaggccgccggcaagaccaaggagggcgtgctgtatgtgggcagcaagaccaaggagggcgtggtgcacggcgtggccaccgtggccgagaagaccaaggagcaggtgaccaacgtgggctag

SEQ ID NO: 172501 - DNA, 423 bp, Artificial Sequence; identical to SEQ ID NO: 172491
  Description of Artificial Sequence: Synthetic coding sequence

SEQ ID NO: 172502 - DNA, 2760 bp, Artificial Sequence
  Description of Artificial Sequence: Synthetic coding sequence
atggaggcccctgagtacctggacctggatgaaattgacttcagtgatgacatctcctacagcgtgaccagcctgaagaccatccctgagctgtgcagaagatgtgacacccagaatgaagatagatctgtgagcagcagctcctggaactgtggcatcagcaccctcatcaccaacacccagaagcccaccggcattgctgatgtgtacagcaagttccggcctgtgaagagggtgagccccctgaagcaccagcctgagaccctggagaacaatgaaagtgatgaccagaagaaccagaaggtggtggagtaccagaagggcggggagagtgacctgggcccccagccccaggagctgggccctggagatggagtgggcggccccccaggcaagagcagcgagcccagcaccagcctgggggagctggagcactatgacctggacatggatgagatcctggatgtgccctacatcaagagcagccagcagctggccagcttcaccaaggtgaccagcgagaagaggatcctgggcctgtgcaccaccatcaatggcctgagcggcaaggcctgcagcacaggcagcagcgagagcagcagcagcaacatggcccccttctgtgtgctgagccctgtgaagagcccccacctgaggaaggccagcgctgtgattcatgaccagcacaagctgagcacagaggagacagagatcagcccccccctggtgaagtgtggcagcgcctatgagcctgagaaccagagcaaggacttcctgaacaagaccttcagtgacccccacggcaggaaggtggagaagaccaccccagactgccagctgcgggccttccacctgcagagcagcgctgctgagagcaagccagaggagcaggtgtctggcctgaacagaaccagcagccagggccctgaggagaggtctgagtacctgaagaaggtgaagagcatcctgaacatcgtgaaggagggccagatcagcctgctgccccacctggccgctgacaacctggacaagatccatgatgaaaatggaaacaacctgctgcacatcgccgccagccagggccatgctgagtgcctgcagcacctgaccagcctgatgggagaggactgcctgaatgaaagaaacacagagaagctgaccccagctggcctggccatcaagaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgcctag

SEQ ID NO: 172503 - DNA, 3051 bp, Artificial Sequence
  Description of Artificial Sequence: Synthetic coding sequence
atggaggcccctgagtacctggacctggatgaaattgacttcagtgatgacatcagtgacaacagaagccagggcaaccggctgcagaagctgggcctggaggacacagacagagaagatgccatgggcttcggcagccaccgggccaagctgactgtggtggccgccctgggcgcctgccactgcccagaaaatgagtacagcgtgaccagcctgaagaccatccctgagctgtgccgccgctgtgacacccagaatgaagatagatctgtgagcagcagctcctggaactgtggcatcagcaccctcatcaccaacacccagaagcccactggaattgctgatgtgtacagcaagttccggcctgtgaagagggtgagccccctgaagcaccagcctgagaccctggagaacaatgaaagtgatgaccagaagaaccagaaggtggtggagtaccagaagggcggggagagtgacctgggcccccagccccaggagctgggccctggagatggagtgggcggccccccaggcaagagcagcgagcccagcaccagcctgggggagctggagcactatgacctggacatggatgagatcctggatgtgccctacatcaagagcagccagcagctggccagcttcaccaaggtgaccagcgagaagaggatcctgggcctgtgcaccaccatcaatggcctgagcggcaaggcctgcagcacaggcagcagcgagagcagcagcagcaacatggcccccttctgtgtgctgagccctgtgaagagcccccacctgaggaaggccagcgctgtgattcatgaccagcacaagctgagcacagaggagacagagatcagcccccccctggtgaagtgtggcagcgcctatgagcctgagaaccagagcaaggacttcctgaacaagaccttcagtgacccccacggcaggaaggtggagaagaccaccccagactgccagctgcgggccttccacctgcagagcagcgctgctgagagcaagccagaggagcaggtgtctggcctgaacagaaccagcagccagggccctgaggagaggtctgagtacctgaagaaggtgaagagcatcctgaacatcgtgaaggagggccagatcagcctgctgccccacctggccgctgacaacctggacaagatccatgatgaaaatggaaacaacctgctgcacatcgccgccagccagggccacgcagaatgtctgcagcacctgaccagcctgatgggagaggactgcctgaatgaaagaaacacagagaagctgaccccagctggcctggccatcaagaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgacagcgtggccaagagcaagccaggagtgcaggagggcatccaggtgctgggcagcctgagcgccagcagccgggcccggcccaaggccaaggatgaagattctgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggacagcgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgagatgtacagcagctgcatcaacctgagcagcaacatgctgattgaggagcacctgtgcaatgacaccaggcacaatgacatcaacaggaagatgaagaagagctacagcatcaagcacatcgccgagcctgagagcaaggagctgttcctgtag

SEQ ID NO: 172504 - DNA, 2580 bp, Artificial Sequence
  Description of Artificial Sequence: Synthetic coding sequence
atggaggcccctgagtacctggacctggatgaaattgacttcagtgatgacatctcctacagcgtgaccagcctgaagaccatccctgagctgtgcagaagatgtgacacccagaatgaagatagatctgtgagcagcagctcctggaactgtggcatcagcaccctcatcaccaacacccagaagcccaccggcattgctgatgtgtacagcaagttccggcctgtgaagagggtgagccccctgaagcaccagcctgagaccctggagaacaatgaaagtgatgaccagaagaaccagaaggtggtggagtaccagaagggcggggagagtgacctgggcccccagccccaggagctgggccctggagatggagtgggcggccccccaggcaagagcagcgagcccagcaccagcctgggggagctggagcactatgacctggacatggatgagatcctggatgtgccctacatcaagagcagccagcagctggccagcttcaccaaggtgaccagcgagaagaggatcctgggcctgtgcaccaccatcaatggcctgagcggcaaggcctgcagcacaggcagcagcgagagcagcagcagcaacatggcccccttctgtgtgctgagccctgtgaagagcccccacctgaggaaggccagcgctgtgattcatgaccagcacaagctgagcacagaggagacagagatcagcccccccctggtgaagtgtggcagcgcctatgagcctgagaaccagagcaaggacttcctgaacaagaccttcagtgacccccacggcaggaaggtggagaagaccaccccagactgccagctgcgggccttccacctgcagagcagcgctgctgagagcaagccagaggagcaggtgtctggcctgaacagaaccagcagccagggccctgaggagaggtctgagtacctgaagaaggtgaagagcatcctgaacatcgtgaaggagggccagatcagcctgctgaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgcctag

SEQ ID NO: 172505 - DNA, 1812 bp, Artificial Sequence
  Description of Artificial Sequence: Synthetic coding sequence
atgacctacctgatccagagccaccacagcagaagaagccagaactgtgccgaggatgtgatcaggaagaccaagacagaccagaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgagatgtacagcagctgcatcaacctgagcagcaacatgctgattgaggagcacctgtgcaatgacaccaggcacaatgacatcaacaggaagatgaagaagagctacagcatcaagcacatcgccgagcctgagagcaaggagctgttcctgtag

SEQ ID NO: 172506 - DNA, 1566 bp, Artificial Sequence
  Description of Artificial Sequence: Synthetic coding sequence
atgaagctgaccctggtgatgacctacctgatccagagccaccacagcagaagaagccagaactgtgccgaggatgtgatcaggaagaccaagacagaccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgcctag

SEQ ID NO: 172507 - DNA, 1146 bp, Artificial Sequence
  Description of Artificial Sequence: Synthetic coding sequence
atgaagctgaccctggtgatgacctacctgatccagagccaccacagcagaagaagccagaactgtgccgaggatgtgatcaggaagaccaagacagaccagaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctggcttcctgagcgccagccggccccccaacccctggatggccacagcccacctgcccccccagagagctgccaaccagacctag

SEQ ID NO: 172508 - DNA, 1767 bp, Artificial Sequence
  Description of Artificial Sequence: Synthetic coding sequence
atggaggcccctgagtacctggacctggatgaaattgacttcagtgatgacatcagtgacaacagaagccagggcaaccggctgcagaagctgggcctggaggacacagacagagaagatgccatgggcttcggcagccaccgggccaagctgactgtggtggccgccctgggcgcctgccactgcccagaaaatgagtacagcgtgaccagcctgaagaccatccctgagctgtgccgccgctgtgacacccagaatgaagatagatctgtgagcagcagctcctggaactgtggcatcagcaccctcatcaccaacacccagaagcccactggaattgctgatgtgtacagcaagttccggcctgtgaagagggtgagccccctgaagcaccagcctgagaccctggagaacaatgaaagtgatgaccagaagaaccagaaggtggtggagtaccagaagggcggggagagtgacctgggcccccagccccaggagctgggccctggagatggagtgggcggccccccaggcaagagcagcgagcccagcaccagcctgggggagctggagcactatgacctggacatggatgagatcctggatgtgccctacatcaagagcagccagcagctggccagcttcaccaaggtgaccagcgagaagaggatcctgggcctgtgcaccaccatcaatggcctgagcggcaaggcctgcagcacaggcagcagcgagagcagcagcagcaacatggcccccttctgtgtgctgagccctgtgaagagcccccacctgaggaaggccagcgctgtgattcatgaccagcacaagctgagcacagaggagacagagatcagcccccccctggtgaagtgtggcagcgcctatgagcctgagaaccagagcaaggacttcctgaacaagaccttcagtgacccccacggcaggaaggtggagaagaccaccccagactgccagctgcgggccttccacctgcagagcagcgctgctgagagcaagccagaggagcaggtgtctggcctgaacagaaccagcagccagggccctgaggagaggtctgagtacctgaagaaggtgaagagcatcctgaacatcgtgaaggagggccagatcagcctgctgccccacctggccgctgacaacctggacaagatccatgatgaaaatggaaacaacctgctgcacatcgccgccagccagggccacgcagaatgtctgcagcacctgaccagcctgatgggagaggactgcctgaatgaaagaaacacagagaagctgaccccagctggcctggccatcaagaatggccagctggagtgtgtgcgctggatggtgtctgaaacagaggccatcgccgagctgagctgcagcaaggacttccccagcctcatccactacgccggctgctacggccaggagaagatcctgctgtggctgctgcagttcatgcaggagcagggcatcagcctggatgaggtggaccaggacggcaacagcgctgtgcacgtggccagccagcacggctacctgggctgcatccagacccggctgaagatccagggcacctggaatggaagtgagacctgcctcttcacccaccacttcagcagctacccacccatcagcagcggcctgcagtgccagggccaggagggcgtgctcttcatcccagaccaggtgggcgccgccaccaacaagcaggtgctcttccagaaccagctgcctgagaccaagagcagctactag

SEQ ID NO: 172509 - DNA, 267 bp, Artificial Sequence
  Description of Artificial Sequence: Synthetic coding sequence
atggaggcccctgagtacctggacctggatgaaattgacttcagtgatgacatctcctacagcgtgaccagcctgaagaccatccctgagctgtgcagaagatgtgacacccagaatgaagatagaagtgccacccccagctgccggcagagccggcagaacagcaggaggaagtggaagcagagcatcacctactgcggcgtgacaggcacccggcgggtgtccacagccccccacttctttgatggccggcggctgccccagtag

SEQ ID NO: 172510 - DNA, 297 bp, Artificial Sequence
  Description of Artificial Sequence: Synthetic coding sequence
atggaggcccctgagtacctggacctggatgaaattgacttcagtgatgacatctcctacagcgtgaccagcctgaagaccatccctgagctgtgcagaagatgtgacacccagaatgaagatagatctgtgagcagcagctcctggaactgtggcatcagcaccctcatcaccaacacccagaagcccaccggcattgctgatgtgtacagcaagttccggcctgtgaagagggtgagccccctgaagcaccagcctgagaccctggagaacaatgaaagtgatgaccagaagtag

SEQ ID NO: 172511 - DNA, 45 bp, Artificial Sequence
  Description of Artificial Sequence: Synthetic coding sequence
atggaggcccctgagtacctggacctggatgaaattgacttctag

SEQ ID NO: 172512 - DNA, 408 bp, Artificial Sequence
  Description of Artificial Sequence: Synthetic coding sequence
atggaggcccctgagtacctggacctggatgaaattgacttcagtgatgacatctcctacagcgtgaccagcctgaagaccatccctgagctgtgcagaagatgtgacacccagaatgaagatagatctgtgagcagcagctcctggaactgtggcatcagcaccctcatcaccaacacccagaagcccaccggcattgctgatgtgtacagcaagttccggcctgtgaagagggtgagccccctgaagcaccagcctgagaccctggagaacaatgaaagtgatgaccagaagaaccagaaggtggtggagtaccagaagggcggggagagtgacctgggcccccagccccaggagctgggccctggagatggagtgggcggccccccaggcaagagcagcgagtag

SEQ ID NO: 172513 - DNA, 1434 bp, Artificial Sequence
  Description of Artificial Sequence: Synthetic coding sequence
atgcaggagcagggcatcagcctggatgaggtggaccaggacggcaacagcgctgtgcacgtggccagccagcacggctacctgggctgcatccagaccctggtggagtatggagccaacgtgaccatgcagaaccacgccggggagaagcccagccagagcgctgagcggcagggccacaccctgtgcagccgctacctggtggtggtggagacctgcatgagcctggccagccaggtggtgaagctgaccaagcagctgaaggagcagacagtggagcgggtgaccctgcagaaccagctgcagcagttcctggaggcccagaagtctgagggcaagagcctgcccagcagccccagcagccccagcagccctgccagcaggaagagccagtggaagagcccagatgctgatgatgattctgtggccaagagcaagccaggagtgcaggagggcatccaggtgctgggcagcctgagcgccagcagccgggcccggcccaaggccaaggatgaggacagcgacaagatcctgcggcagctgctgggcaaggagatcagtgaaaatgtgtgcacccaggagaagctgagcctggagttccaggatgcccaggccagcagcaggaacagcaagaagatccccctggagaagcgggagctgaagctggcccggctgcggcagctgatgcagaggagcctgtctgagagtgacacagacagcaacaacagcgaggaccccaagaccacccctgtgaggaaggctgaccggccccggccccagcccatcgtggagagcgtggagagcatggattctgctgagagcctgcacctgatgatcaagaagcacaccctggccagcggcggccgccgcttccccttcagcatcaaggccagcaagagcctggatggccacagccccagccccaccagcgagagcagcgagccagacctggagagccagtacccaggcagcggcagcatcccccccaaccagcccagcggggacccccagcagcccagcccagacagcacagctgcccagaaggtggccaccagccccaagagcgccctgaagagccccagcagcaagaggaggaccagccagaacctgaagctgcgggtgacctttgaggagcctgtggtgcagatggagcagcccagcctggagctgaatggagagaaggacaaggacaagggccgcaccctgcagaggaccagcaccagcaatgaaagtggggaccagctgaagaggccctttggagccttccgcagcatcatggagaccctgagcggcaaccagaacaacaacaacaactaccaggccgccaaccagctgaagaccagcaccctgcccctgaccagcctgggcaggaagacagatgccaagggcaacccagccagcagcgccagcaagggcaagaacaaggccgcctag

SEQ ID NO: 172514 - DNA, 405 bp, Artificial Sequence
  Description of Artificial Sequence: Synthetic coding sequence
atggatgtgttcatgaagggcctgtccatggccaaggagggcgtggtggccgctgctgagaagaccaagcagggcgtgacagaagctgctgagaagaccaaggagggcgtgctgtatgtgggcagcaagacccgggagggcgtggtgcagggcgtggcctctgtggccgagaagaccaaggagcaggccagccacctgggcggcgctgtgttcagcggggccggcaacattgctgctgccaccggcctggtgaagcgggaggagttccccacagacctgaagccagaggaggtggcccaggaggccgctgaggagcccctcatcgagcccctgatggagcctgagggggagagctatgaggaccccccccaggaggagtaccaggagtatgagcctgaggcctag

SEQ ID NO: 172515 - DNA, 405 bp, Artificial Sequence; identical to SEQ ID NO: 172514
  Description of Artificial Sequence: Synthetic coding sequence

SEQ ID NO: 172516 - DNA, 405 bp, Artificial Sequence; identical to SEQ ID NO: 172514
  Description of Artificial Sequence: Synthetic coding sequence

SEQ ID NO: 172517 - DNA, 405 bp, Artificial Sequence; identical to SEQ ID NO: 172514
  Description of Artificial Sequence: Synthetic coding sequence

SEQ ID NO: 172518 - DNA, 381 bp, Artificial Sequence
  Description of Artificial Sequence: Synthetic coding sequence
atggatgtgttcaagaagggcttcagcatcgccaaggagggcgtggtgggcgctgtggagaagaccaagcagggcgtgacagaagctgctgagaagaccaaggagggcgtgatgtatgtgggcgccaagaccaaggaaaatgtggtgcagagcgtgaccagcggcctgccctggggctggggctggggcggcggccagcctgtgagcagccacagcggccgggaggaccagggcgccggccagaggcgggagcggggctgtggggagcagaggcagcactgcggccaccaggaccggggcggcggcggggagcaccggggccacctgcggggcggggcccagggcggcctggaggccatctgcccccccaccggcggctag

SEQ ID NO: 172519 - DNA, 384 bp, Artificial Sequence
  Description of Artificial Sequence: Synthetic coding sequence
atggatgtgttcaagaagggcttcagcatcgccaaggagggcgtggtgggcgctgtggagaagaccaagcagggcgtgacagaagctgctgagaagaccaaggagggcgtgatgtatgtgggcgccaagaccaaggaaaatgtggtgcagagcgtgacctctgtggccgagaagaccaaggagcaggccaatgctgtgtctgaggccgtggtgtcctctgtgaacacagtggccaccaagacagtggaggaggccgagaacattgctgtgaccagcggcgtggtgaggaaggaggacctgcggcccagcgccccccagcaggagggggaggccagcaaggagaaggaggaggtggccgaggaggcccagagcggcggggactag

SEQ ID NO: 172520 - DNA, 471 bp, Artificial Sequence
  Description of Artificial Sequence: Synthetic coding sequence
atggccggccagttccgctcctatgtgtgggaccccctgctgatcctgagccagatcgtgctgatgcagacagtgtactacggcagcctgggcctgtggctggccctggtggatggcctggtgcgcagcagccccagcctggaccagatgtttgatgctgagatcctgggcttcagcaccccacctggccgcctgtccatgatgtccttcatcctgaatgccctgacctgtgccctgggcctgctgtacttcatccggcggggcaagcagtgcctggacttcaccgtgacagtgcacttcttccacctgctgggctgctggttctacagcagccgcttccccagcgccctgacctggtggctggtgcaggccgtgtgcatcgccctgatggctgtgattggagagtacctgtgcatgaggacagagctgaaggagatccccctgaacagcgcccccaagagcaatgtgtag

SEQ ID NO: 172521 - DNA, 471 bp, Artificial Sequence; identical to SEQ ID NO: 172520
  Description of Artificial Sequence: Synthetic coding sequence

SEQ ID NO: 172522 - DNA, 357 bp, Artificial Sequence
  Description of Artificial Sequence: Synthetic coding sequence
atggccggccagttccgctcctatgtgtgggaccccctgctgatcctgagccagatcgtgctgatgcagacagtgtactacggcagcctgggcctgtggctggccctggtggatggcctggtgcgcagcagccccagcctggaccagatgtttgatgctgagatcctgggcttcagcaccccacctggccgcctgtccatgatgtccttcatcctgaatgccctgacctgtgccctgggcctgctgtacttcatccggcggggcaagcagtgcctggacttcaccgtgacagtgcacttcttccacctgctgggctgctggttctacagcagccgcttccccagcgccctgacctag

SEQ ID NO: 172523 - DNA, 231 bp, Artificial Sequence
  Description of Artificial Sequence: Synthetic coding sequence
atggccggccagttccgctcctatgtgtgggaccccctgctgatcctgagccagatcgtgctgatgcagacagtgtactacggcagcctgggcctgtggctggccctggtggatggcctggtgcgcagcagccccagcctggaccagatgtttgatgctgagatcctgggcttcagcaccccacctggccgcctgtccatgatgtccttcatcctgaatgccctgacctag

SEQ ID NO: 172524 - DNA, 1134 bp, Artificial Sequence
  Description of Artificial Sequence: Synthetic coding sequence
atgagcagccctggaacagagagcgctgggaagagcctgcagtacagagtggaccacctgctgtctgctgtggagaatgagctgcaggccggcagcgagaagggggaccccacagagcgggagctgcgggtgggcctggaggagagcgagctgtggctgcgcttcaaggagctgaccaatgagatgattgtgaccaagaatggaagaaggatgtttcctgtgctgaaggtgaatgtgtctggcctggaccccaatgccatgtacagcttcctgctggactttgtggccgctgacaaccaccgctggaagtatgtgaatggagagtgggtgcctgggggcaagccagagccccaggcccccagctgtgtgtacatccacccagacagccccaactttggagcccactggatgaaggcccctgtgtccttcagcaaggtgaagctgaccaacaagctgaatggaggcggccagatcatgctgaacagcctgcacaagtatgagccccgcatccacatcgtgcgggtgggcggcccccagaggatgatcaccagccactgcttccctgagacccagttcatcgctgtgacagcctaccagaatgaggagatcacagccctgaagatcaagtacaacccctttgccaaggccttcctggatgccaaggagaggagtgaccacaaggagatgatggaggagcccggggacagccagcagcccggctacagccagagctacagcgacaacagccctgcctgcctgtccatgctgcagagccatgacaactggagcagcctgggcatgcctgcccaccccagcatgctgcctgtgagccacaatgccagcccccccaccagcagcagccagtaccccagcctgtggagcgtgtccaatggagctgtgaccccaggcagccaggccgctgctgtgtccaatggcctgggcgcccagttcttccggggcagccctgcccactacacccccctgacccaccctgtgtctgcccccagcagcagcggcagccccctgtatgaaggagctgctgctgccacagacatcgtggacagccagtatgatgctgctgcccagggccgcctcatcgcctcctggacccctgtgagcccccccagcatgtag

SEQ ID NO: 172525 - DNA, 735 bp, Artificial Sequence
  Description of Artificial Sequence: Synthetic coding sequence
atgcgctggtgcctgctgctgatctgggcccagggcctgcggcaggcccccctggccagcggcatgatgacaggcaccatcgagaccaccggcaacatctctgctgagaagggcggcagcatcatcctgcagtgccacctgagcagcaccacagcccaggtgacccaggtgaactgggagcagcaggaccagctgctggccatctgcaatgctgacctgggctggcacatcagccccagcttcaaggacagagtggcccctggccctggcctgggcctgaccctgcagagcctgactgtgaatgacacaggagagtacttctgcatctaccacacctacccagatggcacctacacaggccgcatcttcctggaggtgctggagagctctgtggccgagcacggggcccgcttccagatccccctgctgggcgccatggccgccaccctggtggtgatctgcacagctgtgattgtggtggtggccctgaccaggaagaagaaggccctgcgcatccacagcgtggagggggacctgcggaggaagtctgctggccaggaggagtggagccccagcgcccccagccccccaggcagctgtgtgcaggccgaggccgccccagctggcctgtgtggggagcagagaggagaggactgtgccgagctgcatgactacttcaacgtgctgagctaccgcagcctgggcaactgcagcttcttcacagaaacaggatag

SEQ ID NO: 172526 - DNA, 936 bp, Artificial Sequence
  Description of Artificial Sequence: Synthetic coding sequence
atggccttcctggtggcccaccccatgcagtttgtgtacctgctgaccaccctgtgtgtgttcaacatggtgtttgccaagctgggcttcagcgagaccgtcttcagccagaggctgtccttcaccgtgctgtctgctgtgggctacttccagtggcagaagaggccccacctgctgcctgtgggccccctgggccgctccatgcgctggtgcctgctgctgatctgggcccagggcctgcggcaggcccccctggccagcggcatgatgacaggcaccatcgagaccactggaaacatctctgctgagaagggcggcagcatcatcctgcagtgccacctgagcagcaccacagcccaggtgacccaggtgaactgggagcagcaggaccagctgctggccatctgcaatgctgacctgggctggcacatcagccccagcttcaaggacagagtggcccctggccctggcctgggcctgaccctgcagagcctgactgtgaatgacaccggggagtacttctgcatctaccacacctacccagatggcacctacacaggccgcatcttcctggaggtgctggagagctctgtggccgagcacggggcccgcttccagatccccctgctgggcgccatggccgccaccctggtggtgatctgcacagctgtgattgtggtggtggccctgaccaggaagaagaaggccctgcgcatccacagcgtggagggggacctgcggaggaagtctgctggccaggaggagtggagccccagcgcccccagccccccaggcagctgtgtgcaggccgaggccgccccagctggcctgtgtggggagcagagaggagaggactgtgccgagctgcatgactacttcaacgtgctgagctaccgcagcctgggcaactgcagcttcttcacagagaccggctag

SEQ ID NO: 172527 - DNA, 735 bp, Artificial Sequence; identical to SEQ ID NO: 172525
  Description of Artificial Sequence: Synthetic coding sequence

SEQ ID NO: 172528 - DNA, 561 bp, Artificial Sequence
  Description of Artificial Sequence: Synthetic coding sequence
atgagcggcatcagcggctgccccttcttcctgtggggcctgctggccctgctgggcctggccctggtgatcagcctcatcttcaacatcagccactacgtggagaagcagaggcaggacaagatgtacagctacagcagtgaccacaccagggtggatgagtactacatcgaggacacccccatctacggcaacctggatgacatgatcagcgagcccatggatgagaactgctatgagcagatgaaggcccggcctgagaagtctgtgaacaagatgcaggaggccaccccatctgcccaggccaccaatgagacccagatgtgctacgccagcctggaccacagcgtgaagggcaagaggaggaagcccaggaagcagaacacccacttcagtgacaaggatggagatgagcagctgcacgccattgatgcctctgtgtccaagaccaccctggtggacagcttcagccctgagagccaggccgtggaggagaacatccatgatgaccccatccggctgtttggcctcatccgggccaagcgggagcccatcaactag

SEQ ID NO: 172529 - DNA, 1308 bp, Artificial Sequence
  Description of Artificial Sequence: Synthetic coding sequence
atgagcagccctggaacagagagcgctgggaagagcctgcagtacagagtggaccacctgctgtctgctgtggagaatgagctgcaggccggcagcgagaagggggaccccacagagcgggagctgcgggtgggcctggaggagagcgagctgtggctgcgcttcaaggagctgaccaatgagatgattgtgaccaagaatggaagaaggatgtttcctgtgctgaaggtgaatgtgtctggcctggaccccaatgccatgtacagcttcctgctggactttgtggccgctgacaaccaccgctggaagtatgtgaatggagagtgggtgcctgggggcaagccagagccccaggcccccagctgtgtgtacatccacccagacagccccaactttggagcccactggatgaaggcccctgtgtccttcagcaaggtgaagctgaccaacaagctgaatggaggcggccagatcatgctgaacagcctgcacaagtatgagccccgcatccacatcgtgcgggtgggcggcccccagaggatgatcaccagccactgcttccctgagacccagttcatcgctgtgacagcctaccagaatgaggagatcacagccctgaagatcaagtacaacccctttgccaaggccttcctggatgccaaggagaggagtgaccacaaggagatgatggaggagcccggggacagccagcagcccggctacagccagtggggctggctgctgcccggcaccagcaccctgtgccccccagccaacccccacccccagtttggaggagccctgagcctgcccagcacccacagctgtgaccgctaccccaccctgcggagccacaggagcagcccctaccccagcccctatgcccacaggaacaacagccccacctacagcgacaacagccctgcctgcctgtccatgctgcagagccatgacaactggagcagcctgggcatgcctgcccaccccagcatgctgcctgtgagccacaatgccagcccccccaccagcagcagccagtaccccagcctgtggagcgtgtccaatggagctgtgaccccaggcagccaggccgctgctgtgtccaatggcctgggcgcccagttcttccggggcagccctgcccactacacccccctgacccaccctgtgtctgcccccagcagcagcggcagccccctgtatgaaggagctgctgctgccacagacatcgtggacagccagtatgatgctgctgcccagggccgcctcatcgcctcctggacccctgtgagcccccccagcatgtag

SEQ ID NO: 172530 - DNA, 732 bp, Artificial Sequence
  Description of Artificial Sequence: Synthetic coding sequence
atgagcagccctggaacagagagcgctgggaagagcctgcagtacagagtggaccacctgctgtctgctgtggagaatgagctgcaggccggcagcgagaagggggaccccacagagcgggagctgcgggtgggcctggaggagagcgagctgtggctgcgcttcaaggagctgaccaatgagatgattgtgaccaagaatggaagaaggatgtttcctgtgctgaaggtgaatgtgtctggcctggaccccaatgccatgtacagcttcctgctggactttgtggccgctgacaaccaccgctggaagtatgtgaatggagagtgggtgcctgggggcaagccagagccccaggcccccagctgtgtgtacatccacccagacagccccaactttggagcccactggatgaaggcccctgtgtccttcagcaaggtgaagctgaccaacaagctgaatggaggcggccagatcatgctgaacagcctgcacaagtatgagccccgcatccacatcgtgcgggtgggcggcccccagaggatgatcaccagccactgcttccctgagacccagttcatcgctgtgacagcctaccagaatgaggagatcacagccctgaagatcaagtacaacccctttgccaaggccttcctggatgccaaggagaggagtgaccacaaggagatgatggaggagcccggggacagccagcagcccggctacagccagtag

SEQ ID NO: 172531 - DNA, 366 bp, Artificial Sequence
  Description of Artificial Sequence: Synthetic coding sequence
atgaggatcatgctgctcttcaccgccatcctggccttcagcctggcccagagctttggagctgtgtgcaaggagccccaggaggaggtggtgcctgggggcggccgcagcaagagggaccctgacctgtaccagctgctgcagaggctcttcaagagccacagcagcctggagggcctgctgaaggccctgagccaggccagcacagaccccaaggagagcaccagccctgagaagagggacatgcatgacttctttgtgggcctgatgggcaagaggtctgtgcagcctgacagccccacagatgtgaaccaggagaatgtgcccagctttggcatcctgaagtacccacccagggctgagtag

SEQ ID NO: 172532 - DNA, 366 bp, Artificial Sequence; identical to SEQ ID NO: 172531
  Description of Artificial Sequence: Synthetic coding sequence

SEQ ID NO: 172533 - DNA, 312 bp, Artificial Sequence
  Description of Artificial Sequence: Synthetic coding sequence
atgaggatcatgctgctcttcaccgccatcctggccttcagcctggcccagagctttggagctgtgtgcaaggagccccaggaggaggtggtgcctgggggcggccgcagcaagagggaccctgacctgtaccagctgctgcagaggctcttcaagagccacagcagcctggagggcctgctgaaggccctgagccaggccagcacagaccccaaggagagcaccagccctgagaagcacagccccacagatgtgaaccaggagaatgtgcccagctttggcatcctgaagtacccacccagggctgagtag

SEQ ID NO: 172534 - DNA, 366 bp, Artificial Sequence; identical to SEQ ID NO: 172531
  Description of Artificial Sequence: Synthetic coding sequence

SEQ ID NO: 172535 - DNA, 1224 bp, Artificial Sequence
  Description of Artificial Sequence: Synthetic coding sequence
atggacaacgtgctgcctgtggacagcgacctgagccccaacatcagcaccaacaccagcgagcccaaccagtttgtgcagcctgcctggcagatcgtgctgtgggccgccgcctacaccgtcatcgtggtgacctctgtggtgggcaatgtggtggtgatgtggatcatcctggcccacaagaggatgaggacagtgaccaactacttcctggtgaacctggcctttgctgaggcctccatggccgccttcaacacagtggtgaacttcacctatgctgtgcacaatgagtggtactacggcctcttctactgcaagttccacaacttcttccccatcgctgctgtgtttgccagcatctacagcatgacagctgtggcctttgaccgctacatggccatcatccaccccctgcagccccggctgagcgccacagccaccaaggtggtgatctgtgtgatctgggtgctggccctgctgctggccttcccccagggctactacagcaccacagagaccatgcccagccgggtggtgtgcatgattgagtggccagagcaccccaacaagatctatgagaaggtgtaccacatctgtgtgacagtgctgatctacttcctgcccctgctggtgattggctacgcctacacagtggtgggcatcaccctgtgggccagcgagatccctggggacagcagtgaccgctaccacgagcaggtgtctgccaagaggaaggtggtgaagatgatgattgtggtggtgtgcacctttgccatctgctggctgcccttccacatcttcttcctgctgccctacatcaacccagacctgtacctgaagaagttcatccagcaggtgtacctggccatcatgtggctggccatgagcagcaccatgtacaaccccatcatctactgctgcctgaatgaccgcttccggctgggcttcaagcacgccttccgctgctgccccttcatctctgctggggactatgagggcctggagatgaagagcacccgctacctgcagacccagggctctgtgtacaaggtgtcccggctggagaccaccatcagcacagtggtgggcgcccacgaggaggagccagaagatggccccaaggccacccccagcagcctggacctgaccagcaactgcagcagcagaagtgacagcaagaccatgacagagagcttctccttcagcagcaatgtgctgtcctag

SEQ ID NO: 172536 - DNA, 936 bp, Artificial Sequence
  Description of Artificial Sequence: Synthetic coding sequence
atggacaacgtgctgcctgtggacagcgacctgagccccaacatcagcaccaacaccagcgagcccaaccagtttgtgcagcctgcctggcagatcgtgctgtgggccgccgcctacaccgtcatcgtggtgacctctgtggtgggcaatgtggtggtgatgtggatcatcctggcccacaagaggatgaggacagtgaccaactacttcctggtgaacctggcctttgctgaggcctccatggccgccttcaacacagtggtgaacttcacctatgctgtgcacaatgagtggtactacggcctcttctactgcaagttccacaacttcttccccatcgctgctgtgtttgccagcatctacagcatgacagctgtggcctttgaccgctacatggccatcatccaccccctgcagccccggctgagcgccacagccaccaaggtggtgatctgtgtgatctgggtgctggccctgctgctggccttcccccagggctactacagcaccacagagaccatgcccagccgggtggtgtgcatgattgagtggccagagcaccccaacaagatctatgagaaggtgtaccacatctgtgtgacagtgctgatctacttcctgcccctgctggtgattggctacgcctacacagtggtgggcatcaccctgtgggccagcgagatccctggggacagcagtgaccgctaccacgagcaggtgtctgccaagaggaaggtggtgaagatgatgattgtggtggtgtgcacctttgccatctgctggctgcccttccacatcttcttcctgctgccctacatcaacccagacctgtacctgaagaagttcatccagcaggtgtacctggccatcatgtggctggccatgagcagcaccatgtacaaccccatcatctactgctgcctgaatgacagatag

SEQ ID NO: 172537 - DNA, 1197 bp, Artificial Sequence
  Description of Artificial Sequence: Synthetic coding sequence
atgggcacctgtgacatcgtgacagaggccaacatcagcagcggccctgagagcaacaccaccggcatcacagccttctccatgcccagctggcagctggccctgtgggccacagcctacctggccctggtgctggtggccgtgactggaaatgccatcgtcatctggatcatcctggcccacaggaggatgaggacagtgaccaactacttcatcgtgaacctggccctggccgacctgtgcatggccgccttcaatgctgccttcaactttgtgtatgccagccacaacatctggtacttcggccgggccttctgctacttccagaacctcttccccatcacagccatgtttgtgtccatctacagcatgacagccatcgctgctgaccgctacatggccatcgtgcaccccttccagccccggctgagcgcccccagcaccaaggctgtgattgctggcatctggctggtggccctggccctggccagcccccagtgcttctacagcacagtgaccatggaccagggcgccaccaagtgtgtggtggcctggccagaagattctgggggcaagaccctgctgctgtaccacctggtggtgattgccctgatctacttcctgcccctggccgtgatgtttgtggcctacagcgtcatcggcctgaccctgtggaggagagctgtgcccggccaccaggcccatggagccaacctgcggcacctgcaggccatgaagaagtttgtgaagaccatggtgctggtggtgctgacctttgccatctgctggctgccctaccacctgtacttcatcctgggcagcttccaggaggacatctactgccacaagttcatccagcaggtgtacctggccctcttctggctggccatgagcagcaccatgtacaaccccatcatctactgctgcctgaaccaccgcttccgcagcggcttccggctggccttccgctgctgcccctgggtgacccccaccaaggaggacaagctggagctgacccccaccaccagcctgagcaccagggtgaaccgctgccacaccaaggagaccctcttcatggccggggacacagcccccagcgaggccaccagcggggaggccggccggccccaggacggcagcggcctgtggtttggctacggcctgctggcccccaccaagacccacgtggagatctag

SEQ ID NO: 172538 - DNA, 561 bp, Artificial Sequence
  Description of Artificial Sequence: Synthetic coding sequence
atgtttgtggcctacagcgtcatcggcctgaccctgtggaggagagctgtgcccggccaccaggcccatggagccaacctgcggcacctgcaggccatgaagaagtttgtgaagaccatggtgctggtggtgctgacctttgccatctgctggctgccctaccacctgtacttcatcctgggcagcttccaggaggacatctactgccacaagttcatccagcaggtgtacctggccctcttctggctggccatgagcagcaccatgtacaaccccatcatctactgctgcctgaaccaccgcttccgcagcggcttccggctggccttccgctgctgcccctgggtgacccccaccaaggaggacaagctggagctgacccccaccaccagcctgagcaccagggtgaaccgctgccacaccaaggagaccctcttcatggccggggacacagcccccagcgaggccaccagcggggaggccggccggccccaggacggcagcggcctgtggtttggctacggcctgctggcccccaccaagacccacgtggagatctag

SEQ ID NO: 172539 - DNA, 1398 bp, Artificial Sequence
  Description of Artificial Sequence: Synthetic coding sequence
atggccaccctgcctgctgctgagacctggattgatggcggcggcggcgtgggcgcagatgctgtgaacctgacagccagcctggccgccggggccgccaccggggctgtggagaccggctggctgcagctgctggaccaggccggcaacctgagcagcagccccagcgccctgggcctgcctgtggccagccctgcccccagccagccctgggccaacctgaccaaccagtttgtgcagcccagctggagaattgccctgtggagcctggcctacggcgtggtggtggccgtggccgtgctgggcaacctgattgtcatctggatcatcctggcccacaagaggatgaggacagtgaccaactacttcctggtgaacctggccttcagtgatgcctccatggccgccttcaacaccctggtgaacttcatctatgccctgcacagcgagtggtactttggagccaactactgccgcttccagaacttcttccccatcacagctgtgtttgccagcatctacagcatgacagccatcgctgtggaccgctacatggccatcatcgaccccctgaagccccggctgagcgccacagccaccaagatcgtcatcggcagcatctggatcctggccttcctgctggccttcccccagtgcctgtacagcaagaccaaggtgatgcctggccgcaccctgtgctttgtgcagtggccagagggccccaagcagcacttcacctaccacatcatcgtcatcatcctggtgtactgcttccccctgctgatcatgggcatcacctacaccatcgtgggcatcaccctgtggggcggggagatccctggggacacctgtgacaagtaccacgagcagctgaaggccaagaggaaggtggtgaagatgatgatcatcgtggtgatgacctttgccatctgctggctgccctaccacatctacttcatcctgacagccatctaccagcagctgaaccgctggaagtacatccagcaggtgtacctggccagcttctggctggccatgagcagcaccatgtacaaccccatcatctactgctgcctgaacaagcgcttccgggccggcttcaagagggccttccgctggtgccccttcatcaaggtgtcctcctatgatgagctggagctgaagaccacccgcttccaccccaaccggcagagctccatgtacacagtgaccaggatggagagcatgacagtggtgtttgaccccaatgatgctgacaccaccaggagcagcaggaagaagagggccaccccccgggaccccagcttcaacggctgcagcagaagaaacagcaagagcgccagcgccaccagcagcttcatcagcagcccctacacctctgtggatgagtacagctag

SEQ ID NO: 172540 - DNA, 5682 bp, Artificial Sequence
  Description of Artificial Sequence: Synthetic coding sequence
atgggccctggctgtgacctgctgctgaggacagctgccaccatcacagctgctgccatcatgtctgacacagacagtgatgaggacagcgctgggggcggccccttcagcctggccggcttcctgtttggaaacatcaatggagctggccagctggagggggagagcgtgctggatgatgagtgcaagaagcacctggccggcctgggcgccctgggcctgggcagcctcatcacagagctgacagccaatgaggagctgaccggcacagatggagccctggtgaatgatgagggctgggtgcgcagcacagaagatgctgtggactacagcgacatcaatgaggtggccgaggatgagagccgccgctaccagcagaccatgggcagcctgcagcccctgtgccacagcgactatgatgaagatgattatgatgctgactgtgaagatattgactgcaagctgatgcctcctcctcctcctcctcctggccccatgaagaaggacaaggaccaggacagcatcaccggggtgtctgaaaatggagagggcatcatcctgcccagcatcatcgcccccagcagcctggccagcgagaaggtggacttcagcagcagcagtgacagcgagagcgagatgggcccccaggaggccacccaggccgagagtgaagatggcaagctgaccctgcccctggccggcatcatgcagcatgatgccaccaagctgctgcccagcgtgacagagctgtttcctgagttccggcctgggaaggtgctgcgcttcctgcggctgtttggacctgggaagaatgtgcccagcgtgtggaggtctgcccggaggaagaggaagaagaagcaccgggagctgatccaggaggagcagatccaggaggtggagtgcagcgtggagagcgaggtgtcccagaagagcctgtggaactatgactatgcccctcctcctcctcctgagcagtgcctgagtgatgatgagatcaccatgatggcccctgtggagagcaagttcagccagagcactggagacatcgacaaggtgacagacaccaagccccgggtggccgagtggaggtatggccctgcccggctgtggtatgacatgctgggcgtgcctgaagatggcagcggctttgattatggcttcaagctgaggaagacagagcacgagcccgtcatcaagagcaggatgattgaggagttcaggaagctggaggagaacaatggaacagacctgctggctgatgagaacttcctgatggtgacccagctgcactgggaggatgacatcatctgggatggagaagatgtgaagcacaagggcaccaagccccagagggccagcctggccggctggctgcccagctccatgaccagaaatgccatggcctacaacgtgcagcagggctttgctgccaccctggatgatgacaagccctggtacagcatcttccccatcgacaatgaagacctggtgtatggccgctgggaggacaacatcatctgggatgcccaggccatgccccggctgctggagccccctgtgctgaccctggaccccaatgatgagaacctgatcctggagatcccagatgagaaggaggaggccaccagcaacagccccagcaaggagagcaagaaggagagcagcctgaagaagagccgcatcctgctgggcaagacaggagtcatcaaggaggagccccagcagaacatgagccagcctgaggtgaaggacccctggaacctgagcaatgatgagtactactaccccaagcagcagggcctgcggggcacctttggaggcaacatcatccagcacagcatcccagctgtggagctgcggcagcccttcttccccacccacatgggccccatcaagctgcggcagttccacaggcctcccctgaagaagtacagctttggagccctgagccagcccggcccccacagcgtgcagcccctgctgaagcacatcaagaagaaggccaagatgagggagcaggagcggcaggccagcggcggcggggagatgttcttcatgaggaccccccaggacctgaccgggaaggatggagacctgatcctggccgagtacagtgaagaaaatggccccctgatgatgcaggtgggcatggccaccaagatcaagaactactacaagaggaagccaggcaaggaccccggggccccagactgcaagtacggggagaccgtgtactgccacaccagccccttcctgggcagcctgcaccctggccagctgctgcaggcctttgagaacaacctcttccgggcccccatctacctgcacaagatgcctgagacagacttcctgatcatccgcacccggcagggctactacatccgggagctggtggacatctttgtggtgggccagcagtgccccctgtttgaggtgcccggccccaacagcaagagggccaacacccacatccgggacttcctgcaggtgttcatctaccgcctcttctggaagagcaaggaccggccccggcgcatccgcatggaggacatcaagaaggccttccccagccacagcgagagcagcatcaggaagaggctgaagctgtgtgccgacttcaagaggacaggcatggacagcaactggtgggtgctgaagagtgacttccggctgcccacagaggaggagatccgggccatggtgtccccagagcagtgctgtgcctactacagcatgattgctgctgagcagaggctgaaggatgctggctacggggagaagagcttctttgcccctgaggaggagaatgaggaggacttccagatgaagattgatgatgaggtgaggacagccccctggaacaccacccgggccttcatcgccgccatgaagggcaagtgcctgctggaggtgactggagtggccgaccccaccggctgtggggagggcttctcctatgtgaagatccccaacaagcccacccagcagaaggatgacaaggagccccagcctgtgaagaagacagtgactggaacagatgctgacctgcggcggctgagcctgaagaatgccaagcagctgctgaggaagtttggagtgcctgaggaggagatcaagaagctgagccgctgggaggtgattgatgtggtgaggaccatgagcacagagcaggcccggagcggggagggccccatgagcaagtttgcccggggcagccgcttctctgtggccgagcaccaggagcgctacaaggaggagtgccagaggatctttgacctgcagaacaaggtgctgagcagcacagaggtgctgagcacagacacagacagcagcagcgctgaggacagcgactttgaggagatgggcaagaacatcgagaacatgctgcagaacaagaagaccagcagccagctgagccgggagcgggaggagcaggagaggaaggagctgcagaggatgctgctggccgccggcagcgctgccagcggcaacaaccacagagatgatgacacagcctctgtgaccagcctgaacagcagcgccaccggccgctgcctgaagatctaccgcaccttcagagatgaggagggcaaggagtatgtgcgctgtgaaacagtgaggaagccagctgtgattgatgcctacgtgcgcatccgcaccaccaaggatgaggagttcatcaggaagtttgccctgtttgatgagcagcaccgggaggagatgaggaaggagcggcggcgcatccaggagcagctgcggcggctgaagaggaaccaggagaaggagaagctgaagggccccccagagaagaagcccaagaagatgaaggagaggccagacctgaagctgaagtgtggggcctgtggggccatcggccacatgaggaccaacaagttctgccccctgtactaccagaccaatgccccacccagcaaccctgtggccatgacagaggagcaggaggaggagctggagaagacagtcatccacaatgacaatgaggagctgatcaaggtggagggcaccaagatcgtgctgggcaagcagctgattgaatctgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgagagaaaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaacggccctgagagccagtacaccaagacagcccaggagatcgtgaatgtgtgctaccagaccctgacagaatatgatgagcacctgacccagctggagaaggacatctgcacagccaaggaggccgccctggaggaggccgagctggagagcctggaccccatgaccccaggcccctacaccccccagcccccagacctgtatgacaccaacaccagcctgtccatgagcagagatgccagcgtcttccaggatgagagcaacatgtctgtgctggacatccccagcgccaccccagagaagcaggtgacccaggagggagaagatggagatggagacctggctgatgaggaggagggcaccgtgcagcagccccaggcctctgtgctgtatgaggacctgctgatgtctgaaggagaagatgatgaagaagatgctggcagtgatgaggagggggacaaccccttcagcgccatccagctgtctgagagcggcagtgacagtgatgtgggcagcggcggcatccggcccaagcagcccaggatgctgcaggagaacaccaggatggacatggagaatgaggagagcatgatgtcctatgaaggagatggaggagaggccagccacggcctggaggacagcaacatctcctatggcagctatgaggagccagaccccaagagcaacacccaggacaccagcttcagcagcattggaggctatgaggtgtctgaggaggaggaggatgaggaggaggaggagcagaggagcggccccagcgtgctgagccaggtgcacctgtctgaagatgaagaagattctgaggacttccacagcattgctggggacagcgacctggacagtgatgaatag

SEQ ID NO: 172541 - DNA, 5619 bp, Artificial Sequence
  Description of Artificial Sequence: Synthetic coding sequence
atgggccctggctgtgacctgctgctgaggacagctgccaccatcacagctgctgccatcatgtctgacacagacagtgatgaggacagcgctgggggcggccccttcagcctggccggcttcctgtttggaaacatcaatggagctggccagctggagggggagagcgtgctggatgatgagtgcaagaagcacctggccggcctgggcgccctgggcctgggcagcctcatcacagagctgacagccaatgaggagctgaccggcacagatggagccctggtgaatgatgagggctgggtgcgcagcacagaagatgctgtggactacagcgacatcaatgaggtggccgaggatgagagccgccgctaccagcagaccatgggcagcctgcagcccctgtgccacagcgactatgatgaagatgattatgatgctgactgtgaagatattgactgcaagctgatgcctcctcctcctcctcctcctggccccatgaagaaggacaaggaccaggacagcatcaccggggagaaggtggacttcagcagcagcagtgacagcgagagcgagatgggcccccaggaggccacccaggccgagagtgaagatggcaagctgaccctgcccctggccggcatcatgcagcatgatgccaccaagctgctgcccagcgtgacagagctgtttcctgagttccggcctgggaaggtgctgcgcttcctgcggctgtttggacctgggaagaatgtgcccagcgtgtggaggtctgcccggaggaagaggaagaagaagcaccgggagctgatccaggaggagcagatccaggaggtggagtgcagcgtggagagcgaggtgtcccagaagagcctgtggaactatgactatgcccctcctcctcctcctgagcagtgcctgagtgatgatgagatcaccatgatggcccctgtggagagcaagttcagccagagcactggagacatcgacaaggtgacagacaccaagccccgggtggccgagtggaggtatggccctgcccggctgtggtatgacatgctgggcgtgcctgaagatggcagcggctttgattatggcttcaagctgaggaagacagaacatgagcctgtgatcaagagcaggatgattgaggagttcaggaagctggaggagaacaacggcacagacctgctggctgatgagaacttcctgatggtgacccagctgcactgggaggatgacatcatctgggatggagaagatgtgaagcacaagggcaccaagccccagagggccagcctggccggctggctgcccagctccatgaccagaaatgccatggcctacaacgtgcagcagggctttgctgccaccctggatgatgacaagccctggtacagcatcttccccatcgacaatgaagacctggtgtatggccgctgggaggacaacatcatctgggatgcccaggccatgccccggctgctggagccccctgtgctgaccctggaccccaatgatgaaaatctcatcctggagatcccagatgagaaggaggaggccaccagcaacagccccagcaaggagagcaagaaggagagcagcctgaagaagagccgcatcctgctgggcaagacaggagtcatcaaggaggagccccagcagaacatgagccagcctgaggtgaaggacccctggaacctgagcaatgatgagtactactaccccaagcagcagggcctgcggggcaccttcggcggcaacatcatccagcacagcatcccagctgtggagctgcggcagcccttcttccccacccacatgggccccatcaagctgcggcagttccaccggccccccctgaagaagtacagctttggagccctgagccagcccggcccccacagcgtgcagcccctgctgaagcacatcaagaagaaggccaagatgagggagcaggagcggcaggccagcggcggcggggagatgttcttcatgaggaccccccaggacctgaccgggaaggatggagacctgatcctggccgagtacagcgaggagaatggccccctgatgatgcaggtgggcatggccaccaagatcaagaactactacaagaggaagccaggcaaggaccccggggccccagactgcaagtatggagagaccgtgtactgccacaccagccccttcctgggcagcctgcaccctggccagctgctgcaggcctttgagaacaacctcttccgggcccccatctacctgcacaagatgcctgagacagacttcctgatcatccgcacccggcagggctactacatccgggagctggtggacatctttgtggtgggccagcagtgccccctgtttgaggtgcccggccccaacagcaagagggccaacacccacatccgggacttcctgcaggtgttcatctaccgcctcttctggaagagcaaggaccggccccggcgcatccgcatggaggacatcaagaaggccttccccagccacagcgagagcagcatcaggaagaggctgaagctgtgtgccgacttcaagaggacaggcatggacagcaactggtgggtgctgaagagtgacttccggctgcccacagaggaggagatccgggccatggtgtccccagagcagtgctgtgcctactacagcatgattgctgctgagcagaggctgaaggatgctggctatggagagaagagcttctttgcccctgaggaggagaatgaggaggacttccagatgaagattgatgatgaggtgaggacagccccctggaacaccacccgggccttcatcgccgccatgaagggcaagtgcctgctggaggtgactggagtggccgaccccaccggctgtggggagggcttctcctatgtgaagatccccaacaagcccacccagcagaaggatgacaaggagccccagcctgtgaagaagacagtgactggaacagatgctgacctgcggcggctgagcctgaagaatgccaagcagctgctgaggaagtttggagtgcctgaggaggagatcaagaagctgagccgctgggaggtgattgatgtggtgaggaccatgagcacagagcaggcccggtctggagagggccccatgagcaagtttgcccggggcagccgcttctctgtggccgagcaccaggagcgctacaaggaggagtgccagaggatctttgacctgcagaacaaggtgctgagcagcacagaggtgctgagcacagacacagacagcagcagcgcagaagattctgactttgaggagatgggcaagaacatcgagaacatgctgcagaacaagaagaccagcagccagctgagccgggagcgggaggagcaggagaggaaggagctgcagaggatgctgctggccgccggcagcgctgccagcggcaacaaccacagagatgatgacacagcctctgtgaccagcctgaacagcagcgccaccggccgctgcctgaagatctaccgcaccttcagagatgaggagggcaaggagtatgtgcgctgtgagaccgtgaggaagccagctgtgattgatgcctacgtgcgcatccgcaccaccaaggatgaggagttcatcaggaagtttgccctgtttgatgagcagcaccgggaggagatgaggaaggagcggcggcgcatccaggagcagctgcggcggctgaagaggaaccaggagaaggagaagctgaagggccccccagagaagaagcccaagaagatgaaggagaggccagacctgaagctgaagtgtggggcctgtggggccatcggccacatgaggaccaacaagttctgccccctgtactaccagaccaatgccccacccagcaaccctgtggccatgacagaggagcaggaggaggagctggagaagacagtcatccacaatgacaatgaggagctgatcaaggtggagggcaccaagatcgtgctgggcaagcagctgattgagagcgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgcgggagaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaatggacctgagagccagtacaccaagacagcccaggagatcgtgaatgtgtgctaccagaccctgacagaatatgatgagcacctgacccagctggagaaggacatctgcacagccaaggaggccgccctggaggaggccgagctggagagcctggaccccatgaccccaggcccctacaccccccagcccccagacctgtatgacaccaacaccagcctgtccatgagcagagatgcctctgtgttccaggatgagagcaacatgtctgtgctggacatccccagcgccaccccagagaagcaggtgacccaggagggggaggatggagatggagacctggctgatgaggaggagggcaccgtgcagcagccccaggcctctgtgctgtatgaggacctgctgatgtctgagggggaggatgatgaggaggatgctggcagtgatgaggagggggacaaccccttcagcgccatccagctgtctgagagcggcagtgacagtgatgtgggcagcggcggcatccggcccaagcagcccaggatgctgcaggagaacaccaggatggacatggagaatgaggagagcatgatgtcctatgaaggagatggaggagaggccagccacggcctggaggacagcaacatctcctatggcagctatgaggagccagaccccaagagcaacacccaggacaccagcttcagcagcatcggcggctatgaggtgtctgaggaggaggaggatgaggaggaggaggagcagaggagcggccccagcgtgctgagccaggtgcacctgtctgaagatgaggaggacagcgaggacttccacagcattgctggggacagcgacctggacagtgatgaatag

SEQ ID NO: 172542 - DNA, 1632 bp, Artificial Sequence
  Description of Artificial Sequence: Synthetic coding sequence
atgacagaggagcaggaggaggagctggagaagacagtcatccacaatgacaatgaggagctgatcaaggtggagggcaccaagatcgtgctgggcaagcagctgattgagagcgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgcgggagaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaatggacctgagagccagtacaccaagacagcccaggagatcgtgaatgtgtgctaccagaccctgacagaatatgatgagcacctgacccagctggagaaggacatctgcacagccaaggaggccgccctggaggaggccgagctggagagcctggaccccatgaccccaggcccctacaccccccaggccaagcccccagacctgtatgacaccaacaccagcctgtccatgagcagagatgcctctgtgttccaggatgagagcaacatgtctgtgctggacatccccagcgccaccccagagaagcaggtgacccagatgaggcagggccggggccgcctgggggaggaggacagtgatgtggacatcgagggctatgatgatgaggaggaggatggcaagcccaagaccccagcccctgagggggaggatggagatggagacctggctgatgaggaggagggcaccgtgcagcagccccaggcctctgtgctgtatgaggacctgctgatgtctgagggggaggatgatgaggaggatgctggcagtgatgaggagggggacaaccccttcagcgccatccagctgtctgagagcggcagtgacagtgatgtgggcagcggcggcatccggcccaagcagcccaggatgctgcaggagaacaccaggatggacatggagaatgaggagagcatgatgtcctatgaaggagatggaggagaggccagccacggcctggaggacagcaacatcagccaccagtag

SEQ ID NO: 172543 - DNA, 5688 bp, Artificial Sequence
  Description of Artificial Sequence: Synthetic coding sequence
atgggccctggctgtgacctgctgctgaggacagctgccaccatcacagctgctgccatcatgtctgacacagacagtgatgaggacagcgctgggggcggccccttcagcctggccggcttcctgtttggaaacatcaatggagctggccagctggagggggagagcgtgctggatgatgagtgcaagaagcacctggccggcctgggcgccctgggcctgggcagcctcatcacagagctgacagccaatgaggagctgaccggcacagatggagccctggtgaatgatgagggctgggtgcgcagcacagaagatgctgtggactacagcgacatcaatgaggtggccgaggatgagagccgccgctaccagcagaccatgggcagcctgcagcccctgtgccacagcgactatgatgaagatgattatgatgctgactgtgaagatattgactgcaagctgatgcctcctcctcctcctcctcctggccccatgaagaaggacaaggaccaggacagcatcaccggggtgtctgaaaatggagagggcatcatcctgcccagcatcatcgcccccagcagcctggccagcgagaaggtggacttcagcagcagcagtgacagcgagagcgagatgggcccccaggaggccacccaggccgagagtgaagatggcaagctgaccctgcccctggccggcatcatgcagcatgatgccaccaagctgctgcccagcgtgacagagctgtttcctgagttccggcctgggaaggtgctgcgcttcctgcggctgtttggacctgggaagaatgtgcccagcgtgtggaggtctgcccggaggaagaggaagaagaagcaccgggagctgatccaggaggagcagatccaggaggtggagtgcagcgtggagagcgaggtgtcccagaagagcctgtggaactatgactatgcccctcctcctcctcctgagcagtgcctgagtgatgatgagatcaccatgatggcccctgtggagagcaagttcagccagagcactggagacatcgacaaggtgacagacaccaagccccgggtggccgagtggaggtatggccctgcccggctgtggtatgacatgctgggcgtgcctgaagatggcagcggctttgattatggcttcaagctgaggaagacagagcacgagcccgtcatcaagagcaggatgattgaggagttcaggaagctggaggagaacaatggaacagacctgctggctgatgagaacttcctgatggtgacccagctgcactgggaggatgacatcatctgggatggagaagatgtgaagcacaagggcaccaagccccagagggccagcctggccggctggctgcccagctccatgaccagaaatgccatggcctacaacgtgcagcagggctttgctgccaccctggatgatgacaagccctggtacagcatcttccccatcgacaatgaagacctggtgtatggccgctgggaggacaacatcatctgggatgcccaggccatgccccggctgctggagccccctgtgctgaccctggaccccaatgatgagaacctgatcctggagatcccagatgagaaggaggaggccaccagcaacagccccagcaaggagagcaagaaggagagcagcctgaagaagagccgcatcctgctgggcaagacaggagtcatcaaggaggagccccagcagaacatgagccagcctgaggtgaaggacccctggaacctgagcaatgatgagtactactaccccaagcagcagggcctgcggggcacctttggaggcaacatcatccagcacagcatcccagctgtggagctgcggcagcccttcttccccacccacatgggccccatcaagctgcggcagttccacaggcctcccctgaagaagtacagctttggagccctgagccagcccggcccccacagcgtgcagcccctgctgaagcacatcaagaagaaggccaagatgagggagcaggagcggcaggccagcggcggcggggagatgttcttcatgaggaccccccaggacctgaccgggaaggatggagacctgatcctggccgagtacagtgaagaaaatggccccctgatgatgcaggtgggcatggccaccaagatcaagaactactacaagaggaagccaggcaaggaccccggggccccagactgcaagtacggggagaccgtgtactgccacaccagccccttcctgggcagcctgcaccctggccagctgctgcaggcctttgagaacaacctcttccgggcccccatctacctgcacaagatgcctgagacagacttcctgatcatccgcacccggcagggctactacatccgggagctggtggacatctttgtggtgggccagcagtgccccctgtttgaggtgcccggccccaacagcaagagggccaacacccacatccgggacttcctgcaggtgttcatctaccgcctcttctggaagagcaaggaccggccccggcgcatccgcatggaggacatcaagaaggccttccccagccacagcgagagcagcatcaggaagaggctgaagctgtgtgccgacttcaagaggacaggcatggacagcaactggtgggtgctgaagagtgacttccggctgcccacagaggaggagatccgggccatggtgtccccagagcagtgctgtgcctactacagcatgattgctgctgagcagaggctgaaggatgctggctacggggagaagagcttctttgcccctgaggaggagaatgaggaggacttccagatgaagattgatgatgaggtgaggacagccccctggaacaccacccgggccttcatcgccgccatgaagggcaagtgcctgctggaggtgactggagtggccgaccccaccggctgtggggagggcttctcctatgtgaagatccccaacaagcccacccagcagaaggatgacaaggagccccagcctgtgaagaagacagtgactggaacagatgctgacctgcggcggctgagcctgaagaatgccaagcagctgctgaggaagtttggagtgcctgaggaggagatcaagaagctgagccgctgggaggtgattgatgtggtgaggaccatgagcacagagcaggcccggagcggggagggccccatgagcaagtttgcccggggcagccgcttctctgtggccgagcaccaggagcgctacaaggaggagtgccagaggatctttgacctgcagaacaaggtgctgagcagcacagaggtgctgagcacagacacagacagcagcagcgctgaggacagcgactttgaggagatgggcaagaacatcgagaacatgctgcagaacaagaagaccagcagccagctgagccgggagcgggaggagcaggagaggaaggagctgcagaggatgctgctggccgccggcagcgctgccagcggcaacaaccacagagatgatgacacagcctctgtgaccagcctgaacagcagcgccaccggccgctgcctgaagatctaccgcaccttcagagatgaggagggcaaggagtatgtgcgctgtgaaacagtgaggaagccagctgtgattgatgcctacgtgcgcatccgcaccaccaaggatgaggagttcatcaggaagtttgccctgtttgatgagcagcaccgggaggagatgaggaaggagcggcggcgcatccaggagcagctgcggcggctgaagaggaaccaggagaaggagaagctgaagggccccccagagaagaagcccaagaagatgaaggagaggccagacctgaagctgaagtgtggggcctgtggggccatcggccacatgaggaccaacaagttctgccccctgtactaccagaccaatgccccacccagcaaccctgtggccatgacagaggagcaggaggaggagctggagaagacagtcatccacaatgacaatgaggagctgatcaaggtggagggcaccaagatcgtgctgggcaagcagctgattgaatctgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgagagaaaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaacggccctgagagccagtacaccaagacagcccaggagatcgtgaatgtgtgctaccagaccctgacagaatatgatgagcacctgacccagctggagaaggacatctgcacagccaaggaggccgccctggaggaggccgagctggagagcctggaccccatgaccccaggcccctacaccccccaggccaagcccccagacctgtatgacaccaacaccagcctgtccatgagcagagatgccagcgtcttccaggatgagagcaacatgtctgtgctggacatccccagcgccaccccagagaagcaggtgacccaggagggagaagatggagatggagacctggctgatgaggaggagggcaccgtgcagcagccccaggcctctgtgctgtatgaggacctgctgatgtctgaaggagaagatgatgaagaagatgctggcagtgatgaggagggggacaaccccttcagcgccatccagctgtctgagagcggcagtgacagtgatgtgggcagcggcggcatccggcccaagcagcccaggatgctgcaggagaacaccaggatggacatggagaatgaggagagcatgatgtcctatgaaggagatggaggagaggccagccacggcctggaggacagcaacatctcctatggcagctatgaggagccagaccccaagagcaacacccaggacaccagcttcagcagcattggaggctatgaggtgtctgaggaggaggaggatgaggaggaggaggagcagaggagcggccccagcgtgctgagccaggtgcacctgtctgaagatgaagaagattctgaggacttccacagcattgctggggacagcgacctggacagtgatgaatag

SEQ ID NO: 172544 - DNA, 5721 bp, Artificial Sequence
  Description of Artificial Sequence: Synthetic coding sequence
atgggccctggctgtgacctgctgctgaggacagctgccaccatcacagctgctgccatcatgtctgacacagacagtgatgaggacagcgctgggggcggccccttcagcctggccggcttcctgtttggaaacatcaatggagctggccagctggagggggagagcgtgctggatgatgagtgcaagaagcacctggccggcctgggcgccctgggcctgggcagcctcatcacagagctgacagccaatgaggagctgaccggcacagatggagccctggtgaatgatgagggctgggtgcgcagcacagaagatgctgtggactacagcgacatcaatgaggtggccgaggatgagagccgccgctaccagcagaccatgggcagcctgcagcccctgtgccacagcgactatgatgaagatgattatgatgctgactgtgaagatattgactgcaagctgatgcctcctcctcctcctcctcctggccccatgaagaaggacaaggaccaggacagcatcaccggggagaaggtggacttcagcagcagcagtgacagcgagagcgagatgggcccccaggaggccacccaggccgagagtgaagatggcaagctgaccctgcccctggccggcatcatgcagcatgatgccaccaagctgctgcccagcgtgacagagctgtttcctgagttccggcctgggaaggtgctgcgcttcctgcggctgtttggacctgggaagaatgtgcccagcgtgtggaggtctgcccggaggaagaggaagaagaagcaccgggagctgatccaggaggagcagatccaggaggtggagtgcagcgtggagagcgaggtgtcccagaagagcctgtggaactatgactatgcccctcctcctcctcctgagcagtgcctgagtgatgatgagatcaccatgatggcccctgtggagagcaagttcagccagagcactggagacatcgacaaggtgacagacaccaagccccgggtggccgagtggaggtatggccctgcccggctgtggtatgacatgctgggcgtgcctgaagatggcagcggctttgattatggcttcaagctgaggaagacagaacatgagcctgtgatcaagagcaggatgattgaggagttcaggaagctggaggagaacaacggcacagacctgctggctgatgagaacttcctgatggtgacccagctgcactgggaggatgacatcatctgggatggagaagatgtgaagcacaagggcaccaagccccagagggccagcctggccggctggctgcccagctccatgaccagaaatgccatggcctacaacgtgcagcagggctttgctgccaccctggatgatgacaagccctggtacagcatcttccccatcgacaatgaagacctggtgtatggccgctgggaggacaacatcatctgggatgcccaggccatgccccggctgctggagccccctgtgctgaccctggaccccaatgatgaaaatctcatcctggagatcccagatgagaaggaggaggccaccagcaacagccccagcaaggagagcaagaaggagagcagcctgaagaagagccgcatcctgctgggcaagacaggagtcatcaaggaggagccccagcagaacatgagccagcctgaggtgaaggacccctggaacctgagcaatgatgagtactactaccccaagcagcagggcctgcggggcaccttcggcggcaacatcatccagcacagcatcccagctgtggagctgcggcagcccttcttccccacccacatgggccccatcaagctgcggcagttccaccggccccccctgaagaagtacagctttggagccctgagccagcccggcccccacagcgtgcagcccctgctgaagcacatcaagaagaaggccaagatgagggagcaggagcggcaggccagcggcggcggggagatgttcttcatgaggaccccccaggacctgaccgggaaggatggagacctgatcctggccgagtacagcgaggagaatggccccctgatgatgcaggtgggcatggccaccaagatcaagaactactacaagaggaagccaggcaaggaccccggggccccagactgcaagtatggagagaccgtgtactgccacaccagccccttcctgggcagcctgcaccctggccagctgctgcaggcctttgagaacaacctcttccgggcccccatctacctgcacaagatgcctgagacagacttcctgatcatccgcacccggcagggctactacatccgggagctggtggacatctttgtggtgggccagcagtgccccctgtttgaggtgcccggccccaacagcaagagggccaacacccacatccgggacttcctgcaggtgttcatctaccgcctcttctggaagagcaaggaccggccccggcgcatccgcatggaggacatcaagaaggccttccccagccacagcgagagcagcatcaggaagaggctgaagctgtgtgccgacttcaagaggacaggcatggacagcaactggtgggtgctgaagagtgacttccggctgcccacagaggaggagatccgggccatggtgtccccagagcagtgctgtgcctactacagcatgattgctgctgagcagaggctgaaggatgctggctatggagagaagagcttctttgcccctgaggaggagaatgaggaggacttccagatgaagattgatgatgaggtgaggacagccccctggaacaccacccgggccttcatcgccgccatgaagggcaagtgcctgctggaggtgactggagtggccgaccccaccggctgtggggagggcttctcctatgtgaagatccccaacaagcccacccagcagaaggatgacaaggagccccagcctgtgaagaagacagtgactggaacagatgctgacctgcggcggctgagcctgaagaatgccaagcagctgctgaggaagtttggagtgcctgaggaggagatcaagaagctgagccgctgggaggtgattgatgtggtgaggaccatgagcacagagcaggcccggtctggagagggccccatgagcaagtttgcccggggcagccgcttctctgtggccgagcaccaggagcgctacaaggaggagtgccagaggatctttgacctgcagaacaaggtgctgagcagcacagaggtgctgagcacagacacagacagcagcagcgcagaagattctgactttgaggagatgggcaagaacatcgagaacatgctgcagaacaagaagaccagcagccagctgagccgggagcgggaggagcaggagaggaaggagctgcagaggatgctgctggccgccggcagcgctgccagcggcaacaaccacagagatgatgacacagcctctgtgaccagcctgaacagcagcgccaccggccgctgcctgaagatctaccgcaccttcagagatgaggagggcaaggagtatgtgcgctgtgagaccgtgaggaagccagctgtgattgatgcctacgtgcgcatccgcaccaccaaggatgaggagttcatcaggaagtttgccctgtttgatgagcagcaccgggaggagatgaggaaggagcggcggcgcatccaggagcagctgcggcggctgaagaggaaccaggagaaggagaagctgaagggccccccagagaagaagcccaagaagatgaaggagaggccagacctgaagctgaagtgtggggcctgtggggccatcggccacatgaggaccaacaagttctgccccctgtactaccagaccaatgccccacccagcaaccctgtggccatgacagaggagcaggaggaggagctggagaagacagtcatccacaatgacaatgaggagctgatcaaggtggagggcaccaagatcgtgctgggcaagcagctgattgagagcgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgcgggagaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaatggacctgagagccagtacaccaagacagcccaggagatcgtgaatgtgtgctaccagaccctgacagaatatgatgagcacctgacccagctggagaaggacatctgcacagccaaggaggccgccctggaggaggccgagctggagagcctggaccccatgaccccaggcccctacaccccccagcccccagacctgtatgacaccaacaccagcctgtccatgagcagagatgcctctgtgttccaggatgagagcaacatgtctgtgctggacatccccagcgccaccccagagaagcaggtgacccagatgaggcagggccggggccgcctgggggaggaggacagtgatgtggacatcgagggctatgatgatgaggaggaggatggcaagcccaagaccccagcccctgagggggaggatggagatggagacctggctgatgaggaggagggcaccgtgcagcagccccaggcctctgtgctgtatgaggacctgctgatgtctgagggggaggatgatgaggaggatgctggcagtgatgaggagggggacaaccccttcagcgccatccagctgtctgagagcggcagtgacagtgatgtgggcagcggcggcatccggcccaagcagcccaggatgctgcaggagaacaccaggatggacatggagaatgaggagagcatgatgtcctatgaaggagatggaggagaggccagccacggcctggaggacagcaacatctcctatggcagctatgaggagccagaccccaagagcaacacccaggacaccagcttcagcagcatcggcggctatgaggtgtctgaggaggaggaggatgaggaggaggaggagcagaggagcggccccagcgtgctgagccaggtgcacctgtctgaagatgaggaggacagcgaggacttccacagcattgctggggacagcgacctggacagtgatgaatag

SEQ ID NO: 172545 - DNA, 897 bp, Artificial Sequence
  Description of Artificial Sequence: Synthetic coding sequence
atgacagaggagcaggaggaggagctggagaagacagtcatccacaatgacaatgaggagctgatcaaggtggagggcaccaagatcgtgctgggcaagcagctgattgagagcgcagatgaggtgcggaggaagagcctggtgctgaagttccccaagcagcagctgccccccaagaagaagagaagagtgggcaccaccgtgcactgtgactacctgaaccggccccacaagagcatccacagaagaagaacagaccccatggtgaccctgagcagcatcctggagagcatcatcaatgacatgagggacctgcccaacacctaccccttccacacccctgtgaatgccaaggtggtgaaggactactacaagatcatcacccggcccatggacctgcagaccctgcgggagaatgtgaggaagaggctgtaccccagccgggaggagttccgggagcacctggagctgattgtgaagaacagcgccacctacaacggccccaagcacagcctgacccagatcagccagagcatgctggacctgtgtgatgagaagctgaaggagaaggaggacaagctggcccggctggagaaggccatcaaccccctgctggatgatgatgaccaggtggccttctccttcatcctggacaacatcgtgacccagaagatgatggctgtgcctgacagctggcccttccaccaccctgtgaacaagaagtttgtgcctgactactacaaggtgattgtgaaccccatggacctggagaccatcaggaagaacatcagcaagcacaagtaccagagccgggagagcttcctggatgatgtgaacctgatcctggccaacagcgtgaagtacaacggctacatgtgcaccacctgccgcttctag

SEQ ID NO: 172546 - DNA, 657 bp, Artificial Sequence
  Description of Artificial Sequence: Synthetic coding sequence
atgagctgcagcggcagcggggctgaccctgaggccgccccagccagcgctgccagcgcccctggccctgcccctcctgtgtctgccccagctgccctgcccagcagcacagctgctgagaacaaggccagccctgctggaacagctgggggccctggggccggggctgctgctgggggcaccggccccctggccgcccgggccggggagcctgctgagaggagaggagctgcccctgtgtctgctgggggcgccgcccctcctgagggcgccatcagcaatggagtgtatgtgctgcccagcgctgccaatggagatgtgaagcctgtggtgagcagcacccccctggtggacttcctgatgcagctggaggactacacccccaccatcccagatgctgtgacaggctactacctgaacagagctggctttgaggccagtgacccccgcatcatccgcctcatcagcctggccgcccagaagttcatcagtgacatcgccaatgatgccctgcagcactgcaagatgaagggcacagccagcggcagcagccgcagcaagagcaaggacaggaagtacaccctgaccatggaggacctgaccccagccctgtctgaatatggcatcaacgtgaagaagccccactacttcacctag

SEQ ID NO: 172547 - DNA, 636 bp, Artificial Sequence
  Description of Artificial Sequence: Synthetic coding sequence
atggatgatgcccacgagagccccagcgacaagggcggggagactggagagagtgatgaaacagctgctgtgcctggggaccccggggccacagacacagatggcatccctgaggagacagatggagatgctgatgtggacctgaaggaggccgctgctgaggagggggagctggagagccaggatgtgtctgacctgaccaccgtggagcgggaggacagcagcctgctgaacccagctgccaagaagctgaagattgacaccaaggagaagaaggagaagaagcagaaggtggatgaagatgagatccagaagatgcagatcctggtgagcagcttcagcgaggagcagctgaacagatatgagatgtacagaagaagtgccttccccaaggccgccatcaagaggctcatccagagcatcaccggcacctctgtgtcccagaatgtggtgattgccatgagcggcatcagcaaggtgtttgtgggggaggtggtggaggaggccctggatgtgtgtgagaagtggggcgagatgccacccctgcagcccaagcacatgagggaggccgtgcggcggctgaagagcaagggccagatccccaacagcaagcacaagaagatcatcttcttctag

SEQ ID NO: 172548 - DNA, 465 bp, Artificial Sequence
  Description of Artificial Sequence: Synthetic coding sequence
atggatgatgcccacgagagccccagcgacaagggcggggagactggagagagtgatgaaacagctgctgtgcctggggaccccggggccacagacacagatggcatccctgaggagacagatggagatgctgatgtggacctgaaggaggccgctgctgaggagggggagctggagagccaggatgtgtctgacctgaccaccgtggagcgggaggacagcagcctgctgaacccagctgccaagaagctgaagattgacaccaaggagaagaaggagaagaagcagaaggtggatgaagatgagatccagaagatgcagatcctggtgagcagcttcagcgaggagcagctgaacagatatgagatgtacagaagaagtgccttccccaaggccgccatcaagaggcactggatgtgtgtgcgctctggagagaagtgccaccactacaaccccaacatctag

SEQ ID NO: 172549 - DNA, 486 bp, Artificial Sequence
  Description of Artificial Sequence: Synthetic coding sequence
atgaaccagtttggccccagcgccctgatcaacctgagcaacttcagcagcatcaagccagagcccgccagcaccccaccccagggctccatggccaacagcacagctgtggtgaagatccctggcacccctggggccggcggccgcctgagccctgagaacaaccaggtgctgaccaagaagaagctgcaggacctggtgcgggaggtggaccccaatgagcagctggatgaagatgtggaggagatgctgctgcagattgctgatgacttcatcgagagcgtggtgacagctgcctgccagctggcccggcacaggaagagcagcaccctggaggtgaaggatgtgcagctgcacctggagcggcagtggaacatgtggatccctggctttggaagtgaggagatccggccctacaagaaggcctgcaccacagaggcccacaagcagaggatggccctgatcaggaagaccaccaagaagtag

SEQ ID NO: 172550 - DNA, 486 bp, Artificial Sequence; identical to SEQ ID NO: 172549
  Description of Artificial Sequence: Synthetic coding sequence

SEQ ID NO: 172551 - DNA, 1779 bp, Artificial Sequence
  Description of Artificial Sequence: Synthetic coding sequence
atgtctgacagcggcagctatggccagagcggcggggagcagcagagctacagcacctacggcaaccctggcagccagggctacggccaggccagccagagctacagcggctacggccagaccacagacagcagctatggccagaactacagcggctacagcagctatggccagagccagagcggctacagccagagctatggaggctatgagaaccagaagcagagcagctacagccagcagccctacaacaaccagggccagcagcagaacatggagagcagcggcagccagggcggccgggcccccagctatgaccagcctgactatggccagcaggacagctatgaccagcagagcggctatgaccagcaccagggcagctatgatgagcagagcaactatgaccagcagcacgacagctacagccagaaccagcagagctaccacagccagcgggagaactacagccaccacacccaggatgacagaagagatgtgagccgctacggggaggacaacagaggctatggaggcagccagggcggcggccggggccggggcggctatgacaaggatggccggggccccatgacaggcagcagcggcggggacagaggaggcttcaagaactttggaggccaccgggactatggccccaggacagatgctgacagcgagagtgacaacagcgacaacaacaccatctttgtgcagggcctgggggagggcgtgtccacagaccaggtgggggagttcttcaagcagatcggcatcatcaagaccaacaagaagacaggcaagcccatgatcaacctgtacacagacaaggacaccgggaagcccaagggggaggccaccgtgtcctttgatgatcctccttctgccaaggccgccatcgactggtttgatggcaaggagttccacggcaacatcatcaaggtgtcctttgccacccggcggcctgagttcatgagaggaggcggcagcggcggcggccggcggggccggggcggctaccggggccggggcggcttccagggccggggcggggaccccaagagcggggactgggtgtgccccaaccccagctgtggcaacatgaactttgcccggaggaacagctgcaaccagtgcaatgagcccaggcctgaggacagccggcccagcggcggggacttccggggccggggctatggaggagagcggggctaccggggccggggcggccggggcggggaccggggcggctacggcggggacagaagtggcggcggctatggaggagacaggagcagcggcggcggctacagcggggacagaagtggcggcggctacggcggggacagaagtggcggcggctatggaggagaccggggcggcggctatggaggagaccggggcggcggctatggaggagaccggggcggcggctatggaggagaccggggcggctacggcggggacagaggaggcggctacggcggggacagaggaggctatggaggagaccggggcggctacggcggggacagaggaggctatggaggagaccggggcggctacggcggggacaggagcagaggaggctatggaggagaccggggcggcggcagcggctatggaggagacagaagtggcggctatggaggagacagaagtggcggcggctacggcggggacagaggaggcggctacggcggggacagaggaggctatggaggcaagatgggcggcagaaatgactacagaaatgaccagaggaaccggccctactag

SEQ ID NO: 172552 - DNA, 1779 bp, Artificial Sequence; identical to SEQ ID NO: 172551
  Description of Artificial Sequence: Synthetic coding sequence

SEQ ID NO: 172553 - DNA, 1188 bp, Artificial Sequence
  Description of Artificial Sequence: Synthetic coding sequence
atgacaggcagcagtggaggagaccggggcggcttcaagaactttggaggccaccgggactatggccccaggacagatgctgacagcgagagtgacaacagcgacaacaacaccatctttgtgcagggcctgggggagggcgtgtccacagaccaggtgggggagttcttcaagcagatcggcatcatcaagaccaacaagaagacaggcaagcccatgatcaacctgtacacagacaaggacaccgggaagcccaagggggaggccaccgtgtcctttgatgacccccccagcgccaaggccgccatcgactggtttgatggcaaggagttccacggcaacatcatcaaggtgtcctttgccaccaggaggcctgagttcatgaggggcggcggcagcggcggcggcagaagaggccggggcggctaccggggccggggcggcttccagggccggggcggggaccccaagagcggggactgggtgtgccccaaccccagctgtggcaacatgaactttgcccggaggaacagctgcaaccagtgcaatgagcccaggcctgaggacagccggcccagcggcggggacttccggggccggggctacggcggggagcggggctaccggggccggggcggccggggcggggacagaggaggctatggaggagacagaagtggcggcggctacggcggggacaggagcagcggcggcggctacagcggggacagaagtggcggcggctatggaggagacagaagtggcggcggctacggcggggacagaggaggcggctacggcggggacagaggaggcggctacggcggggacagaggaggcggctacggcggggacagaggaggctatggaggagaccggggcggcggctatggaggagaccggggcggctacggcggggacagaggaggctatggaggagaccggggcggctacggcggggacagaggaggctatggaggagacaggagccggggcggctacggcggggacagaggaggcggcagcggctacggcggggacagaagtggcggctacggcggggacagaagtggcggcggctatggaggagaccggggcggcggctatggaggagaccggggcggctacggcggcaagatgggcggcagaaatgactacagaaatgaccagaggaaccggccctactag

SEQ ID NO: 172554 - DNA, 2790 bp, Artificial Sequence
  Description of Artificial Sequence: Synthetic coding sequence
atgtgtgagagctacagccgcagcctgctgcgggtgtctgtggcccagatctgccaggccctgggctgggacagcgtgcagctgagcgcctgccacctgctgacagatgtgctgcagcgctacctgcagcagctgggccggggctgccaccgctacagcgagctgtatggccgcacagaccccatcctggatgatgtgggggaggccttccagctgatgggcgtgtccctgcacgagctggaggactacatccacaacatcgagcctgtgaccttcccccaccagatccccagcttccctgtgtccaagaacaacgtgctgcagttcccccagcccggcagcaaggatgctgaggagaggaaggagtacatcccagactacctgccccccatcgtgagcagccaggaggaggaggaggaggagcaggtgcccacagatggcggcaccagcgctgaggccatgcaggtgcccctggaggaggatgatgagctggaggaggaggagatcatcaatgatgagaacttcctgggcaagaggcccctggacagccctgaggccgaggagctgcctgccatgaagaggccccggctgctgagcaccaagggggacaccctggatgtggtgctgctggaggcccgggagcccctgagcagcatcaacacccagaagatcccccccatgctgagccctgtgcacgtgcaggacagcacagacctggccccacccagccctgagccccccatgctggcccctgtggccaagagccagatgcccacagccaagcccctggagaccaagagcttcacccccaagaccaagaccaagaccagcagccctggccagaagaccaagagccccaagacagcccagagccctgccatggtgggcagccccatccgcagccccaagacagtgtccaaggagaagaagagccctggccgcagcaagagccccaagagccccaagagccccaaggtgaccacccacatcccccagacccctgtgcggcctgagacccccaacagaacaccttctgccaccctgtctgagaagatcagcaaggagaccatccaggtgaagcagatccagaccccaccagatgctgggaagctgaacagcgagaaccagcccaagaaggctgtggtggccgacaagaccatcgaggccagcattgatgctgtgattgcccgggcctgtgccgagcgggagccagacccctttgagttcagcagcggcagcgagagcgagggggacatcttcaccagccccaagaggatcagcggccctgagtgcaccacccccaaggccagcaccagcgccaacaacttcaccaagagcggcagcacccccctgcccctgagcggcggcaccagcagcagtgacaacagctggaccatggatgccagcattgatgaggtggtgaggaaggccaagctgggcacccccagcaacatgccacccaacttcccctacatcagcagccccagcgtgtccccacccaccccagagcccctgcacaaggtgtatgaggagaagaccaagctgcccagctctgtggaggtgaagaagaagctgaagaaggagctgaagaccaagatgaagaagaaggagaagcagagggaccgggagcgggagaaggacaagaacaaggacaagagcaaggagaaggacaaggtgaaggagaaggagaaggacaaggagaccggccgggagaccaagtacccctggaaggagttcctgaaggaggaggaggccgacccctacaagttcaagatcaaggagtttgaagatgtggaccccaaggtgaagctgaaggatggcctggtgaggaaggagaaggagaagcacaaggacaagaagaaggaccgggagaagggcaagaaggacaaggacaagcgggagaaggagaaggtgaaggacaagggccgggaggacaagatgaaggccccagccccacccctggtgctgccccccaaggagctggccctgcccctcttcagccctgccacagccagccgggtgcctgccatgctgcccagcctgctgcctgtgctgcctgagaagctgtttgaggagaaggagaaggtgaaggagaaggagaagaagaaggacaagaaggagaagaagaagaagaaggagaaggagaaggagaagaaggagaaggagcgggagaaggagaagcgggagcgggagaagcgggagaaggagaaggagaagcacaagcatgagaagatcaaggtggagcctgtggccctggcccccagccctgtgatcccccggctgaccctgcgggtgggcgccggccaggacaagatcgtcatcagcaaggtggtgcctgcccctgaggccaagccagcccccagccagaaccggcccaagaccccacctccagccccagccccagcccctggccccatgctggtgtccccagcccctgtgcccctgcccctgctggcccaggccgctgctggccctgccctgctgcccagccctggccctgctgccagcggggccagcgccaaggcccctgtgcgctctgtggtgacagaaacagtgtccacctacgtgatcagagatgagtggggcaaccagatctggatctgccccggctgcaacaagccagatgatggcagccccatgattggctgtgatgactgtgatgactggtaccactggccctgtgtgggcatcatgacagcccctcctgaggagatgcagtggttctgccccaagtgtgccaacaagaagaaggacaagaagcacaagaagaggaagcaccgggcccactag

SEQ ID NO: 172555 - DNA, 852 bp, Artificial Sequence
  Description of Artificial Sequence: Synthetic coding sequence
atgtgtgagagctacagccgcagcctgctgcgggtgtctgtggcccagatctgccaggccctgggctgggacagcgtgcagctgagcgcctgccacctgctgacagatgtgctgcagcgctacctgcagcagctgggccggggctgccaccgctacagcgagctgtatggccgcacagaccccatcctggatgatgtgggggaggccttccagctgatgggcgtgtccctgcacgagctggaggactacatccacaacatcgagcctgtgaccttcccccaccagatccccagcttccctgtgtccaagaacaacgtgctgcagttcccccagcccggcagcaaggatgctgaggagaggaaggagtacatcccagactacctgccccccatcgtgagcagccaggaggaggaggaggaggagcaggtgcccacagatggcggcaccagcgctgaggccatgcaggtgcccctggaggaggatgatgagctggaggaggaggagatcatcaatgatgagaacttcctgggcaagaggcccctggacagccctgaggccgaggagctgcctgccatgaagaggccccggctgctgagcaccaagggggacaccctggatgtggtgctgctggaggcccgggagcccctgagcagcatcaacacccagaagatcccccccatgctgagccctgtgcacgtgcaggacagcacagacctggccccacccagccctgagccccccatgctggcccctgtggccaagagccagatgcccacagccaagcccctggagaccaagagcttcacccccaagaccaagaccaagaagaagaagaagaagaagaagagctag

SEQ ID NO: 172556 - DNA, 3258 bp, Artificial Sequence
  Description of Artificial Sequence: Synthetic coding sequence
atggctgctggcagtgacctgctggatgaggtgttcttcaacagcgaggtggatgagaaggtggtgtctgacctggtgggcagcctggagagccagctggccgccagcgctgcccaccaccaccacctggcccccaggaccccagaggtgcgggctgctgctgctggggccctgggcaaccacgtggtgtctggcagccctgctggagctgctggagctggccctgctgccccagctgagggcgcccctggagctgcccctgagcccccacctgctggccgggcccggcctgggggcggcggcccccagaggcctggcccccccagcccccggcggcccctggtgcctgctggccctgcccctcctgctgccaagctgcggcccccacctgagggcagcgctggcagctgtgcccctgtgcctgctgctgctgctgtggccgccggccctgagcccgccccagctggccctgccaagccagctggccctgctgccctggccgcccgggccggccctggccctggccctggccctggccctggccctggccctggccctgggaagccagctggccctggggccgcccagaccctgaatggatctgctgccctgctgaacagccaccacgccgccgccccagctgtgtccctggtgaacaacggccctgctgccctgctgcccctgcccaagccagctgcccctggcaccgtcatccagaccccaccatttgtgggcgctgctgcccccccagccccagctgcccccagccccccagctgccccagccccagctgccccagctgctgcccctcctcctcctcctccagccccagccaccctggcccggcccccaggccaccctgctggccccccaacagctgccccagctgtgcccccacctgctgctgcccagaatggaggcagcgctggagctgccccagccccagccccagctgctgggggccctgctggggtgtctggccagcccggccctggagctgctgctgctgccccagcccctggggtgaaggccgagagccccaagagggtggtgcaggccgcccctcctgctgcccagaccctggccgccagcggccctgccagcacagctgcctccatggtgattggccccaccatgcagggcgccctgcccagccctgctgctgtgcccccaccagcccctggcacccccaccggcctgcccaagggagctgctggagctgtgacccagagcctgagcaggacccccacagccaccaccagcggcatccgggccaccctgacccccaccgtgctggccccccggctgccccagcccccccagaaccccaccaacatccagaacttccagctgcccccaggcatggtgctggtgcgctcagaaaatggccagctgctgatgatcccccagcaggccctggcccagatgcaggcccaggcccacgcccagccccagaccaccatggcccccaggcctgccacccccaccagcgcccctcctgtgcagatcagcacagtgcaggcccctggcacccccatcatcgcccggcaggtgacccccaccaccatcatcaagcaggtgtcccaggcccagaccaccgtgcagcccagcgccaccctgcagaggagccctggggtgcagccccagctggtgctgggcggggccgcccagacagccagcctgggcacagccacagctgtgcagacaggcaccccccagaggacagtgcctggggccaccaccaccagcagcgctgccacagagaccatggagaatgtgaagaagtgcaagaacttcctgagcaccctcatcaagctggccagcagcggcaagcagagcacagaaacagctgccaacgtgaaggagctggtgcagaacctgctggatggcaagattgaagctgaggacttcaccagccggctgtaccgggagctgaacagcagcccccagccctacctggtgcccttcctgaagaggagcctgcctgccctgcggcagctgaccccagattctgctgccttcatccagcagagccagcagcagcccccaccacccaccagccaggccaccacagccctgacagctgtggtgctgagcagctctgtgcagaggacagctgggaagacagctgccaccgtgaccagcgccctgcagccccctgtgctgagcctgacccagcccacccaggtgggcgtgggcaagcagggccagcccacccccctggtgatccagcagccccccaagccaggggccctgatccggcccccccaggtgaccctgacccagacccccatggtggccctgcggcagccccacaaccgcatcatgctgaccaccccccagcagatccagctgaaccccctgcagcctgtgcctgtggtgaagccagctgtgctgcccggcaccaaggccctgtctgctgtgtctgcccaggccgccgccgcccagaagaacaagctgaaggagcccggcggcggcagcttcagagatgatgatgacatcaatgatgtggcctccatggccggcgtgaacctgtctgaggagagcgcccgcatcctggccaccaacagcgagctggtgggcaccctgaccaggagctgcaaggatgagaccttcctgctgcaggcccccctgcagaggcgcatcctggagatcggcaagaagcacggcatcacagagctgcacccagatgtggtgtcctatgtgagccacgccacccagcagaggctgcagaacctggtggagaagatcagcgagacagcccagcagaagaacttctcctacaaggatgatgacagatatgagcaggccagtgatgtgcgggcccagctgaagttctttgagcagctggaccagatcgagaagcagaggaaggatgagcaggagcgggagatcctgatgagagctgccaagagccgcagccggcaggaggaccctgagcagctgcggctgaagcagaaggccaaggagatgcagcagcaggagctggcccagatgaggcagagagatgccaacctgacagccctggccgccatcggccccaggaagaagaggaaggtggactgccccggccctggcagcggggctgagggcagcggccctggctctgtggtgcccggcagcagcggcgtgggcaccccccggcagttcacccggcagaggatcaccagggtgaacctgcgggacctgatcttctgcctggagaatgaaagagagaccagccacagcctgctgctgtacaaggccttcctgaagtag

SEQ ID NO: 172557 - DNA, 2850 bp, Artificial Sequence
  Description of Artificial Sequence: Synthetic coding sequence
ggccggggcctgctgcagcagagaggaggccgggagagcggccctgcccctcctgctgccaagctgcggcccccacctgagggcagcgctggcagctgtgcccctgtgcctgctgctgctgctgtggccgccggccctgagcccgccccagctggccctgccaagccagctggccctgctgccctggccgcccgggccggccctggccctggccctggccctggccctggccctggccctggccctgggaagccagctggccctggggccgcccagaccctgaatggatctgctgccctgctgaacagccaccacgccgccgccccagctgtgtccctggtgaacaacggccctgctgccctgctgcccctgcccaagccagctgccccagctgctgcccctcctcctcctcctccagccccagccaccctggcccggcccccaggccaccctgctggccccccaacagctgccccagctgtgcccccacctgctgctgcccagaatggaggcagcgctggagctgccccagccccagccccagctgctgggggccctgctggggtgtctggccagcccggccctggagctgctgctgctgccccagcccctggggtgaaggccgagagccccaagagggtggtgcaggccgcccctcctgctgcccagaccctggccgccagcggccctgccagcacagctgcctccatggtgattggccccaccatgcagggcgccctgcccagccctgctgctgtgcccccaccagcccctggcacccccaccggcctgcccaagggagctgctggagctgtgacccagagcctgagcaggacccccacagccaccaccagcggcatccgggccaccctgacccccaccgtgctggccccccggctgccccagcccccccagaaccccaccaacatccagaacttccagctgcccccaggcatggtgctggtgcgctcagaaaatggccagctgctgatgatcccccagcaggccctggcccagatgcaggcccaggcccacgcccagccccagaccaccatggcccccaggcctgccacccccaccagcgcccctcctgtgcagatcagcacagtgcaggcccctggcacccccatcatcgcccggcaggtgacccccaccaccatcatcaagcaggtgtcccaggcccagaccaccgtgcagcccagcgccaccctgcagaggagccctggggtgcagccccagctggtgctgggcggggccgcccagacagccagcctgggcacagccacagctgtgcagacaggcaccccccagaggacagtgcctggggccaccaccaccagcagcgctgccacagagaccatggagaatgtgaagaagtgcaagaacttcctgagcaccctcatcaagctggccagcagcggcaagcagagcacagaaacagctgccaacgtgaaggagctggtgcagaacctgctggatggcaagattgaagctgaggacttcaccagccggctgtaccgggagctgaacagcagcccccagccctacctggtgcccttcctgaagaggagcctgcctgccctgcggcagctgaccccagattctgctgccttcatccagcagagccagcagcagcccccaccacccaccagccaggccaccacagccctgacagctgtggtgctgagcagctctgtgcagaggacagctgggaagacagctgccaccgtgaccagcgccctgcagccccctgtgctgagcctgacccagcccacccaggtgggcgtgggcaagcagggccagcccacccccctggtgatccagcagccccccaagccaggggccctgatccggcccccccaggtgaccctgacccagacccccatggtggccctgcggcagccccacaaccgcatcatgctgaccaccccccagcagatccagctgaaccccctgcagcctgtgcctgtggtgaagccagctgtgctgcccggcaccaaggccctgtctgctgtgtctgcccaggccgccgccgcccagaagaacaagctgaaggagcccggcggcggcagcttcagagatgatgatgacatcaatgatgtggcctccatggccggcgtgaacctgtctgaggagagcgcccgcatcctggccaccaacagcgagctggtgggcaccctgaccaggagctgcaaggatgagaccttcctgctgcaggcccccctgcagaggcgcatcctggagatcggcaagaagcacggcatcacagagctgcacccagatgtggtgtcctatgtgagccacgccacccagcagaggctgcagaacctggtggagaagatcagcgagacagcccagcagaagaacttctcctacaaggatgatgacagatatgagcaggccagtgatgtgcgggcccagctgaagttctttgagcagctggaccagatcgagaagcagaggaaggatgagcaggagcgggagatcctgatgagagctgccaagagccgcagccggcaggaggaccctgagcagctgcggctgaagcagaaggccaaggagatgcagcagcaggagctggcccagatgaggcagagagatgccaacctgacagccctggccgccatcggccccaggaagaagaggaaggtggactgccccggccctggcagcggggctgagggcagcggccctggctctgtggtgcccggcagcagcggcgtgggcaccccccggcagttcacccggcagaggatcaccagggtgaacctgcgggacctgatcttctgcctggagaatgaaagagagaccagccacagcctgctgctgtacaaggccttcctgaagtag

SEQ ID NO: 172558 - DNA, 2589 bp, Artificial Sequence
  Description of Artificial Sequence: Synthetic coding sequence
atgcctgctggcctgacagagcctgctggagctgcccctcctgctgctgtgtctgccagcggcaccgtgaccatggccccagctggggccctgcctgtgcgggtggagagcacccctgtggccctgggcgctgtgaccaaggcccctgtgtctgtgtgtgtggagcccacagccagccagcccctgcggagccctgtgggcaccctggtgaccaaggtggcccctgtgtctgccccacccaaggtgagcagcggcccccggctgcctgccccccagatcgtggccgtgaaggcccccaacaccaccaccatccagtttcctgccaacctgcagctgcccccaggcaccgtgctgatcaagagcaacagcggccccctgatgctggtgagcccccagcagacagtgaccagggctgagaccaccagcaacatcaccagcaggcctgctgtgcctgccaacccccagacagtgaagatctgcaccgtgcccaacagcagcagccagctgatcaagaaggtggccgtgacccctgtgaagaagctggcccagatcggcaccaccgtggtgaccaccgtgcccaagcccagctctgtgcagagcgtggccgtgcccacctctgtggtgacagtgacccctgggaagcccctgaacacagtgaccaccctgaagcccagcagcctgggcgccagcagcacccccagcaatgagcccaacctgaaggccgagaacagcgctgctgtgcagatcaacctgagccccaccatgctggagaatgtgaagaagtgcaagaacttcctggccatgctgatcaagctggcctgcagcggcagccagagccctgagatgggccagaatgtgaagaagctggtggagcagctgctggatgccaagattgaggccgaggagttcaccaggaagctgtatgtggagctgaagagcagcccccagccccacctggtgcccttcctgaagaagtctgtggtggccctgcggcagctgctgcccaacagccagagcttcatccagcagtgtgtgcagcagaccagcagtgacatggtgattgccacctgcaccaccaccgtgaccaccagccctgtggtgaccaccaccgtgagcagcagccagagcgagaagagcatcatcgtgtctggggccacagcccccaggacagtgtctgtgcagaccctgaaccccctggccggccctgtgggcgccaaggccggcgtggtgaccctgcacagcgtgggccccacagctgccactggaggcaccacagctggcaccggcctgctgcagaccagcaagcccctggtgacctctgtggccaacacagtgaccaccgtgtccctgcagcctgagaagcctgtggtgtctggaacagctgtgaccctgagcctgcctgctgtgacctttggagagaccagcggggccgccatctgcctgcccagcgtgaagcctgtggtgagcagcgctggcaccaccagtgacaagcctgtgattggcacccctgtgcagatcaagctggcccagcccggccctgtgctgagccagcctgctggcatcccccaggccgtgcaggtgaagcagctggtggtgcagcagcccagcggcggcaatgagaagcaggtgaccaccatcagccacagcagcaccctgaccatccagaagtgtggccagaagaccatgcctgtgaacaccatcatccccaccagccagttccccccagccagcatcctgaagcagatcaccctgcccggcaacaagatcctgagcctgcaggccagccccacccagaagaaccgcatcaaggaaaatgtgaccagctgcttcagagatgaagatgacatcaatgatgtgacctccatggccggcgtgaacctgaatgaggagaatgcctgcatcctggccaccaacagcgagctggtgggcaccctcatccagagctgcaaggatgagcccttcctgttcatcggggccctgcagaagaggatcctggacatcggcaagaagcatgacatcacagagctgaacagtgatgctgtgaacctgatcagccaggccacccaggagcggctgcggggcctgctggagaagctgacagccatcgcccagcacaggatgaccacctacaaggccagcgagaactacatcctgtgcagcgacaccaggagccagctgaagttcctggagaagctggaccagctggagaagcagaggaaggacctggaggagcgggagatgctgctgaaggccgccaagagccgcagcaacaaggaggaccctgagcagctgcggctgaagcagaaggccaaggagctgcagcagctggagctggcccagatccagcacagagatgccaacctgacagccctggccgccatcggccccaggaagaagaggcccctggagagcggcatcgagggcctgaaggacaacctgctggccagcggcaccagcagcctgacagccaccaagcagctgcaccggccccgcatcacccgcatctgcctgcgggacctgatcttctgcatggagcaggagcgggagatgaagtacagccgggccctgtacctggccctgctgaagtag

SEQ ID NO: 172559 - DNA, 1857 bp, Artificial Sequence
  Description of Artificial Sequence: Synthetic coding sequence
atgcctgctggcctgacagagcctgctggagctgcccctcctgctgctgtgtctgccagcggcaccgtgaccatggccccagctggggccctgcctgtgcgggtggagagcacccctgtggccctgggcgctgtgaccaaggcccctgtgtctgtgtgtgtggagcccacagccagccagcccctgcggagccctgtgggcaccctggtgaccaaggtggcccctgtgtctgccccacccaaggtgagcagcggcccccggctgcctgccccccagatcgtggccgtgaaggcccccaacaccaccaccatccagtttcctgccaacctgcagctgcccccaggcaccgtgctgatcaagagcaacagcggccccctgatgctggtgagcccccagcagacagtgaccagggctgagaccaccagcaacatcaccagcaggcctgctgtgcctgccaacccccagacagtgaagatctgcaccgtgcccaacagcagcagccagctgatcaagaaggtggccgtgacccctgtgaagaagctggcccagatcggcaccaccgtggtgaccaccgtgcccaagcccagctctgtgcagagcgtggccgtgcccacctctgtggtgacagtgacccctgggaagcccctgaacacagtgaccaccctgaagcccagcagcctgggcgccagcagcacccccagcaatgagcccaacctgaaggccgagaacagcgctgctgtgcagatcaacctgagccccaccatgctggagaatgtgaagaagtgcaagaacttcctggccatgctgatcaagctggcctgcagcggcagccagagccctgagatgggccagaatgtgaagaagctggtggagcagctgctggatgccaagattgaggccgaggagttcaccaggaagctgtatgtggagctgaagagcagcccccagccccacctggtgcccttcctgaagaagtctgtggtggccctgcggcagctgctgcccaacagccagagcttcatccagcagtgtgtgcagcagaccagcagtgacatggtgattgccacctgcaccaccaccgtgaccaccagccctgtggtgaccaccaccgtgagcagcagccagagcgagaagagcatcatcgtgtctggggccacagcccccaggacagtgtctgtgcagaccctgaaccccctggccggccctgtgggcgccaaggccggcgtggtgaccctgcacagcgtgggccccacagctgccactggaggcaccacagctggcaccggcctgctgcagaccagcaagcccctggtgacctctgtggccaacacagtgaccaccgtgtccctgcagcctgagaagcctgtggtgtctggaacagctgtgaccctgagcctgcctgctgtgacctttggagagaccagcggggccgccatctgcctgcccagcgtgaagcctgtggtgagcagcgctggcaccaccagtgacaagcctgtgattggcacccctgtgcagatcaagctggcccagcccggccctgtgctgagccagcctgctggcatcccccaggccgtgcaggtgaagcagctggtggtgcagcagcccagcggcggcaatgagaagcaggtgaccaccatcagccacagcagcaccctgaccatccagaagtgtggccagaagaccatgcctgtgaacaccatcatccccaccagccagttccccccagccagcatcctgaagcagatcaccctgcccggcaacaagatcctgagcctgcaggccagccccacccagaagaaccgcatcaaggaaaatgtgaccagctgcttccgcagcaccttcatctgtgtgtactag

SEQ ID NO: 172560 - DNA, 2598 bp, Artificial Sequence
  Description of Artificial Sequence: Synthetic coding sequence
atgcctgctggcctgacagagcctgctggagctgcccctcctgctgctgtgtctgccagcggcaccgtgaccatggccccagctggggccctgcctgtgcgggtggagagcacccctgtggccctgggcgctgtgaccaaggcccctgtgtctgtgtgtgtggagcccacagccagccagcccctgcggagccctgtgggcaccctggtgaccaaggtggcccctgtgtctgccccacccaaggtgagcagcggcccccggctgcctgccccccagatcgtggccgtgaaggcccccaacaccaccaccatccagtttcctgccaacctgcagctgcccccaggcaccgtgctgatcaagagcaacagcggccccctgatgctggtgagcccccagcagacagtgaccagggctgagaccaccagcaacatcaccagcaggcctgctgtgcctgccaacccccagacagtgaagatctgcaccgtgcccaacagcagcagccagctgatcaagaaggtggccgtgacccctgtgaagaagctggcccagatcggcaccaccgtggtgaccaccgtgcccaagcccagctctgtgcagagcgtggccgtgcccacctctgtggtgacagtgacccctgggaagcccctgaacacagtgaccaccctgaagcccagcagcctgggcgccagcagcacccccagcaatgagcccaacctgaaggccgagaacagcgctgctgtgcagatcaacctgagccccaccatgctggagaatgtgaagaagtgcaagaacttcctggccatgctgatcaagctggcctgcagcggcagccagagccctgagatgggccagaatgtgaagaagctggtggagcagctgctggatgccaagattgaggccgaggagttcaccaggaagctgtatgtggagctgaagagcagcccccagccccacctggtgcccttcctgaagaagtctgtggtggccctgcggcagctgctgcccaacagccagagcttcatccagcagtgtgtgcagcagaccagcagtgacatggtgattgccacctgcaccaccaccgtgaccaccagccctgtggtgaccaccaccgtgagcagcagccagagcgagaagagcatcatcgtgtctggggccacagcccccaggacagtgtctgtgcagaccctgaaccccctggccggccctgtgggcgccaaggccggcgtggtgaccctgcacagcgtgggccccacagctgccactggaggcaccacagctggcaccggcctgctgcagaccagcaagcccctggtgacctctgtggccaacacagtgaccaccgtgtccctgcagcctgagaagcctgtggtgtctggaacagctgtgaccctgagcctgcctgctgtgacctttggagagaccagcggggccgccatctgcctgcccagcgtgaagcctgtggtgttctgctgggaccacatcaagcctgtgattggcacccctgtgcagatcaagctggcccagcccggccctgtgctgagccagcctgctggcatcccccaggccgtgcaggtgaagcagctgttcagcctcttccaggtggtgcagcagcccagcggcggcaatgagaagcaggtgaccaccatcagccacagcagcaccctgaccatccagaagtgtggccagaagaccatgcctgtgaacaccatcatccccaccagccagtttcctccagccagcatcctgaagcagatcaccctgcccggcaacaagatcctgagcctgcaggccagccccacccagaagaaccgcatcaaggaaaatgtgaccagctgcttcagagatgaagatgacatcaatgatgtgacctccatggccggcgtgaacctgaatgaagaaaatgcctgcatcctggccaccaacagcgagctggtgggcaccctcatccagagctgcaaggatgagcccttcctgttcatcggggccctgcagaagaggatcctggacatcggcaagaagcatgacatcacagagctgaacagtgatgctgtgaacctgatcagccaggccacccaggagcggctgcggggcctgctggagaagctgacagccatcgcccagcacaggatgaccacctacaaggccagcgagaactacatcctgtgcagcgacaccaggagccagctgaagttcctggagaagctggaccagctggagaagcagaggaaggacctggaggagcgggagatgctgctgaaggccgccaagagccgcagcaacaaggaggaccctgagcagctgcggctgaagcagaaggccaaggagctgcagcagctggagctggcccagatccagcacagagatgccaacctgacagccctggccgccatcggccccaggaagaagaggcccctggagagcggcatcgagggcctgaaggacaacctgctggccagcggcaccagcagcctgacagccaccaagcagctgcaccggccccgcatcacccgcatctgcctgcgggacctgatcttctgcatggagcaggagcgggagatgaagtacagccgggccctgtacctggccctgctgaagtag

SEQ ID NO: 172561 - DNA, 2238 bp, Artificial Sequence
  Description of Artificial Sequence: Synthetic coding sequence
atggccgccctggccgaggagcagacagaggtggccgtgaagctggagcctgagggcccccccaccctgctgcccccccaggccggagatggagctggggagggcagcggcggcaccaccaacaacggccccaatggaggcggcggcaatgtggccgccagcagcagcactggaggagatggcggcacccccaagcccaccgtggccgtgtctgctgctgccccagctggggccgcccctgtgcctgctgctgccccagatgctggggcccctcatgaccggcagaccctgctggccgtgctgcagttcctgcggcagagcaagctgcgggaggccgaggaggccctgcggcgggaggccggcctgctggaggaggccgtggccggcagcggggcccctggagaggtggacagcgctggagctgaggtgaccagcgccctgctgagccgggtgacagccagcgcccctggccctgctgccccagaccccccaggcaccggggccagcggggccaccgtggtgtctggcagcgccagcggccctgctgcccctgggaaggtgggctctgtggccgtggaggaccagccagatgtgtctgctgtgctgagcgcctacaaccagcagggcgaccccaccatgtatgaggagtactacagcggcctgaagcacttcatcgagtgcagcctggactgccacagagctgagctgagccagctgttctaccccctgtttgtgcacatgtacctggagctggtgtacaaccagcatgaaaatgaggccaagagcttctttgagaagttccacggggaccaggagtgctactaccaggatgacctgcgggtgctgagcagcctgaccaagaaggagcacatgaagggaaatgagaccatgctggacttccgcaccagcaagtttgtgctgcgcatcagccgggacagctaccagctgctgaagaggcacctgcaggagaagcagaacaaccagatctggaacatcgtgcaggagcacctgtacatcgacatctttgatggcatgcccaggagcaagcagcagattgatgccatggtgggcagcctggccggggaggccaagcgggaggccaacaagagcaaggtgttcttcggcctgctgaaggagcctgagattgaggtgcccctggatgatgaagatgaggagggggagaatgaggagggcaagcccaagaagaagaagcccaagaaggacagcatcggcagcaagagcaagaagcaggaccccaatgccccaccccagaaccgcatccccctgcctgagctgaaggacagcgacaagctggacaagatcatgaacatgaaggagaccaccaagagggtgcggctgggccctgactgcctgcccagcatctgcttctacaccttcctgaatgcctaccagggcctgacagctgtggatgtgacagatgacagcagcctgattgctgggggctttgctgacagcacagtgcgggtgtggagcgtgacccccaagaagctgcggtctgtgaagcaggccagtgacctgagcctgattgacaaggagagtgatgatgtgctggagcgcatcatggatgagaagacagccagcgagctgaagatcctgtatggccacagcggccctgtgtatggagccagcttctccccagaccggctgtgggccacagaccactaccagcccctgcgcatctttgctggccacctggctgatgtgaactgcacccgcttccaccccaacagcaactacgtggccactggatctgctgacagaacagtgcggctgtgggatgtgctgaatggaaactgtgtgcgcatcttcaccggccacaagggccccatccacagcctgaccttcagccccaacggccgcttcctggccactggagccacagatggccgggtgctgctgtgggacattggacatggcctgatggtgggggagctgaagggccacacagacacagtgtgcagcctgcgcttcagcagagatggagagatcctggccagcggctccatggacaacacagtgcggctgtgggatgccatcaaggcctttgaggacctggagacagatgacttcaccacagccaccggccacatcaacctgcctgagaacagccaggagctgctgctgggcacctacatgaccaagagcacccctgtggtgcacctgcacttcaccaggaggaacctggtgctggccgccggggcctacagcccccagtag

SEQ ID NO: 172562 - DNA, 2403 bp, Artificial Sequence
  Description of Artificial Sequence: Synthetic coding sequence
atggccgccctggccgaggagcagacagaggtggccgtgaagctggagcctgagggcccccccaccctgctgcccccccaggccggagatggagctggggagggcagcggcggcaccaccaacaacggccccaatggaggcggcggcaatgtggccgccagcagcagcactggaggagatggcggcacccccaagcccaccgtggccgtgtctgctgctgccccagctggggccgcccctgtgcctgctgctgccccagatgctggggcccctcatgaccggcagaccctgctggccgtgctgcagttcctgcggcagagcaagctgcgggaggccgaggaggccctgcggcgggaggccggcctgctggaggaggccgtggccggcagcggggcccctggagaggtggacagcgctggagctgaggtgaccagcgccctgctgagccgggtgacagccagcgcccctggccctgctgccccagaccccccaggcaccggggccagcggggccaccgtggtgtctggcagcgccagcggccctgctgcccctgggaaggtgggctctgtggccgtggaggaccagccagatgtgtctgctgtgctgagcgcctacaaccagcagggcgaccccaccatgtatgaggagtactacagcggcctgaagcacttcatcgagtgcagcctggactgccacagagctgagctgagccagctgttctaccccctgtttgtgcacatgtacctggagctggtgtacaaccagcatgaaaatgaggccaagagcttctttgagaagttccacggggaccaggagtgctactaccaggatgacctgcgggtgctgagcagcctgaccaagaaggagcacatgaagggaaatgagaccatgctggacttccgcaccagcaagtttgtgctgcgcatcagccgggacagctaccagctgctgaagaggcacctgcaggagaagcagaacaaccagatctggaacatcgtgcaggagcacctgtacatcgacatctttgatggcatgcccaggagcaagcagcagattgatgccatggtgggcagcctggccggggaggccaagcgggaggccaacaagagcaaggtgttcttcggcctgctgaaggagcctgagattgaggtgcccctggatgatgaagatgaggagggggagaatgaggagggcaagcccaagaagaagaagcccaagaaggacagcatcggcagcaagagcaagaagcaggaccccaatgccccaccccagaaccgcatccccctgcctgagctgaaggacagcgacaagctggacaagatcatgaacatgaaggagaccaccaagagggtgcggctgggccctgactgcctgcccagcatctgcttctacaccttcctgaatgcctaccagggcctgacagctgtggatgtgacagatgacagcagcctgattgctgggggctttgctgacagcacagtgcgggtgtggagcgtgacccccaagaagctgcggtctgtgaagcaggccagtgacctgagcctgattgacaaggagagtgatgatgtgctggagcgcatcatggatgagaagacagccagcgagctgaagatcctgtatggccacagcggccctgtgtatggagccagcttctccccagacaggaactacctgctgagcagcagtgaagatggcaccgtgcggctgtggagcctgcagaccttcacctgcctggtgggctacaagggccacaactaccctgtgtgggacacccagttcagcccctacggctactactttgtgtctgggggccatgacagagtggcccggctgtgggccacagaccactaccagcccctgcgcatctttgctggccacctggctgatgtgaactgcacccgcttccaccccaacagcaactacgtggccaccggcagcgctgacagaacagtgcggctgtgggatgtgctgaatggaaactgtgtgcgcatcttcaccggccacaagggccccatccacagcctgaccttcagccccaacggccgcttcctggccaccggggccacagatggccgggtgctgctgtgggacatcggccacggcctgatggtgggggagctgaagggccacacagacacagtgtgcagcctgcgcttcagcagagatggagagatcctggccagcggctccatggacaacacagtgcggctgtgggatgccatcaaggcctttgaggacctggagacagatgacttcaccacagccaccggccacatcaacctgcctgagaacagccaggagctgctgctgggcacctacatgaccaagagcacccctgtggtgcacctgcacttcaccaggaggaacctggtgctggccgccggggcctacagcccccagtag

SEQ ID NO: 172563 - DNA, 2034 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccactggctgagcattgagggctgccagcctgccatcccagaaaatcctcctccagcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagaccccggcctgtaccagatgctgccccgcttcagcaccttcatcagcgagggcgtgcgggtgaatgtggtgcagaacaacctggccctgctgatctacctgatgaggatggtgaaggccctgatggacaaccccaccctgtacctggagaagtatgtgcatgagctgatcccagctgtgatgacctgcatcgtgtcccggcagctgtgcctgcggccagatgtggacaaccactgggccctgcgggactttgctgcccggctggtggcccagatctgcaagcacttcagcaccaccaccaacaacatccagagccgcatcaccaagaccttcaccaagtcctgggtggatgagaagaccccctggaccaccaggtatggcagcattgctggcctggccgagctgggccatgatgtgatcaagaccctcatcctgccccggctgcagcaggagggggagcgcatccgctctgtgctggatggccctgtgctgagcaacatcgaccgcatcggggctgaccacgtgcagagcctgctgctgaagcactgtgcccctgtgctggccaagctgcggcccccaccagacaaccaggatgcctacagagctgagtttggcagcctgggccccctgctgtgcagccaggtggtgaaggcccgggcccaggccgccctgcaggcccagcaggtgaacagaaccaccctgaccatcacccagccccggcccaccctgaccctgagccaggccccccagcccggccccaggaccccaggcctgctgaaggtgcccggcagcatcgccctgcctgtgcagaccctggtgtctgcccgggccgccgccccaccccagcccagccccccacccaccaagttcatcgtgatgagcagcagcagcagcgcccccagcacccagcaggtgctgagcctgagcaccagcgcccctggcagcggcagcaccaccaccagccctgtgaccaccaccgtgcccagcgtgcagcccatcgtgaagctggtgtccacagccaccacagccccacccagcacagcccccagcggccctggctctgtgcagaagtacatcgtggtgtccctgccccccaccggggagggcaagggcggccccaccagccaccccagccctgtgcccccaccagccagcagccccagccccctgagcggcagcgccctgtgtggcggcaagcaggaggccggggacagccccccaccagcccctggcacccccaaggccaacggcagccagcccaacagcggcagcccccagcctgccccctag

SEQ ID NO: 172564 - DNA, 231 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagtag

SEQ ID NO: 172565 - DNA, 1806 bp, Artificial Sequence
  Description of Artificial Sequence: Synthetic coding sequence
atgcacatgggcaagaggcagaagctgaccaccagtgacatcgactatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagaccccggcctgtaccagatgctgccccgcttcagcaccttcatcagcgagggcgtgcgggtgaatgtggtgcagaacaacctggccctgctgatctacctgatgaggatggtgaaggccctgatggacaaccccaccctgtacctggagaagtatgtgcatgagctgatcccagctgtgatgacctgcatcgtgtcccggcagctgtgcctgcggccagatgtggacaaccactgggccctgcgggactttgctgcccggctggtggcccagatctgcaagcacttcagcaccaccaccaacaacatccagagccgcatcaccaagaccttcaccaagtcctgggtggatgagaagaccccctggaccaccaggtatggcagcattgctggcctggccgagctgggccatgatgtgatcaagaccctcatcctgccccggctgcagcaggagggggagcgcatccgctctgtgctggatggccctgtgctgagcaacatcgaccgcatcggggctgaccacgtgcagagcctgctgctgaagcactgtgcccctgtgctggccaagctgcggcccccaccagacaaccaggatgcctacagagctgagtttggcagcctgggccccctgctgtgcagccaggtggtgaaggcccgggcccaggccgccctgcaggcccagcaggtgaacagaaccaccctgaccatcacccagccccggcccaccctgaccctgagccaggccccccagcccggccccaggaccccaggcctgctgaaggtgcccggcagcatcgccctgcctgtgcagaccctggtgtctgcccgggccgccgccccaccccagcccagccccccacccaccaagttcatcgtgatgagcagcagcagcagcgcccccagcacccagcaggtgctgagcctgagcaccagcgcccctggcagcggcagcaccaccaccagccctgtgaccaccaccgtgcccagcgtgcagcccatcgtgaagctggtgtccacagccaccacagccccacccagcacagcccccagcggccctggctctgtgcagaagtacatcgtggtgtccctgccccccaccggggagggcaagggcggccccaccagccaccccagccctgtgcccccaccagccagcagccccagccccctgagcggcagcgccctgtgtggcggcaagcaggaggccggggacagccccccaccagcccctggcacccccaaggccaacggcagccagcccaacagcggcagcccccagcctgccccctag

SEQ ID NO: 172566 - DNA, 45 bp, Artificial Sequence
  Description of Artificial Sequence: Synthetic coding sequence
atggccgaggagaagaagctgaagctgagcaacacagtgctgtag

SEQ ID NO: 172567 - DNA, 2145 bp, Artificial Sequence
  Description of Artificial Sequence: Synthetic coding sequence
atgaccaagaggcggctgcagaccatcacagcctgcctgcagctgcgggagggcagccccagcctgcaccggggcctgcaccccagccgggaggagaagagggacagcaggatggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacatcgactatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccactggctgagcattgagggctgccagcctgccatccctgagaaccccccaccagcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagatcctggcctgtaccagatgctgccccgcttcagcaccttcatcagcgagggcgtgcgggtgaatgtggtgcagaacaacctggccctgctgatctacctgatgaggatggtgaaggccctgatggacaaccccaccctgtacctggagaagtatgtgcatgagctgatcccagctgtgatgacctgcatcgtgtcccggcagctgtgcctgcggccagatgtggacaaccactgggccctgcgggactttgctgcccggctggtggcccagatctgcaagcacttcagcaccaccaccaacaacatccagagccgcatcaccaagaccttcaccaagtcctgggtggatgagaagaccccctggaccaccaggtatggcagcattgctggcctggccgagctgggccatgatgtgatcaagaccctcatcctgccccggctgcagcaggagggggagcgcatccgctctgtgctggatggccctgtgctgagcaacatcgacagaattggagctgaccacgtgcagagcctgctgctgaagcactgtgcccctgtgctggccaagctgcggcccccaccagacaaccaggatgcctacagagctgagtttggcagcctgggccccctgctgtgcagccaggtggtgaaggcccgggcccaggccgccctgcaggcccagcaggtgaacagaaccaccctgaccatcacccagccccggcccaccctgaccctgagccaggccccccagcccggccccaggaccccaggcctgctgaaggtgcccggcagcatcgccctgcctgtgcagaccctggtgtctgcccgggctgctgccccaccccagcccagccccccacccaccaagttcatcgtgatgagcagcagcagcagcgcccccagcacccagcaggtgctgagcctgagcaccagcgcccctggcagcggcagcaccaccaccagccctgtgaccaccaccgtgcccagcgtgcagcccatcgtgaagctggtgtccacagccaccacagccccacccagcacagcccccagcggccctggctctgtgcagaagtacatcgtggtgtccctgcccccaactggagagggcaaaggaggccccaccagccaccccagccctgtgcccccaccagccagcagccccagccccctgagcggcagcgccctgtgtggcggcaagcaggaggccggggacagccccccaccagcccctggcacccccaaggccaacggcagccagcccaacagcggcagcccccagcctgccccctag

SEQ ID NO: 172568 - DNA, 702 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagatcctggcctgtag

SEQ ID NO: 172569 - DNA, 405 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccactag

SEQ ID NO: 172570 - DNA, 345 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagctgaagaatgtggagcccctgtatggcttccacgcccaggagttcatccccttccgctttgccagcggcggcggccgggagctgtacttctatgaggagaaggaggtggacctgtag

SEQ ID NO: 172571 - DNA, 2034 bp, Artificial Sequence; identical to SEQ ID NO: 172563
  Description of Artificial Sequence: Synthetic coding sequence

SEQ ID NO: 172572 - DNA, 2034 bp, Artificial Sequence; identical to SEQ ID NO: 172563
  Description of Artificial Sequence: Synthetic coding sequence

SEQ ID NO: 172573 - DNA, 30 bp, Artificial Sequence; identical to SEQ ID NO: 101777
  Description of Artificial Sequence: Synthetic coding sequence

SEQ ID NO: 172574 - DNA, 2205 bp, Artificial Sequence
  Description of Artificial Sequence: Synthetic coding sequence
atggacatccgccacagcgagttcctgccctgcctgcactgccccccatttgtgggccccctgcctgtgagccacgtgtccttcagcagcgcctgccctgtgcccctgcccggcagccccagcctgcaccggggcctgcaccccagccgggaggagaagagggacagcaggatggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacatcgactatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccactggctgagcattgagggctgccagcctgccatccctgagaaccccccaccagcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagatcctggcctgtaccagatgctgccccgcttcagcaccttcatcagcgagggcgtgcgggtgaatgtggtgcagaacaacctggccctgctgatctacctgatgaggatggtgaaggccctgatggacaaccccaccctgtacctggagaagtatgtgcatgagctgatcccagctgtgatgacctgcatcgtgtcccggcagctgtgcctgcggccagatgtggacaaccactgggccctgcgggactttgctgcccggctggtggcccagatctgcaagcacttcagcaccaccaccaacaacatccagagccgcatcaccaagaccttcaccaagtcctgggtggatgagaagaccccctggaccaccaggtatggcagcattgctggcctggccgagctgggccatgatgtgatcaagaccctcatcctgccccggctgcagcaggagggggagcgcatccgctctgtgctggatggccctgtgctgagcaacatcgacagaattggagctgaccacgtgcagagcctgctgctgaagcactgtgcccctgtgctggccaagctgcggcccccaccagacaaccaggatgcctacagagctgagtttggcagcctgggccccctgctgtgcagccaggtggtgaaggcccgggcccaggccgccctgcaggcccagcaggtgaacagaaccaccctgaccatcacccagccccggcccaccctgaccctgagccaggccccccagcccggccccaggaccccaggcctgctgaaggtgcccggcagcatcgccctgcctgtgcagaccctggtgtctgcccgggctgctgccccaccccagcccagccccccacccaccaagttcatcgtgatgagcagcagcagcagcgcccccagcacccagcaggtgctgagcctgagcaccagcgcccctggcagcggcagcaccaccaccagccctgtgaccaccaccgtgcccagcgtgcagcccatcgtgaagctggtgtccacagccaccacagccccacccagcacagcccccagcggccctggctctgtgcagaagtacatcgtggtgtccctgcccccaactggagagggcaaaggaggccccaccagccaccccagccctgtgcccccaccagccagcagccccagccccctgagcggcagcgccctgtgtggcggcaagcaggaggccggggacagccccccaccagcccctggcacccccaaggccaacggcagccagcccaacagcggcagcccccagcctgccccctag

SEQ ID NO: 172575 - DNA, 768 bp, Artificial Sequence
  Description of Artificial Sequence: Synthetic coding sequence
atggccgaggagaagaagctgaagctgagcaacacagtgctgcccagcgagagcatgaaggtggtggccgagagcatgggcatcgcccagatccaggaggagacctgccagctgctgacagatgaggtgtcctaccgcatcaaggagatcgcccaggatgccctgaagttcatgcacatgggcaagaggcagaagctgaccaccagtgacattgattatgccctgaagctgaagaatgtggagcccctgtatggcttccacgcccaggagttcatccccttccgctttgccagcggcggcggccgggagctgtacttctatgaggagaaggaggtggacctgagtgacatcatcaacacccccctgccccgggtgcccctggatgtgtgcctgaaggcccactggctgagcattgagggctgccagcctgccatcccagaaaatcctcctccagcccccaaggagcagcagaaggccgaggccacagagcccctgaagagcgccaagccaggccaggaggaggatggccccctgaagggcaagggccagggcgccaccacagcagatggcaagggcaaggagaagaaggccccacccctgctggagggcgcccccctgcggctgaagcccaggagcatccacgagctgtctgtggagcagcagctgtactacaaggagatcacagaggcctgtgtgggcagctgtgaggccaagagagctgaggccctgcagagcatcgccacagaccccggcctgtaccagatgtag

SEQ ID NO: 172576 - DNA, 1050 bp, Artificial Sequence
  Description of Artificial Sequence: Synthetic coding sequence
atgagcaagagcaaggatgatgcccctcatgagctggagagccagttcatcctgcggctgcccccagaatatgccagcacagtgagaagagctgtgcagagcggccacgtgaacctgaaggaccggctgaccatcgagctgcacccagatggaagacatggaattgtgcgggtggacagagtgcccctggccagcaagctggtggacctgccctgtgtgatggagagcctgaagaccatcgacaagaagaccttctacaagacagctgacatctgccagatgctggtgtccacagtggatggagacctgtacccacctgtggaggagcctgtggccagcacagaccccaaggccagcaagaagaaggacaaggacaaggagaagaagttcatctggaaccacggcatcaccctgcccctgaagaatgtgaggaagaggcgcttcaggaagacagccaagaagaagtacatcgagagcccagatgtggagaaggaggtgaagaggctgctgagcacagatgctgaggccgtgtccacccgctgggagatcatcgccgaggatgagaccaaggaggccgagaaccagggcctggacatcagcagccctggcatgagcggccaccggcagggccatgacagcctggagcatgatgagctgcgggagatcttcaatgacctgagcagcagcagtgaagatgaagatgagacccagcaccaggatgaggaggacatcaacatcatcgacacagaggaggacctggagcggcagctgcaggacaagctgaatgaaagtgatgagcagcaccaggagaatgaaggcaccaaccagctggtgatgggcatccagaagcagattgacaacatgaagggcaagctgcaggagacccaggaccgggccaagaggcaggaggacctgatcatgaaggtggagaacctggccctgaagaaccgcttccaggccgtgctggatgagctgaagcagaaggaggaccgggagaaggagcagctgagcagcctgcaggaggagctggagagcctgctggagaagtag

SEQ ID NO: 172577 - DNA, 909 bp, Artificial Sequence
  Description of Artificial Sequence: Synthetic coding sequence
atgtctgagagccaggatgaggtgcctgatgaggtggagaaccagttcatcctgcggctgcccctggagcacgcctgcaccgtgaggaacctggcccggagccagagcgtgaagatgaaggacaagctgaagattgacctgctgcctgatggaagacatgctgtggtggaggtggaggatgtgcccctggccgccaagctggtggacctgccctgcgtcatcgagagcctgcggaccctggacaagaagaccttctacaagacagctgacatcagccagatgctggtgtgcacagcagatggagacatccacctgagccctgaggagcctgctgccagcacagaccccaacatcgtgaggaagaaggagcggggccgggaggagaagtgtgtgtggaagcacggcatcaccccacccctgaagaatgtgaggaagaagcgcttcaggaagacccagaagaaggtgcctgatgtgaaggagatggagaagagcagcttcacagagtacatcgagagcccagatgtggagaatgaggtgaagaggctgctgcggagtgatgctgaggccgtgtccacccgctgggaggtgattgctgaagatggcaccaaggagattgagagccagggcagcatccctggcttcctgatcagcagcggcatgagcagccacaagcagggccacaccagctctgtgatggagatccagaagcagatcgagaagaaggagaagaagctgcacaagatccagaacaaggcccagaggcagaaggacctgatcatgaaggtggagaacctgaccctgaagaaccacttccagagcgtgctggagcagctggagctgcaggagaagcagaagaatgagaagctgatcagcctgcaggagcagctgcagcgcttcctgaagaagtag

SEQ ID NO: 172578 - DNA, 1131 bp, Artificial Sequence
  Description of Artificial Sequence: Synthetic coding sequence
atgtctgagagccaggatgaggtgcctgatgaggtggagaaccagttcatcctgcggctgcccctggagcacgcctgcaccgtgaggaacctggcccggagccagagcgtgaagatgaaggacaagctgaagattgacctgctgcctgatggaagacatgctgtggtggaggtggaggatgtgcccctggccgccaagctggtggacctgccctgcgtcatcgagagcctgcggaccctggacaagaagaccttctacaagacagctgacatcagccagatgctggtgtgcacagcagatggagacatccacctgagccctgaggagcctgctgccagcacagaccccaacatcgtgaggaagaaggagcggggccgggaggagaagtgtgtgtggaagcacggcatcaccccacccctgaagaatgtgaggaagaagcgcttcaggaagacccagaagaaggtgcctgatgtgaaggagatggagaagagcagcttcacagagtacatcgagagcccagatgtggagaatgaggtgaagaggctgctgcggagtgatgctgaggccgtgtccacccgctgggaggtgattgctgaagatggcaccaaggagattgagagccagggcagcatccctggcttcctgatcagcagcggcatgagcagccacaagcagggccacaccagcagtgaatatgacatgctgcgggagatgttcagtgacagccgcagcaacaatgatgatgatgaagatgaagatgatgaagatgaagatgaagatgaagatgaagatgaagatgaggacaaggaggaggaggaggaggactgcagcgaggagtacctggagcggcagctgcaggccgagttcatcgagagcggccagtaccgggccaatgaaggcaccagcagcatcgtgatggagatccagaagcagatcgagaagaaggagaagaagctgcacaagatccagaacaaggcccagaggcagaaggacctgatcatgaaggtggagaacctgaccctgaagaaccacttccagagcgtgctggagcagctggagctgcaggagaagcagaagaatgagaagctgatcagcctgcaggagcagctgcagcgcttcctgaagaagtag

SEQ ID NO: 172579 - DNA, 909 bp, Artificial Sequence; identical to SEQ ID NO: 172577
  Description of Artificial Sequence: Synthetic coding sequence

SEQ ID NO: 172580 - DNA, 1389 bp, Artificial Sequence
  Description of Artificial Sequence: Synthetic coding sequence
atggagtgcccagagggccagctgcccatcagcagtgaaaatgacagcacccccaccgtgtccaccagcgaggtgaccagccagcaggagccccagatcctggtggaccggggcagcgagaccacctatgagagcagcgctgacattgctggagatgagggcacccagatcccagcagatgaggacacccagacagatgctgacagcagcgcccaggccgccgcccaggcccctgagaacttccaggagggcaaggacatgtctgagagccaggatgaggtgcctgatgaggtggagaaccagttcatcctgcggctgcccctggagcacgcctgcaccgtgaggaacctggcccggagccagagcgtgaagatgaaggacaagctgaagattgacctgctgcctgatggaagacatgctgtggtggaggtggaggatgtgcccctggccgccaagctggtggacctgccctgcgtcatcgagagcctgcggaccctggacaagaagaccttctacaagacagctgacatcagccagatgctggtgtgcacagcagatggagacatccacctgagccctgaggagcctgctgccagcacagaccccaacatcgtgaggaagaaggagcggggccgggaggagaagtgtgtgtggaagcacggcatcaccccacccctgaagaatgtgaggaagaagcgcttcaggaagacccagaagaaggtgcctgatgtgaaggagatggagaagagcagcttcacagagtacatcgagagcccagatgtggagaatgaggtgaagaggctgctgcggagtgatgctgaggccgtgtccacccgctgggaggtgattgctgaagatggcaccaaggagattgagagccagggcagcatccctggcttcctgatcagcagcggcatgagcagccacaagcagggccacaccagcagtgaatatgacatgctgcgggagatgttcagtgacagccgcagcaacaatgatgatgatgaagatgaagatgatgaagatgaagatgaagatgaagatgaagatgaagatgaggacaaggaggaggaggaggaggactgcagcgaggagtacctggagcggcagctgcaggccgagttcatcgagagcggccagtaccgggccaatgaaggcaccagcagcatcgtgatggagatccagaagcagatcgagaagaaggagaagaagctgcacaagatccagaacaaggcccagaggcagaaggacctgatcatgaaggtggagaacctgaccctgaagaaccacttccagagcgtgctggagcagctggagctgcaggagaagcagaagaatgagaagctgatcagcctgcaggagcagctgcagcgcttcctgaagaagtag

SEQ ID NO: 172581 - DNA, 1548 bp, Artificial Sequence
  Description of Artificial Sequence: Synthetic coding sequence
atgggcaactgggtggtgaaccactggttctctgtgctcttcctggtggtgtggctgggcctgaatgtgttcctgtttgtggatgccttcctgaagtatgagaaggctgacaagtactactacaccaggaagatcctgggcagcaccctggcctgtgcccgggccagcgccctgtgcctgaacttcaacagcaccctcatcctgctgcctgtgtgcaggaacctgctgtccttcctgcggggcacctgcagcttctgcagcaggaccctgaggaagcagctggaccacaacctgaccttccacaagctggtggcctacatgatctgcctgcacacagccatccacatcatcgcccacctgttcaactttgactgctacagccgcagccggcaggccacagatggcagcctggccagcatcctgagcagcctgagccatgatgagaagaagggcggctcctggctgaaccccatccagagcaggaacaccaccgtggagtatgtgaccttcaccagcattgctggcctgactggagtcatcatgaccatcgccctgatcctgatggtgaccagcgccacagagttcatcagaagaagctactttgaggtgttctggtacacccaccacctgttcatcttctacatcctgggcctgggcatccatggaattggaggcatcgtgcggggccagacagaggagagcatgaatgaaagccaccccaggaaatgtgccgagagctttgagatgtgggatgaccgggacagccactgccggcggcccaagtttgagggccaccccccagagagctggaagtggatcctggcccctgtgatcctgtacatctgtgagcgcatcctgcgcttctaccgcagccagcagaaggtggtgatcaccaaggtggtgatgcaccccagcaaggtgctggagctgcagatgaacaagaggggcttctccatggaggtgggccagtacatctttgtgaactgccccagcatcagcctgctggagtggcaccccttcaccctgaccagcgcccctgaggaggacttcttcagcatccacatccgggccgccggggactggacagaaaatctcatccgggcctttgagcagcagtacagccccatccccagaattgaggtggatggcccctttggaacagcctctgaagatgtgttccagtatgaggtggccgtgctggtgggcgccggcattggagtgaccccatttgccagcatcctgaagagcatctggtacaagttccagtgtgccgaccacaacctgaagaccaagaaggtgggccacgccgccctgaactttgacaaggccacagacatcgtgacaggcctgaagcagaagaccagctttggccggcccatgtgggacaatgagttcagcaccatcgccaccagccaccccaagtctgtggtgggcgtcttcctgtgtggccccaggaccctggccaagagcctgaggaagtgctgccaccgctacagcagcctggaccccaggaaggtgcagttctacttcaacaaggagaacttctag

SEQ ID NO: 172582 - DNA, 795 bp, Artificial Sequence; identical to SEQ ID NO: 156631
  Description of Artificial Sequence: Synthetic coding sequence

SEQ ID NO: 172583 - DNA, 510 bp, Artificial Sequence
  Description of Artificial Sequence: Synthetic coding sequence
atgtgccacaggaagccaggcaccccaggagtgggcaagaccaccctgggcaaggagctggccagcaagagcggcctgaagtacatcaacgtgggggacctggcccgggaggagcagctgtatgatggctatgatgaggagtatgactgccccatcctggatgaagatagagtggtggatgagctggacaaccagatgagggagggcggcgtcatcgtggactaccacggctgtgacttcttccctgagcgctggttccacatcgtgtttgtgctgaggacagacaccaacgtgctgtatgaaaggctggagacccggggctacaatgagaagaagctgacagacaacatccagtgtgagatcttccaggtgctgtatgaggaggccacagccagctacaaggaggagatcgtgcaccagctgcccagcaacaagccagaggagctggagaacaacgtggaccagatcctgaagtggattgagcagtggatcaaggaccacaacagctag

SEQ ID NO: 172584 - DNA, 519 bp, Artificial Sequence
  Description of Artificial Sequence: Synthetic coding sequence
atgctgctgcccaacatcctgctgaccggcaccccaggagtgggcaagaccaccctgggcaaggagctggccagcaagagcggcctgaagtacatcaacgtgggggacctggcccgggaggagcagctgtatgatggctatgatgaggagtatgactgccccatcctggatgaggacagagtggtggatgagctggacaaccagatgagggagggcggcgtgattgtggactaccacggctgtgacttcttccctgagcgctggttccacatcgtgtttgtgctgaggacagacaccaacgtgctgtatgagcggctggagacccggggctacaatgagaagaagctgacagacaacatccagtgtgagatcttccaggtgctgtatgaggaggccacagccagctacaaggaggagatcgtgcaccagctgcccagcaacaagccagaggagctggagaacaacgtggaccagatcctgaagtggattgagcagtggatcaaggaccacaacagctag

SEQ ID NO: 172585 - DNA, 597 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactaccgcctgaagagcctgcagaagaaggccagcaccagcgctggccgcatcaccgtgccccggctgtctgtgggctctgtgaccagccggcccagcacccccaccctgggcacccccaccccccagaccatgtctgtgtccaccaaggtgggcacccccatgagcctgaccggccagcgcttcaccgtgcagatgcccaccagccagagccctgcctag

SEQ ID NO: 172586 - DNA, 411 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactaccgcctgaagagcctgcagaagaaggcctag

SEQ ID NO: 172587 - DNA, 795 bp, Artificial Sequence; identical to SEQ ID NO: 156631
  Description of Artificial Sequence: Synthetic coding sequence

SEQ ID NO: 172588 - DNA, 309 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacctag

SEQ ID NO: 172589 - DNA, 501 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactaccgcctgaagagcctgcagaagaaggccagcaccagcgctggccgcatcaccgtgccccggctgtctgtgggctctgtgaccagccggcccagcacccccaccctgggcacccccacctag

SEQ ID NO: 172590 - DNA, 384 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactactag

SEQ ID NO: 172591 - DNA, 756 bp, Artificial Sequence
  Description of Artificial Sequence: Synthetic coding sequence
atggagagcggcaagatggccccacccaagaatgcccccagagatgccctggtgatggcccagatcctgaaggacatgggcatcacagaatatgagcccagggtcatcaaccagatgctggagtttgccttccgctacgtgaccaccatcctggatgatgccaagatctacagcagccacgccaagaagcccaacgtggatgctgatgatgtgcggctggccatccagtgcagagctgaccagagcttcaccagccccccaccccgggacttcctgctggacatcgcccggcagaagaaccagacccccctgcccctcatcaagccctatgccggcccccggctgcccccagaccgctactgcctgacagcccccaactaccgcctgaagagcctcatcaagaagggccccaaccagggccgcctggtgccccggctgtctgtgggcgctgtgagcagcaagcccaccacccccaccatcgccaccccccagacagtgtctgtgcccaacaaggtggccacccccatgtctgtgaccagccagcgcttcaccgtgcagatcccccccagccagagcacccctgtgaagcctgtgcctgccaccacagctgtgcagaatgtgctgatcaaccccagcatgattggccccaagaacatcctgatcaccaccaacatggtgagcagccagaacacagccaatgaggccaaccccctgaagaggaagcatgaagatgatgatgacaatgacatcatgtag

SEQ ID NO: 172592 - DNA, 879 bp, Artificial Sequence
  Description of Artificial Sequence: Synthetic coding sequence
atgcccctgcacgtgaagtggcccttccctgctgtgccccccctgacctggaccctggccagctctgtggtgatgggcctggtgggcacctacagctgcttctggaccaagtacatgaaccacctgactgtgcacaaccgggaggtgctgtatgagctgattgagaagaggggccctgccacccccctcatcaccgtgagcaaccaccagagctgcatggatgacccccacctgtggggcatcctgaagctgcggcacatctggaacctgaagctgatgcgctggaccccagctgctgctgacatctgcttcaccaaggagctgcacagccacttcttcagcctgggcaaatgtgtgcctgtgtgcagaggagctgagttcttccaggctgaaaatgaaggaaaaggagtgctggacaccggccgccacatgcctggagctgggaagaggcgggagaagggagatggagtgtaccagaagggcatggacttcatcctggagaagctgaaccacggggactgggtgcacatcttccctgagggcaaggtgaacatgagcagcgagttcctgcgcttcaagtggggcatcggccgcctgattgctgagtgccacctgaaccccatcatcctgcccctgtggcacgtgggcatgaatgatgtgctgcccaacagccccccctacttccccaggtttggccagaagatcaccgtgctgattggcaagcccttcagcgccctgcctgtgctggagcggctgcgggcagagaacaagtctgctgtggagatgaggaaggccctgacagacttcatccaggaggagttccagcacctgaagacccaggccgagcagctgcacaaccacctgcagcccggccgctag

SEQ ID NO: 172593 - DNA, 789 bp, Artificial Sequence
  Description of Artificial Sequence: Synthetic coding sequence
atgcccctgcacgtgaagtggcccttccctgctgtgccccccctgacctggaccctggccagctctgtggtgatgggcctggtgggcacctacagctgcttctggaccaagtacatgaaccacctgactgtgcacaaccgggaggtgctgtatgagctgattgagaagaggggccctgccacccccctcatcaccgtgagcaaccaccagagctgcatggatgacccccacctgtggggcatcctgaagctgcggcacatctggaacctgaagctgatgcgctggaccccagctgctgctgacatctgcttcaccaaggagctgcacagccacttcttcagcctgggcaaatgtgtgcctgtgtgcagaggagatggagtgtaccagaagggcatggacttcatcctggagaagctgaaccacggggactgggtgcacatcttccctgagggcaaggtgaacatgagcagcgagttcctgcgcttcaagtggggcatcggccgcctgattgctgagtgccacctgaaccccatcatcctgcccctgtggcacgtgggcatgaatgatgtgctgcccaacagccccccctacttccccaggtttggccagaagatcaccgtgctgattggcaagcccttcagcgccctgcctgtgctggagcggctgcgggcagagaacaagtctgctgtggagatgaggaaggccctgacagacttcatccaggaggagttccagcacctgaagacccaggccgagcagctgcacaaccacctgcagcccggccgctag

SEQ ID NO: 172594 - DNA, 837 bp, Artificial Sequence
  Description of Artificial Sequence: Synthetic coding sequence
atgcccctgcacgtgaagtggcccttccctgctgtgccccccctgacctggaccctggccagctctgtggtgatgggcctggtgggcacctacagctgcttctggaccaagtacatgaaccacctgactgtgcacaaccgggaggtgctgtatgagctgattgagaagaggggccctgccacccccctcatcaccgtgagcaaccaccagagctgcatggatgacccccacctgtggggcatcctgaagctgcggcacatctggaacctgaagctgatgcgctggaccccagctgctgctgacatctgcttcaccaaggagctgcacagccacttcttcagcctgggcaaatgtgtgcctgtgtgcagaggagctgagttcttccaggctgaaaatgaaggaaaaggagtgctggacaccggccgccacatgcctggagctgggaagaggcgggagaagggagatggagtgtaccagaagggcatggacttcatcctggagaagctgaaccacggggactgggtgcacatcttccctgagggcatcggccgcctgattgctgagtgccacctgaaccccatcatcctgcccctgtggcacgtgggcatgaatgatgtgctgcccaacagccccccctacttccccaggtttggccagaagatcaccgtgctgattggcaagcccttcagcgccctgcctgtgctggagcggctgcgggcagagaacaagtctgctgtggagatgaggaaggccctgacagacttcatccaggaggagttccagcacctgaagacccaggccgagcagctgcacaaccacctgcagcccggccgctag

SEQ ID NO: 172595 - DNA, 747 bp, Artificial Sequence
  Description of Artificial Sequence: Synthetic coding sequence
atgcccctgcacgtgaagtggcccttccctgctgtgccccccctgacctggaccctggccagctctgtggtgatgggcctggtgggcacctacagctgcttctggaccaagtacatgaaccacctgactgtgcacaaccgggaggtgctgtatgagctgattgagaagaggggccctgccacccccctcatcaccgtgagcaaccaccagagctgcatggatgacccccacctgtggggcatcctgaagctgcggcacatctggaacctgaagctgatgcgctggaccccagctgctgctgacatctgcttcaccaaggagctgcacagccacttcttcagcctgggcaaatgtgtgcctgtgtgcagaggagatggagtgtaccagaagggcatggacttcatcctggagaagctgaaccacggggactgggtgcacatcttccctgagggcatcggccgcctgattgctgagtgccacctgaaccccatcatcctgcccctgtggcacgtgggcatgaatgatgtgctgcccaacagccccccctacttccccaggtttggccagaagatcaccgtgctgattggcaagcccttcagcgccctgcctgtgctggagcggctgcgggcagagaacaagtctgctgtggagatgaggaaggccctgacagacttcatccaggaggagttccagcacctgaagacccaggccgagcagctgcacaaccacctgcagcccggccgctag

SEQ ID NO: 172596 - DNA, 798 bp, Artificial Sequence
  Description of Artificial Sequence: Synthetic coding sequence
atgcccctgcacgtgaagtggcccttccctgctgtgccccccctgacctggaccctggccagctctgtggtgatgggcctggtgggcacctacagctgcttctggaccaagtacatgaaccacctgactgtgcacaaccgggaggtgctgtatgagctgattgagaagaggggccctgccacccccctcatcaccgtgagcaaccaccagagctgcatggatgacccccacctgtggggcatcctgaagctgcggcacatctggaacctgaagctgatgcgctggaccccagctgctgctgacatctgcttcaccaaggagctgcacagccacttcttcagcctgggcaaatgtgtgcctgtgtgcagaggagctgagttcttccaggctgaaaatgaaggaaaaggagtgctggacaccggccgccacatgcctggagctgggaagaggcgggagaagggcaaggtgaacatgagcagcgagttcctgcgcttcaagtggggcatcggccgcctgattgctgagtgccacctgaaccccatcatcctgcccctgtggcacgtgggcatgaatgatgtgctgcccaacagccccccctacttcccccgcttcggccagaagatcaccgtgctgattggcaagcccttcagcgccctgcctgtgctggagcggctgcgggcagagaacaagtctgctgtggagatgaggaaggccctgacagacttcatccaggaggagttccagcacctgaagacccaggccgagcagctgcacaaccacctgcagcctggaagatag

SEQ ID NO: 172597 - DNA, 7629 bp, Artificial Sequence
  Description of Artificial Sequence: Synthetic coding sequence
atggtggccctgagcctgaagatctgtgtgcgccactgcaatgtggtgaagaccatgcagtttgagcccagcacagctgtgtatgatgcctgcagggtcatccgggagcgggtgcctgaggcccagacaggccaggccagtgactatggcctcttcctgagtgatgaggaccccaggaagggcatctggctggaggccggccgcaccctggactactacatgctgagaaatggagacatcctggagtacaagaagaagcagaggccccagaagatccgcatgctggatggctctgtgaagacagtgatggtggatgacagcaagacagtgggggagctgctggtgaccatctgcagcagaattggcatcaccaactatgaggagtacagcctcatccaggagaccatcgaggagaagaaggaggagggcaccggcaccctgaagaaggacaggaccctgctgagagatgagaggaagatggagaagctgaaggccaagctgcacacagatgatgacctgaactggctggaccacagcaggaccttccgggagcagggcgtggatgaaaatgagaccctgctgctgcggaggaagttcttctacagcgaccagaatgtggacagccgggaccctgtgcagctgaacctgctgtatgtgcaggccagagatgacatcctgaatggcagccaccctgtgtcctttgagaaggcctgtgaatttggaggcttccaggcccagatccagtttggcccccacgtggagcacaagcacaagccaggcttcctggacctgaaggagttcctgcccaaggagtacatcaagcagagaggagctgagaagaggatcttccaggagcacaagaactgtggggagatgtctgaaattgaggccaaggtgaagtatgtgaagctggcccggagcctgcggacctatggagtgtccttcttcctggtgaaggagaagatgaagggcaagaacaagctggtgccccggctgctgggcatcaccaaggacagcgtgatgagggtggatgagaagaccaaggaggtgctgcaggagtggcccctgaccaccgtgaagcgctgggccgccagccccaagagcttcaccctggactttggagagtaccaggagagctactacagcgtgcagaccacagaaggagagcagatcagccagctgattgctggctacatcgacatcatcctgaagaagaagcagagcaaggaccgcttcggcctggagggagatgaggagagcaccatgctggaggagagcgtgagccccaagaagagcaccatcctgcagcagcagttcaacagaacaggcaaggccgagcacggctctgtggccctgcctgctgtgatgaggagcggcagcagcggccctgagaccttcaacgtgggctccatgcccagcccccagcagcaggtgatggtgggccagatgcaccggggccacatgccacccctgaccagcgcccagcaggccctgatgggcaccatcaacacctccatgcatgctgtgcagcaggcccaggatgacctgtctgagctggacagcctgccccccctgggccaggacatggccagccgggtgtgggtgcagaacaaggtggatgagagcaagcatgagatccacagccaggtggatgccatcacagctggaacagcctctgtggtgaacctgacagctggggaccctgctgacacagactacacagctgtgggctgtgccatcaccaccatcagcagcaacctgacagagatgagcaagggcgtgaagctgctggccgccctgatggatgatgaggtgggcagcggggaggacctgctgcgggccgcccggaccctggccggggctgtgtctgacctgctgaaggctgtgcagcccaccagcggggagccccggcagacagtgctgacagctgctggcagcatcggccaggccagcggggacctgctgcggcagatcggggagaatgaaacagatgagcgcttccaggatgtgctgatgagcctggccaaggctgtggccaatgctgctgccatgctggtgctgaaggccaagaatgtggcccaggtggctgaagatactgtgctgcagaacagagtgattgctgctgccacccagtgtgccctgagcaccagccagctggtggcctgtgccaaggtggtgagccccaccatcagcagccctgtgtgccaggagcagctgattgaggccggcaagctggtggacagatctgtggagaactgtgtgcgggcctgccaggccgccaccacagacagcgagctgctgaagcaggtgtctgctgctgcctctgtggtgtcccaggccctgcatgacctgctgcagcacgtgcggcagtttgccagcagaggagagcccatcggccgctatgaccaggccacagacaccatcatgtgtgtgacagagagcatcttcagctccatgggagatgctggggagatggtgcggcaggcccgggtgctggcccaggccaccagtgacctggtgaatgccatgagaagtgatgctgaggccgagattgacatggagaacagcaagaagctgctggccgccgccaagctgctggccgacagcacagccaggatggtggaggccgccaagggagctgctgccaacccagaaaatgaagaccagcagcagaggctgcgggaggccgctgagggcctgcgggtggccaccaatgctgctgcccagaatgccatcaagaagaagatcgtgaaccggctggaggtggccgccaagcaggccgctgctgctgccacccagaccatcgccgccagccagaatgctgctgtgagcaacaagaacccagctgcccagcagcagctggtgcagagctgcaaggctgtggccgaccacatcccccagctggtgcagggcgtgcggggcagccaggcccaggccgaggacctgagcgcccagctggccctgatcatcagcagccagaacttcctgcagcccggcagcaagatggtgtcctctgccaaggctgctgtgcccaccgtgtctgaccaggccgccgccatgcagctgagccagtgtgccaagaacctggccaccagcctggccgagctgaggacagccagccagaaggcccacgaggcctgtggccccatggagattgacagcgccctgaacacagtgcagaccctgaagaatgagctgcaggatgccaagatggctgctgtggagagccagctgaagcccctgcccggggagaccctggagaagtgtgcccaggacctgggcagcaccagcaaggctgtgggcagctccatggcccagctgctgacctgtgccgcccagggcaatgagcactacacaggagtggccgcccgggagacagcccaggccctgaagaccctggcccaggccgcccggggcgtggccgccagcaccacagatcctgctgctgcccacgccatgctggacagcgccagagatgtgatggagggcagcgccatgctgatccaggaggccaagcaggccctgattgcccctggagatgctgagcggcagcagaggctggcccaggtggccaaggctgtgagccacagcctgaacaactgtgtgaactgcctgcccggccagaaggatgtggatgtggccctgaagagcatcggggagagcagcaagaagctgctggtggacagcctgccccccagcaccaagcccttccaggaggcccagagcgagctgaaccaggccgctgctgacctgaaccagagcgctggggaggtggtgcacgccacccggggccagagcggggagctggccgccgccagcggcaagttcagtgatgactttgatgagttcctggatgctggcatcgagatggccggccaggcccagaccaaggaggaccagatccaggtgattggcaacctgaagaacatctccatggccagcagcaagctgctgctggccgccaagagcctgtctgtggaccccggggccccaaatgccaagaacctgctggccgccgccgcccgggctgtgacagagagcatcaaccagctgatcaccctgtgcacccagcaggcccctggccagaaggaatgtgacaatgccctgcgggagctggagaccgtgaagggcatgctggacaaccccaatgaacctgtgtctgacctgagctactttgactgcattgaatctgtgatggagaacagcaaggtgctgggggagagcatggccggcatcagccagaatgccaagacaggagacctgcctgccttcggggagtgtgtgggcatcgccagcaaggccctgtgtggcctgacagaagctgctgcccaggccgcctacctggtgggcatcagtgaccccaacagccaggccggccaccagggcctggtggaccccatccagtttgcccgggccaaccaggccatccagatggcctgccagaacctggtggaccccggcagcagccccagccaggtgctgtctgctgccaccatcgtggccaagcacaccagcgccctgtgcaatgcctgcagaattgccagcagcaagacagccaaccctgtggccaagaggcactttgtgcagagcgccaaggaggtggccaacagcacagccaacctggtgaagaccatcaaggccctggatggagacttcagcgaggacaacagaaataaatgtcgcatcgccacagcccccctcatcgaggccgtggagaacctgacagcctttgccagcaaccctgagtttgtgtccatcccagcccagatcagcagcgagggcagccaggcccaggagcccatcctggtgtctgccaagaccatgctggagagcagcagctacctgatcagaacagcccggagcctggccatcaaccccaaggacccccccacctggagcgtgctggccggccacagccacacagtgtctgacagcatcaagagcctcatcaccagcatccgggacaaggcccctggccagcgggagtgtgactacagcattgatggcatcaaccgctgcatccgggacatcgagcaggccagcctggccgctgtgtcccagagcctggccaccagagatgacatctctgtggaggccctgcaggagcagctgacctctgtggtgcaggagatcggccacctgattgaccccatcgccacagctgcccggggggaggccgcccagctgggccacaaggtgacccagctggccagctactttgagcccctcatcctggccgctgtgggcgtggccagcaagatcctggaccaccagcagcagatgacagtgctggaccagaccaagaccctggccgagagcgccctgcagatgctgtatgctgccaaggagggcggcggcaaccccaaggcccagcacacccatgatgccatcacagaggccgcccagctgatgaaggaggccgtggatgacatcatggtgaccctgaatgaggccgccagcgaggtgggcctggtgggcggcatggtggatgccatcgccgaggccatgagcaagctggatgagggcaccccacctgagcccaagggcacctttgtggactaccagaccaccgtggtgaagtacagcaaggccatcgctgtgacagcccaggagatgatgaccaagtctgtgaccaaccctgaggagctgggcggcctggccagccagatgaccagtgactatggccacctggccttccagggccagatggctgctgccacagctgagcctgaggagatcggcttccagatccgcaccagggtgcaggacctgggccacggctgcatcttcctggtgcagaaggccggggccctgcaggtgtgccccacagacagctacaccaagcgggagctgattgaatgtgcccgggctgtgacagagaaggtgtccctggtgctgagcgccctgcaggccggcaacaagggcacccaggcctgcatcacagctgccacagctgtgtctggcatcatcgctgacctggacaccaccatcatgtttgccacagctggcaccctgaatgctgagaacagcgagacctttgctgaccaccgggagaacatcctgaagacagccaaggccctggtggaggacaccaagctgctggtgtctggggccgccagcaccccagacaagctggcccaggccgcccagagcagcgctgccaccatcacccagctggccgaggtggtgaagctgggcgccgccagcctgggcagtgatgatcctgagacccaggtggtgctgatcaatgccatcaaggatgtggccaaggccctgagtgacctgatcagcgccaccaagggggccgccagcaagcctgtggatgaccccagcatgtaccagctgaagggggccgccaaggtgatggtgaccaacgtgaccagcctgctgaagacagtgaaggctgtggaggatgaggccacccggggcacccgggccctggaggccaccatcgagtgcatcaagcaggagctgactgtgttccagagcaaggatgtgcctgagaagaccagcagccctgaggagagcatccgcatgaccaagggcatcaccatggccacagccaaggctgtggccgccggcaacagctgccggcaggaggatgtgattgccacagccaacctgagcaggaaggctgtgtctgacatgctgacagcctgcaagcaggccagcttccacccagatgtgtctgatgaggtgaggacccgggccctgcgcttcggcacagaatgtaccctgggctacctggacctgctggagcacgtgctggtgatcctgcagaagcccaccccagagttcaagcagcagctggccgccttcagcaagagggtggccggggctgtgacagagctgatccaggccgctgaggccatgaagggcacagagtgggtggaccctgaggaccccaccgtgattgctgagacagagctgctgggcgccgccgccagcattgaagctgctgccaagaagctggagcagctgaagccccgggccaagcccaagcaggctgatgagaccctggactttgaggagcagatcctggaggccgccaagagcattgctgctgccaccagcgccctggtgaagagcgccagcgctgcccagcgggagctggtggcccagggcaaggtgggcagcatcccagccaatgctgctgatgatggccagtggagccagggcctcatctctgctgccaggatggtggccgccgccaccagcagcctgtgtgaggccgccaatgcctctgtgcagggccacgccagcgaggagaagctgatcagcagcgccaagcaggtggccgccagcacagcccagctgctggtggcctgcaaggtgaaggctgaccaggacagcgaggccatgaggcggctgcaggccgctggaaatgctgtgaagagggccagtgacaacctggtgcgggccgcccagaaggccgccttcggcaaggcagatgatgatgatgtggtggtgaagaccaagtttgtgggcggcatcgcccagatcatcgccgcccaggaggagatgctgaagaaggagcgggagctggaggaggccaggaagaagctggcccagatccggcagcagcagtacaagttcctgcccacagagctgagagaagatgagggctag

SEQ ID NO: 172598 - DNA, 7629 bp, Artificial Sequence; identical to SEQ ID NO: 172597
  Description of Artificial Sequence: Synthetic coding sequence

SEQ ID NO: 172599 - DNA, 5190 bp, Artificial Sequence
  Description of Artificial Sequence: Synthetic coding sequence
atgaaggtgtccaccctgcgggagagcagcgccatggccagccccctgccccgggagatggaggaggagctggtgcccactggaagtgagcccggggacacccgggccaagccccctgtgaagcccaagccccgggccctgcctgccaagccagccctgcctgccaagcccagcctgctggtgcctgtgggccccaggcctccccggggccccctggccgagctgcccagcgccaggaagatgaacatgctggccggcccccagccctacggcggcagcaagaggcccctgccctttgcccccaggcctgctgtggaggccagcactggaggagaggccacccaggagaccgggaaggaggaggccggcaaggaggagcccccacccctgaccccaccagcccgctgtgccgcccctggaggagtgaggaaggccccagcccccttccggcctgccagcgagagatttgctgccaccaccgtggaggagatcctggccaagatggagcagcccaggaaggaggtgctggccagcccagaccggctgtggggcagccggctgaccttcaaccatgatggcagcagccgctatggccccaggacctacggcaccaccacagcccccagagatgaagatggcagcaccctcttccggggctggagccaggagggccctgtgaagagccctgcagaatgtcgggaggagcacagcaagaccccagaggagaggagcctgcccagcgacctggccttcaacggggacctggccaaggccgccagcagcgagctgcctgctgacatcagcaagccctggatccccagcagccctgcccccagcagtgaaaatggaggccctgccagccctggcctgcctgctgaggccagcggcagcggccctggcagcccccacctgcaccccccagacaagagcagcccctgccacagccagctgctggaggcccagaccccagaggccagccaggccagcccctgcccagctgtgaccccatctgcccccagcgctgccctgcctgatgagggcagccgccacacccccagccctggcctgcctgctgagggcgcccctgaggccccccggcccagcagccccccacctgaggtgctggagccccacagcctggaccagcccccagccaccagcccccggcccctcatcgaggtgggggagctgctggacctgaccaggaccttccccagcggcggggaggaggaggccaagggagatgcccacctgcggcccaccagcctggtgcagaggcgcttcagcgagggcgtgctgcagagccccagccaggaccaggagaagctgggcggcagcctggccgccctgccccagggccagggcagccagctggccctggaccggccctttggagctgagagcaactggagcctgagccagagctttgagtggaccttccccacccggcccagcggcctgggcgtgtggaggctggacagccccccacccagccccatcacagaggccagcgaggccgctgaggccgctgaggccggcaacctggccgtgagcagccgggaggagggcgtgtcccagcagggccagggcgccggcagcgcccccagcggcagcggcagctcctgggtgcagggagatgaccccagcatgagcctgacccagaagggagatggagagagccagccccagtttcctgctgtgcccctggagcccctgcccaccacagagggcaccccaggcctgcccctgcagcaggccgaggagagatatgagagccaggagcccctggccggccaggagagccccctgcccctggccacccgggaggccgccctgcccatcctggagcctgtgctgggccaggagcagcctgctgccccagaccagccctgtgtgctgtttgctgatgcccctgagcccggccaggccctgcctgtggaggaggaggccgtgaccctggcccgggcagagaccacccaggccaggacagaggcccaggacctgtgccgggccagccctgagcccccaggccctgagagcagcagccgctggctggatgacctgctggccagccccccaccttctgggggcggggccaggagaggagctggagctgagctgaaggacacccagagccccagcacctgcagcgagggcctgctgggctggagccagaaggacctgcagagcgagtttggcatcactggagacccccagcccagcagcttcagccccagctcctggtgccagggcgccagccaggactatggcctgggcggggccagccccaggggggaccccggcctgggggagcgggactggaccagcaaatatggccagggcgctggggagggcagcacccgggagtgggccagccgctgtggcatcggccaggaggagatggaggccagcagcagccaggaccagagcaaggtgtctgcccctggggtgctgacagcccaggacagagtggtgggcaagccagcccagctgggcacccagaggagccaggaggctgatgtgcaggactgggagttcaggaagagggacagccagggcacctacagcagcagagatgctgagctgcaggaccaggagtttgggaagagggacagcctgggcacctacagcagcagagatgtgtccctgggggactgggagtttgggaagagggacagcctgggcgcctatgccagccaggatgccaatgagcagggccaggacctgggcaagagggaccaccacggccgctacagcagccaggatgctgatgagcaggactgggagttccagaagagagatgtgtccctgggcacctacggcagcagagctgctgagccccaggagcaggagtttgggaagagcgcctggatccgggactacagcagcggcggcagcagcaggaccctggatgcccaggacaggagctttggcacccggcccctgagcagcggcttcagccctgaggaggcccagcagcaggatgaggagtttgagaagaagatccccagcgtggaggacagcctgggggagggcagcagagatgctggccggcctggagagcggggcagcggcggcctcttcagccccagcacagcccacgtgcctgatggagccctgggccagagggaccagagctcctggcagaacagtgatgccagccaggaggtgggcggccaccaggagcggcagcaggccggggcccagggccctggcagcgctgacctggaggatggagagatgggcaagaggggctgggtgggggagttcagcctgtctgtgggcccccagcgggaggccgccttcagccctggccagcaggactggagccgggacttctgcatcgaggccagcgagaggagctaccagtttggcatcattggaaatgacagagtgtctggagctggcttcagccccagcagcaagatggagggcggccactttgtgcccccaggcaagaccacagctggctctgtggactggacagaccagctgggcctgaggaacctggaggtgagcagctgtgtgggcagcggcggcagcagcgaggcccgggagagcgctgtgggccagatgggctggagcggcggcctgagcctgcgggacatgaacctgaccggctgcctggagagcggcggcagcgaggagcccggcggcatcggcgtgggggagaaggactggaccagtgatgtgaatgtgaagagcaaggacctggccgaggtgggggagggcggcggccacagccaggcccgggagagcggcgtgggccagacagactggagcggcgtggaggccggggagttcctgaagagccgggagcggggcgtgggccaggccgactggaccccagacctgggcctgaggaacatggcccctggagctgtgtgcagccctggagagagcaaggagctgggcgtgggccagatggactggggcaacaacctgggcctgcgggacctggaggtgacctgtgaccctgacagcggcggcagccagggcctgcggggctgcggcgtgggccagatggactggacccaggacctggccccccagaatgtggagctgtttggagcccccagcgaggcccgggagcacggcgtgggcggcgtgtcccagtgcccagagcccggcctgcggcacaacggcagcctgagccctggcctggaggcccgggaccccctggaggcccgggagctgggcgtgggggagaccagcggccctgagacccagggcgaggactacagcagcagcagcctggagccccaccctgctgaccccggcatggagaccggggaggccctgagctttggagccagccctggccgctgcccagcccggcccccacccagcggcagccagggcctgctggaggagatgctggccgccagcagcagcaaggctgtggcccggcgggagagcgctgccagcggcctgggcggcctgctggaggaggagggcgctggggccggggccgcccaggaggaggtgctggagcccggccgggacagcccccccagctggaggccccagccagatggagaggccagccagacagaagatgtggatggcacctggggcagcagcgctgcccgctggagcgaccagggccctgcccagaccagccggcggcccagccagggccccccagcccggagccccagccaggacttctccttcatcgaggacacagagatcctggacagcgccatgtaccgcagccgggccaacctgggcaggaagaggggccaccgggcccctgtgatccggcctgggggcaccctgggcctgtctgaggccgctgacagtgatgcccacctgttccaggacagcacagagccccgggccagccgggtgcccagcagtgatgaggaggtggtggaggagccccagagcaggaggaccaggatgagcctgggcaccaagggcctgaaggtgaacctcttccctggcctgagccccagcgccctgaaggccaagctgcggcccaggaacagatctgctgaggagggggagctggccgagagcaagagcagccagaaggagagcgctgtgcagaggagcaagagctgcaaggtgcccggcctgggcaagcccctgaccctgccccccaagccagagaagagcagcggcagcgagggcagcagccccaactggctgcaggccctgaagctgaagaagaagaaggtgtag

SEQ ID NO: 172600 - DNA, 432 bp, Artificial Sequence
  Description of Artificial Sequence: Synthetic coding sequence
atgaaggtgtccaccctgcgggagagcagcgccatggccagccccctgccccgggagatggaggaggagctggtgcccactggaagtgagcccggggacacccgggccaagccccctgtgaagcccaagccccgggccctgcctgccaagccagccctgcctgccaagcccagcctgctggtgcctgtgggccccaggcctccccggggccccctggccgagctgcccagcgccaggaagatgaacatgctggccggcccccagccctacggcggcagcaagaggcccctgccctttgcccccaggcctgctgtggaggccagcactggaggagaggccacccaggagaccgggaaggaggaggccggcaaggaggagcccccacccctgaccccaccagcccgctgtgccgcccctggaggagtgaggtag

SEQ ID NO: 172601 - DNA, 5190 bp, Artificial Sequence; identical to SEQ ID NO: 172599
  Description of Artificial Sequence: Synthetic coding sequence

SEQ ID NO: 172602 - DNA, 3006 bp, Artificial Sequence
  Description of Artificial Sequence: Synthetic coding sequence
atgcccagcaccaacagagctggcagcctgaaggaccctgagattgctgagctgttcttcaaggaggaccctgagaagctgttcacagacctgcgggagatcggccacggcagctttggagctgtgtactttgccagagatgtgaggaccaatgaggtggtggccatcaagaagatgagctacagcggcaagcagagcacagagaagtggcaggacatcatcaaggaggtgaagttcctgcagaggatcaagcaccccaacagcattgagtacaagggctgctacctgcgggagcacacagcctggctggtgatggagtactgcctgggcagcgccagtgacctgctggaggtgcacaagaagcccctgcaggaggtggagattgctgccatcacccatggagccctgcagggcctggcctacctgcacagccacaccatgatccaccgggacatcaaggccggcaacatcctgctgacagagcccggccaggtgaagctggccgactttggcagcgcctccatggccagccctgccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccccaccctgcagagcaatgagtggagcgactacttcaggaactttgtggacagctgcctgcagaagatcccccaggaccggcccaccagcgaggagctgctgaagcacatctttgtgctgcgggagaggcctgagaccgtgctgattgacctgatccagaggaccaaggatgctgtgcgggagctggacaacctgcagtacaggaagatgaagaagctgctcttccaggaggcccacaacggccctgctgtggaggcccaggaggaggaggaggagcaggaccatggagtgggccgcacaggcaccgtgaacagcgtgggcagcaaccagagcatccccagcatgagcatcagcgccagcagccagagcagctctgtgaacagcctgcctgatgtgtctgatgacaagtctgagctggacatgatggagggggaccacacagtgatgagcaacagcagcgtcatccacctgaagccagaggaggagaactaccgggaggagggggaccccaggacccgggccagtgacccccagagccccccccaggtgagccgccacaagagccactacagaaaccgggagcactttgccaccatcagaacagccagcctggtgacccggcagatgcaggagcacgagcaggacagcgagctgcgggagcagatgagcggctacaagaggatgaggcggcagcaccagaagcagctgatgaccctggagaacaagctgaaggccgagatggatgagcaccggctgcggctggacaaggacctggagacccagaggaacaactttgctgctgagatggagaagctgatcaagaagcaccaggccgccatggagaaggaggccaaggtgatgagcaatgaggagaagaagttccagcagcacatccaggcccagcagaagaaggagctgaacagcttcctggagagccagaagcgggagtacaagctgaggaaggagcagctgaaggaggagctgaatgaaaaccagagcacccccaagaaggagaagcaggagtggctgagcaagcagaaggagaacatccagcacttccaggccgaggaggaggccaacctgctgcggcggcagaggcagtacctggagctggagtgccgccgcttcaagaggaggatgctgctgggccgccacaacctggagcaggacctggtgcgggaggagctgaacaagaggcagacccagaaggacctggagcacgccatgctgctgcggcagcacgagagcatgcaggagctggagttccgccacctgaacaccatccagaagatgagatgtgagctgatccggctgcagcaccagacagagctgaccaaccagctggagtacaacaagagaagagagcgggagctgcggaggaagcacgtgatggaggtgcggcagcagcccaagagcctgaagagcaaggagctgcagatcaagaagcagttccaggacacctgcaagatccagacccggcagtacaaggccctgaggaaccacctgctggagaccacccccaagtctgagcacaaggctgtgctgaagaggctgaaggaggagcagaccaggaagctggccatcctggccgagcagtatgaccacagcatcaatgagatgctgagcacccaggccctgcggctggatgaggcccaggaggccgagtgccaggtgctgaagatgcagctgcagcaggagctggagctgctgaatgcctaccagagcaagatcaagatgcaggccgaggcccagcacgaccgggagctgcgggagctggagcagagggtgtccctgcggcgggccctgctggagcagaagattgaggaggagatgctggccctgcagaatgaaagaacagagcgcatccgcagcctgctggagcggcaggcccgggagattgaggcctttgacagcgagagcatgaggctgggcttcagcaacatggtgctgagcaacctgagccctgaggccttcagccacagctacccaggggccagcggctggagccacaaccccactggaggccctggcccccactggggccaccccatgggcggccccccccaggcctggggccaccccatgcagggcggcccccagccctggggccaccccagcggccccatgcagggcgtgccccggggcagctccatgggcgtgaggaacagcccccaggccctgcggaggacagccagcggcggccgcacagagcagggcatgagccgcagcacctctgtgaccagccagatcagcaatggcagccacatgagctacacctag

SEQ ID NO: 172603 - DNA, 2562 bp, Artificial Sequence
  Description of Artificial Sequence: Synthetic coding sequence
atgcccagcaccaacagagctggcagcctgaaggaccctgagattgctgagctgttcttcaaggaggaccctgagaagctgttcacagacctgcgggagatcggccacggcagctttggagctgtgtactttgccagagatgtgaggaccaatgaggtggtggccatcaagaagatgagctacagcggcaagcagagcacagagaagtggcaggacatcatcaaggaggtgaagttcctgcagaggatcaagcaccccaacagcattgagtacaagggctgctacctgcgggagcacacagcctggctggtgatggagtactgcctgggcagcgccagtgacctgctggaggtgcacaagaagcccctgcaggaggtggagattgctgccatcacccatggagccctgcagggcctggcctacctgcacagccacaccatgatccaccgggacatcaaggccggcaacatcctgctgacagagcccggccaggtgaagctggccgactttggcagcgcctccatggccagccctgccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccccaccctgcagagcaatgagtggagcgactacttcaggaactttgtggacagctgcctgcagaagatcccccaggaccggcccaccagcgaggagctgctgaagcacatctttgtgctgcgggagaggcctgagaccgtgctgattgacctgatccagaggaccaaggatgctgtgcgggagctggacaacctgcagtacaggaagatgaagaagctgctcttccaggaggcccacaacggccctgctgtggaggcccaggaggaggaggaggagcaggaccatggagtgggccgcacaggcaccgtgaacagcgtgggcagcaaccagagcatccccagcatgagcatcagcgccagcagccagagcagctctgtgaacagcctgcctgatgtgtctgatgacaagtctgagctggacatgatggagggggaccacacagtgatgagcaacagcagcgtcatccacctgaagccagaggaggagaactaccgggaggagggggaccccaggacccgggccagtgacccccagagccccccccaggtgagccgccacaagagccactacagaaaccgggagcactttgccaccatcagaacagccagcctggtgacccggcagatgcaggagcacgagcaggacagcgagctgcgggagcagatgagcggctacaagaggatgaggcggcagcaccagaagcagctgatgaccctggagaacaagctgaaggccgagatggatgagcaccggctgcggctggacaaggacctggagacccagaggaacaactttgctgctgagatggagaagctgatcaagaagcaccaggccgccatggagaaggaggccaaggtgatgagcaatgaggagaagaagttccagcagcacatccaggcccagcagaagaaggagctgaacagcttcctggagagccagaagcgggagtacaagctgaggaaggagcagctgaaggagagcaaggagctgcagatcaagaagcagttccaggacacctgcaagatccagacccggcagtacaaggccctgaggaaccacctgctggagaccacccccaagtctgagcacaaggctgtgctgaagaggctgaaggaggagcagaccaggaagctggccatcctggccgagcagtatgaccacagcatcaatgagatgctgagcacccaggccctgcggctggatgaggcccaggaggccgagtgccaggtgctgaagatgcagctgcagcaggagctggagctgctgaatgcctaccagagcaagatcaagatgcaggccgaggcccagcacgaccgggagctgcgggagctggagcagagggtgtccctgcggcgggccctgctggagcagaagattgaggaggagatgctggccctgcagaatgaaagaacagagcgcatccgcagcctgctggagcggcaggcccgggagattgaggcctttgacagcgagagcatgaggctgggcttcagcaacatggtgctgagcaacctgagccctgaggccttcagccacagctacccaggggccagcggctggagccacaaccccactggaggccctggcccccactggggccaccccatgggcggccccccccaggcctggggccaccccatgcagggcggcccccagccctggggccaccccagcggccccatgcagggcgtgccccggggcagctccatgggcgtgaggaacagcccccaggccctgcggaggacagccagcggcggccgcacagagcagggcatgagccgcagcacctctgtgaccagccagatcagcaatggcagccacatgagctacacctag

SEQ ID NO: 172604 - DNA, 3150 bp, Artificial Sequence
  Description of Artificial Sequence: Synthetic coding sequence
atgcctgctgggggccgggccggcagcctgaaggaccctgatgtggccgagctgttcttcaaggatgatcctgagaagctgttcagtgacctgcgggagatcggccacggcagctttggagctgtgtactttgccagagatgtgagaaattctgaggtggtggccatcaagaagatgagctacagcggcaagcagagcaatgagaagtggcaggacatcatcaaggaggtgcgcttcctgcagaagctgcggcaccccaacaccatccagtaccggggctgctacctgcgggagcacacagcctggctggtgatggagtactgcctgggcagcgccagtgacctgctggaggtgcacaagaagcccctgcaggaggtggagattgctgctgtgacccatggagccctgcagggcctggcctacctgcacagccacaacatgatccacagagatgtgaaggccggcaacatcctgctgtctgagcccggcctggtgaagctgggggactttggcagcgccagcatcatggccccagccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccctgtgctgcagagcggccactggagcgagtacttcaggaactttgtggacagctgcctgcagaagatcccccaggaccggcccaccagcgaggtgctgctgaagcacagatttgtgctgcgggagcggccccccaccgtcatcatggacctgatccagaggaccaaggatgctgtgcgggagctggacaacctgcagtacaggaagatgaagaagatcctcttccaggaggcccccaacggccctggagctgaggcccctgaggaggaggaggaggccgagccctacatgcaccgggccggcaccctgaccagcctggagagcagccacagcgtgcccagcatgagcatcagcgccagcagccagagcagctctgtgaacagcctggctgatgccagtgacaatgaggaggaggaggaggaggaggaggaggaggaggaggaggaggagggccctgaggcccgggagatggccatgatgcaggagggggagcacacagtgaccagccacagcagcatcatccaccggctgcccggcagtgacaacctgtatgatgacccctaccagcctgagatcacccccagccccctgcagcccccagctgccccagcccccaccagcaccaccagcagcgcccggcggcgggcctactgcaggaacagagaccactttgccaccatcagaacagccagcctggtgtcccggcagatccaggagcacgagcaggacagcgccctgcgggagcagctgagcggctacaagaggatgaggcggcagcaccagaagcagctgctggccctggagagccggctgcggggggagcgggaggagcacagcgcccggctgcagcgggagctggaggcccagagagctggctttggagctgaggccgagaagctggcccggcggcaccaggccatcggggagaaggaggcccgggccgcccaggccgaggagaggaagttccagcagcacatcctgggccagcagaagaaggagctggccgccctgctggaggcccagaagaggacctacaagctgaggaaggagcagctgaaggaggagctgcaggagaaccccagcacccccaagcgggagaaggccgagtggctgctgcggcagaaggagcagctgcagcagtgccaggccgaggaggaggccggcctgctgcggcggcagaggcagtactttgagctgcagtgccggcagtacaagaggaagatgctgctggcccggcacagcctggaccaggacctgctgcgggaggacctgaacaagaagcagacccagaaggacctggagtgtgccctgctgctgcggcagcacgaggccacccgggagctggagctgcggcagctgcaggccgtgcagaggaccagggctgagctgacccggctgcagcaccagacagagctgggcaaccagctggagtacaacaagagaagagagcaggagctgcggcagaagcatgctgcccaggtgcggcagcagcccaagagcctgaagagcaaggagctgcagatcaagaagcagttccaggagacctgcaagatccagacccggcagtacaaggccctgcgggcccacctgctggagaccacccccaaggcccagcacaagagcctgctgaagaggctgaaggaggagcagaccaggaagctggccatcctggccgagcagtatgaccagagcatcagcgagatgctgagcagccaggccctgcggctggatgagacccaggaggccgagttccaggccctgcggcagcagctgcagcaggagctggagctgctgaatgcctaccagagcaagatcaagatcagaacagagagccagcacgagcgggagctgcgggagctggagcagagggtggccctgcggcgggccctgctggagcagagggtggaggaggagctgctggccctgcagacaggccgctctgagcgcatccgcagcctgctggagcggcaggcccgggagattgaggcctttgatgctgagagcatgaggctgggcttcagctccatggccctgggcggcatcccagctgaggccgccgcccagggctacccagcccctcctccagccccagcctggcccagcaggcctgtgcccaggtctggggcccactggagccacggccccccacctcctggcatgcctcctccagcctggaggcagcccagcctgctggcccctcctggcccccccaactggctgggcccccccacccagagcggcaccccccggggcggggccctgctgctgctgaggaacagcccccagcccctgcggcgggccgccagcggcggcagcggctctgaaaatgtgggccccccagctgctgctgtgcccggccccctgagccgcagcacctctgtggccagccacatcctgaatggcagcagccacttctacagctag

SEQ ID NO: 172605 - DNA, 3708 bp, Artificial Sequence
  Description of Artificial Sequence: Synthetic coding sequence
atgcctgctgggggccgggccggcagcctgaaggaccctgatgtggccgagctgttcttcaaggatgatcctgagaagctgttcagtgacctgcgggagatcggccacggcagctttggagctgtgtactttgccagagatgtgagaaattctgaggtggtggccatcaagaagatgagctacagcggcaagcagagcaatgagaagtggcaggacatcatcaaggaggtgcgcttcctgcagaagctgcggcaccccaacaccatccagtaccggggctgctacctgcgggagcacacagcctggctggtgatggagtactgcctgggcagcgccagtgacctgctggaggtgcacaagaagcccctgcaggaggtggagattgctgctgtgacccatggagccctgcagggcctggcctacctgcacagccacaacatgatccacagagatgtgaaggccggcaacatcctgctgtctgagcccggcctggtgaagctgggggactttggcagcgccagcatcatggccccagccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccctgtgctgcagagcggccactggagcgagtacttcaggaactttgtggacagctgcctgcagaagatcccccaggaccggcccaccagcgaggtgctgctgaagcacagatttgtgctgcgggagcggccccccaccgtcatcatggacctgatccagaggaccaaggatgctgtgcgggagctggacaacctgcagtacaggaagatgaagaagatcctcttccaggaggcccccaacggccctggagctgaggcccctgaggaggaggaggaggccgagccctacatgcaccgggccggcaccctgaccagcctggagagcagccacagcgtgcccagcatgagcatcagcgccagcagccagagcagctctgtgaacagcctggctgatgccagtgacaatgaggaggaggaggaggaggaggaggaggaggaggaggaggaggagggccctgaggcccgggagatggccatgatgcaggagggggagcacacagtgaccagccacagcagcatcatccaccggctgcccggcagtgacaacctgtatgatgacccctaccagcctgagatcacccccagccccctgcagcccccagctgccccagcccccaccagcaccaccagcagcgcccggcggcgggcctactgcaggaacagagaccactttgccaccatcagaacagccagcctggtgtcccggcagatccaggagcacgagcaggacagcgccctgcgggagcagctgagcggctacaagaggatgaggcggcagcaccagaagcagctgctggccctggagagccggctgcggggggagcgggaggagcacagcgcccggctgcagcgggagctggaggcccagagagctggctttggagctgaggccgagaagctggcccggcggcaccaggccatcggggagaaggaggcccgggccgcccaggccgaggagaggaagttccagcagcacatcctgggccagcagaagaaggagctggccgccctgctggaggcccagaagaggacctacaagctgaggaaggagcagctgaaggaggagctgcaggagaaccccagcacccccaagcgggagaaggccgagtggctgctgcggcagaaggagcagctgcagcagtgccaggccgaggaggaggccggcctgctgcggcggcagaggcagtactttgagctgcagtgccggcagtacaagaggaagatgctgctggcccggcacagcctggaccaggacctgctgcgggaggacctgaacaagaagcagacccagaaggacctggagtgtgccctgctgctgcggcagcacgaggccacccgggagctggagctgcggcagctgcaggccgtgcagaggaccagggctgagctgacccggctgcagcaccagacagagctgggcaaccagctggagtacaacaagagaagagagcaggagctgcggcagaagcatgctgcccaggtgcggcagcagcccaagagcctgaaggtgcgggccggccagaggcctcctggcctgcccctgcccatccctggggccctgggcccccccaacacaggcacccccatcgagcagcagccctgcagccctggccaggaggccgtgctggaccagaggatgctgggggaggaggaggaggccgtgggggagcggcgcatcctgggcaaggagggcgccaccctggagcccaagcagcagaggatcctgggggaggagagcggggcccccagccccagcccccagaagcacggcagcctggtggatgaggaggtgtggggcctgcctgaggagattgaggagctgcgggtgcccagcctggtgccccaggagaggagcatcgtgggccaggaggaggccggcacctggagcctgtggggcaaggaggatgagagcctgctggatgaggagtttgagctgggctgggtgcagggccctgccctgacccctgtgcctgaggaggaggaggaggaggaggagggcgcccccatcggcaccccccgggaccctggagatggctgccccagcccagacatccccccagagcccccacccacccacctgcggccctgcccagccagccagctgcccggcctgctgagccacggcctgctggccggcctgagctttgctgtgggcagcagcagcggcctgctgcccctgctgctgctgctgctgctgcccctgctggccgcccagggcggcggcggcctgcaggccgccctgctggccctggaggtgggcctggtgggcctgggcgccagctacctgctgctgtgcacagccctgcacctgcccagcagcctcttcctgctgctggcccagggcacagccctgggcgctgtgctgggcctgtcctggaggcggggcctgatgggcgtgcccctgggcctgggcgccgcctggctgctggcctggccaggcctggccctgcccctggtggccatggctgctgggggccgctgggtgcggcagcagggcccccgggtgcggcggggcatcagccggctgtggctgcgggtgctgctgcggctgagccccatggccttccgggccctgcagggctgtggggctgtgggggaccggggcctgtttgccctgtaccccaagaccaacaaggatggcttccgcagccggctgcctgtgcccggccccaggagaagaaaccccaggaccacccagcaccccctggccctgctggcccgggtgtgggtgctgtgcaagggctggaactggaggctggcccgggccagccagggcctggccagccacctgcccccctgggccatccacaccctggcctcctggggcctgctgcggggggagcggcccacccgcatcccccggctgctgcccaggagccagaggcagctgggccccccagccagccggcagcccctgcccggcaccctggccggcagaagaagcaggacccggcagagccgggccctgcccccctggaggtag

SEQ ID NO: 172606 - DNA, 2268 bp, Artificial Sequence
  Description of Artificial Sequence: Synthetic coding sequence
atgcctgctgggggccgggccggcagcctgaaggaccctgatgtggccgagctgttcttcaaggatgatcctgagaagctgttcagtgacctgcgggagatcggccacggcagctttggagctgtgtactttgccagagatgtgagaaattctgaggtggtggccatcaagaagatgagctacagcggcaagcagagcaatgagaagtggcaggacatcatcaaggaggtgcgcttcctgcagaagctgcggcaccccaacaccatccagtaccggggctgctacctgcgggagcacacagcctggctggtgatggagtactgcctgggcagcgccagtgacctgctggaggtgcacaagaagcccctgcaggaggtggagattgctgctgtgacccatggagccctgcagggcctggcctacctgcacagccacaacatgatccacagagatgtgaaggccggcaacatcctgctgtctgagcccggcctggtgaagctgggggactttggcagcgccagcatcatggccccagccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccctgtgctgcagagcggccactggagcgagtacttcaggaactttgtggacagctgcctgcagaagatcccccaggaccggcccaccagcgaggtgctgctgaagcacagatttgtgctgcgggagcggccccccaccgtcatcatggacctgatccagaggaccaaggatgctgtgcgggagctggacaacctgcagtacaggaagatgaagaagatcctcttccaggaggcccccaacggccctggagctgaggcccctgaggaggaggaggaggccgagccctacatgcaccgggccggcaccctgaccagcctggagagcagccacagcgtgcccagcatgagcatcagcgccagcagccagagcagctctgtgaacagcctggctgatgccagtgacaatgaggaggaggaggaggaggaggaggaggaggaggaggaggaggagggccctgaggcccgggagatggccatgatgcaggagggggagcacacagtgaccagccacagcagcatcatccaccggctgcccggcagtgacaacctgtatgatgacccctaccagcctgagatcacccccagccccctgcagcccccagctgccccagcccccaccagcaccaccagcagcgcccggcggcgggcctactgcaggaacagagaccactttgccaccatcagaacagccagcctggtgtcccggcagatccaggagcacgagcaggacagcgccctgcgggagcagctgagcggctacaagaggatgaggcggcagcaccagaagcagctgctggccctggagagccggctgcggggggagcgggaggagcacagcgcccggctgcagcgggagctggaggcccagagagctggctttggagctgaggccgagaagctggcccggcggcaccaggccatcggggagaaggaggcccgggccgcccaggccgaggagaggaagttccagcagcacatcctgggccagcagaagaaggagctggccgccctgctggaggcccagaagaggacctacaagctgaggaaggagcagctgaaggaggagctgcaggagaaccccagcacccccaagcgggagaaggccgagtggctgctgcggcagaaggagcagctgcagcagtgccaggccgaggaggaggccggcctgctgcggcggcagaggcagtactttgagctgcagtgccggcagtacaagaggaagatgctgctggcccggcacagcctggaccaggacctgctgcgggaggacctgaacaagaagcagacccagaaggacctggagtgtgccctgctgctgcggcagcacgaggccacccgggagctggagctgcggcagctgcaggccgtgcagaggaccagggctgagctgacccggctgcagcaccagacagagctgggcaaccagctggagtacaacaagagaagagagcaggagctgcggcagaagcatgctgcccaggtgcggcagcagcccaagagcctgaagaagaagaccaacaccaacaagatcagcgagaggtag

SEQ ID NO: 172607 - DNA, 3369 bp, Artificial Sequence
  Description of Artificial Sequence: Synthetic coding sequence
atgcctgctgggggccgggccggcagcctgaaggaccctgatgtggccgagctgttcttcaaggatgatcctgagaagctgttcagtgacctgcgggagatcggccacggcagctttggagctgtgtactttgccagagatgtgagaaattctgaggtggtggccatcaagaagatgagctacagcggcaagcagagcaatgagaagtggcaggacatcatcaaggaggtgcgcttcctgcagaagctgcggcaccccaacaccatccagtaccggggctgctacctgcgggagcacacagcctggctggtgatggagtactgcctgggcagcgccagtgacctgctggaggtgcacaagaagcccctgcaggaggtggagattgctgctgtgacccatggagccctgcagggcctggcctacctgcacagccacaacatgatccacagagatgtgaaggccggcaacatcctgctgtctgagcccggcctggtgaagctgggggactttggcagcgccagcatcatggccccagccaacagctttgtgggcaccccctactggatggcccctgaggtgatcctggccatggatgagggccagtatgatggcaaggtggatgtgtggagcctgggcatcacctgcatcgagctggccgagaggaagcccccactcttcaacatgaatgccatgtctgccctgtaccacatcgcccagaatgaaagccctgtgctgcagagcggccactggagcgagtacttcaggaactttgtggacagctgcctgcagaagatcccccaggaccggcccaccagcgaggtgctgctgaagcacagatttgtgctgcgggagcggccccccaccgtcatcatggacctgatccagaggaccaaggatgctgtgcgggagctggacaacctgcagtacaggaagatgaagaagatcctcttccaggaggcccccaacggccctggagctgaggcccctgaggaggaggaggaggccgagccctacatgcaccgggccggcaccctgaccagcctggagagcagccacagcgtgcccagcatgagcatcagcgccagcagccagagcagctctgtgaacagcctggctgatgccagtgacaatgaggaggaggaggaggaggaggaggaggaggaggaggaggaggagggccctgaggcccgggagatggccatgatgcaggagggggagcacacagtgaccagccacagcagcatcatccaccggctgcccggcagtgacaacctgtatgatgacccctaccagcctgagatcacccccagccccctgcagcccccagctgccccagcccccaccagcaccaccagcagcgcccggcggcgggcctactgcaggaacagagaccactttgccaccatcagaacagccagcctggtgtcccggcagatccaggagcacgagcaggacagcgccctgcgggagcagctgagcggctacaagaggatgaggcggcagcaccagaagcagctgctggccctggagagccggctgcggggggagcgggaggagcacagcgcccggctgcagcgggagctggaggcccagagagctggctttggagctgaggccgagaagctggcccggcggcaccaggccatcggggagaaggaggcccgggccgcccaggccgaggagaggaagttccagcagcacatcctgggccagcagaagaaggagctggccgccctgctggaggcccagaagaggacctacaagctgaggaaggagcagctgaaggaggagctgcaggagaaccccagcacccccaagcgggagaaggccgagtggctgctgcggcagaaggagcagctgcagcagtgccaggccgaggaggaggccggcctgctgcggcggcagaggcagtactttgagctgcagtgccggcagtacaagaggaagatgctgctggcccggcacagcctggaccaggacctgctgcgggaggacctgaacaagaagcagacccagaaggacctggagtgtgccctgctgctgcggcagcacgaggccacccgggagctggagctgcggcagctgcaggccgtgcagaggaccagggctgagctgacccggctgcagcaccagacagagctgggcaaccagctggagtacaacaagagaagagagcaggagctgcggcagaagcatgctgcccaggtgcggcagcagcccaagagcctgaaggagaggagcatcgtgggccaggaggaggccggcacctggagcctgtggggcaaggaggatgagagcctgctggatgaggagtttgagctgggctgggtgcagggccctgccctgacccctgtgcctgaggaggaggaggaggaggaggagggcgcccccatcggcaccccccgggaccctggagatggctgccccagcccagacatccccccagagcccccacccacccacctgcggccctgcccagccagccagctgcccggcctgctgagccacggcctgctggccggcctgagctttgctgtgggcagcagcagcggcctgctgcccctgctgctgctgctgctgctgcccctgctggccgcccagggcggcggcggcctgcaggccgccctgctggccctggaggtgggcctggtgggcctgggcgccagctacctgctgctgtgcacagccctgcacctgcccagcagcctcttcctgctgctggcccagggcacagccctgggcgctgtgctgggcctgtcctggaggcggggcctgatgggcgtgcccctgggcctgggcgccgcctggctgctggcctggccaggcctggccctgcccctggtggccatggccgccggcggccgctgggtgcggcagcagggcccccgggtgagaagaggcatcagccggctgtggctgcgggtgctgctgcggctgagccccatggccttccgggccctgcagggctgtggggctgtgggggaccggggcctgtttgccctgtaccccaagaccaacaaggatggcttccgcagccggctgcctgtgcccggccccaggagaagaaaccccaggaccacccagcaccccctggccctgctggcccgggtgtgggtgctgtgcaagggctggaactggaggctggcccgggccagccagggcctggccagccacctgcccccctgggccatccacaccctggcctcctggggcctgctgcggggggagcggcccacccgcatcccccggctgctgcccaggagccagaggcagctgggccccccagccagccggcagcccctgcccggcaccctggccggccgccgcagcaggacccggcagagccgggccctgcccccctggaggtag

SEQ ID NO: 172608 - DNA, 1401 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggagatgggcttccaccacgtgggccaggccgccctggagctgctgacctctgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagaaggccgagtag

SEQ ID NO: 172609 - DNA, 1347 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagaaggccgagtag

SEQ ID NO: 172610 - DNA, 1515 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaaggtgcagtgcagcaccagcctgtacctgagcctggtgaccctgagcccccaccccatcagcaagcccatggagggcggctgctggtgtggccggcagaacctgggcctggagttcaccctcatctgggtgaagacctggcactacatcctgactgtgggcctgtttgagcacgccacctag

SEQ ID NO: 172611 - DNA, 1347 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagaaggccgagtag

SEQ ID NO: 172612 - DNA, 1401 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggagatgggcttccaccacgtgggccaggccgccctggagctgctgacctctgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagaaggccgagtag

SEQ ID NO: 172613 - DNA, 1515 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaaggtgcagtgcagcaccagcctgtacctgagcctggtgaccctgagcccccaccccatcagcaagcccatggagggcggctgctggtgtggccggcagaacctgggcctggagttcaccctcatctgggtgaagacctggcactacatcctgactgtgggcctgtttgagcacgccacctag

SEQ ID NO: 172614 - DNA, 1347 bp, Artificial Sequence; identical to SEQ ID NO: 172609
  Description of Artificial Sequence: Synthetic coding sequence

SEQ ID NO: 172615 - DNA, 1515 bp, Artificial Sequence; identical to SEQ ID NO: 172613
  Description of Artificial Sequence: Synthetic coding sequence

SEQ ID NO: 172616 - DNA, 1401 bp, Artificial Sequence; identical to SEQ ID NO: 172608
  Description of Artificial Sequence: Synthetic coding sequence

SEQ ID NO: 172617 - DNA, 1347 bp, Artificial Sequence; identical to SEQ ID NO: 172609
  Description of Artificial Sequence: Synthetic coding sequence

SEQ ID NO: 172618 - DNA, 1515 bp, Artificial Sequence; identical to SEQ ID NO: 172610
  Description of Artificial Sequence: Synthetic coding sequence

SEQ ID NO: 172619 - DNA, 609 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcacgtggtgctgactgtgctgacccacaccccagccccccgggtgcggctgggccaggatgccctgctggacctgagctttgcctacatgccacccaccagcgaggccgccagcagcctggcccctggccccccaccatttggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtactag

SEQ ID NO: 172620 - DNA, 1347 bp, Artificial Sequence; identical to SEQ ID NO: 172611
  Description of Artificial Sequence: Synthetic coding sequence

SEQ ID NO: 172621 - DNA, 1401 bp, Artificial Sequence; identical to SEQ ID NO: 172608
  Description of Artificial Sequence: Synthetic coding sequence

SEQ ID NO: 172622 - DNA, 609 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcacgtggtgctgactgtgctgacccacaccccagccccccgggtgcggctgggccaggatgccctgctggacctgagctttgcctacatgccacccaccagcgaggccgccagcagcctggcccctggccccccaccatttggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtactag

SEQ ID NO: 172623 - DNA, 609 bp, Artificial Sequence; identical to SEQ ID NO: 172619
  Description of Artificial Sequence: Synthetic coding sequence

SEQ ID NO: 172624 - DNA, 609 bp, Artificial Sequence; identical to SEQ ID NO: 172619
  Description of Artificial Sequence: Synthetic coding sequence

SEQ ID NO: 172625 - DNA, 1347 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagcacgccacctag

SEQ ID NO: 172626 - DNA, 1515 bp, Artificial Sequence; identical to SEQ ID NO: 172613
  Description of Artificial Sequence: Synthetic coding sequence

SEQ ID NO: 172627 - DNA, 471 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagctccatgggccacgccatgcctgtggagttcaccatcccagcctgcctgcccagaggagctgccctgcggagcccctggaggtag

SEQ ID NO: 172628 - DNA, 1401 bp, Artificial Sequence; identical to SEQ ID NO: 172612
  Description of Artificial Sequence: Synthetic coding sequence

SEQ ID NO: 172629 - DNA, 1086 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcacgtggtgctgactgtgctgacccacaccccagccccccgggtgcggctgggccaggatgccctgctggacctgagctttgcctacatgccacccaccagcgaggccgccagcagcctggcccctggccccccaccatttggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgcccaccgtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagaaggccgagtag

SEQ ID NO: 172630 - DNA, 1347 bp, Artificial Sequence; identical to SEQ ID NO: 172625
  Description of Artificial Sequence: Synthetic coding sequence

SEQ ID NO: 172631 - DNA, 471 bp, Artificial Sequence; identical to SEQ ID NO: 172627
  Description of Artificial Sequence: Synthetic coding sequence

SEQ ID NO: 172632 - DNA, 1086 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcacgtggtgctgactgtgctgacccacaccccagccccccgggtgcggctgggccaggatgccctgctggacctgagctttgcctacatgccacccaccagcgaggccgccagcagcctggcccctggccccccaccatttggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagcacgccacctag

SEQ ID NO: 172633 - DNA, 1347 bp, Artificial Sequence
  Description of Artificial Sequence: Synthetic coding sequence
atgaagagcctgagcctgctgctggccgtggccctgggcctggccacagctgtgtctgctggccctgctgtgattgagtgctggtttgtggaggatgccagcggcaagggcctggccaagaggcctggggccctgctgctgcggcagggccctggagagcccccacccaggccagacctggaccctgagctgtacctgtctgtgcatgaccctgctggggccctgcaggccgccttccgccgctaccccaggggggccccagccccccactgtgagatgagcagatttgtgcccctgcctgccagcgccaagtgggccagcggcctgaccccagcccagaactgcccccgggccctggatggagcctggctgatggtgtccatcagcagccctgtgctgagcctgagcagcctgctgcggccccagcctgagccccagcaggagcctgtgctgatcaccatggccaccgtggtgctgactgtgctgacccacaccccagccccccgggtgcggctgggccaggatgccctgctggacctgagctttgcctacatgccacccaccagcgaggccgccagcagcctggcccctggccccccacccttcggcctggagtggaggcggcagcacctgggcaagggccacctgctgctggccgccaccccaggcctgaatggccagatgcctgctgcccaggagggcgctgtggcctttgctgcctgggatgatgatgagccctggggcccctggacaggaaatggcaccttctggctgccccgggtgcagcccttccaggagggcacctacctggccaccatccacctgccctacctgcagggccaggtgaccctggagctggccgtgtacaagccacccaaggtgtccctgatgcctgccaccctggcccgggccgcccctggagaggcccctcctgagctgctgtgcctggtgagccacttctaccccagcggcggcctggaggtggagtgggagctgcggggcggccctgggggccgcagccagaaggccgagggccagcgctggctgagcgccctgcggcaccacagtgatggctctgtgtccctgagcggccacctgcagcccccacctgtgaccacagagcagcacggggcccgctatgcctgccgcatccaccaccccagcctgcctgccagcggccgctctgctgaggtgaccctggaggtggccggcctgagcggccccagcctggaggacagcgtgggcctcttcctgagcgccttcctgctgctgggcctcttcaaggccctgggctgggccgctgtgtacctgagcacctgcaaggacagcaagaagcacgccacctag

SEQ ID NO: 172634 - DNA, 1086 bp, Artificial Sequence; identical to SEQ ID NO: 172632
  Description of Artificial Sequence: Synthetic coding sequence

SEQ ID NO: 172635 - DNA, 471 bp, Artificial Sequence; identical to SEQ ID NO: 172627
  Description of Artificial Sequence: Synthetic coding sequence

SEQ ID NO: 172636 - DNA, 1347 bp, Artificial Sequence; identical to SEQ ID NO: 172633
  Description of Artificial Sequence: Synthetic coding sequence

SEQ ID NO: 172637 - DNA, 1086 bp, Artificial Sequence; identical to SEQ ID NO: 172629
  Description of Artificial Sequence: Synthetic coding sequence

SEQ ID NO: 172638 - DNA, 1347 bp, Artificial Sequence; identical to SEQ ID NO: 172633
  Description of Artificial Sequence: Synthetic coding sequence

SEQ ID NO: 172639 - DNA, 1086 bp, Artificial Sequence; identical to SEQ ID NO: 172632
  Description of Artificial Sequence: Synthetic coding sequence

SEQ ID NO: 172640 - DNA, 2037 bp, Artificial Sequence
  Description of Artificial Sequence: Synthetic coding sequence
atgctgctggaggccgagcggcggcggggcggcggggccgccggggcccggctgctggagcgctacagaagagtgcctggggtgcgggccctgcgggctgacagcgtgctgatcattgaaacagtgcccggcttccccccagcccccccagcccctggggccgcccagatccgggctgctgaggtgctggtgtatggagcccctcctggccgggtgtcccggctgctggagagatttgatcctcctgctgcccccaggagaagaggcagccctgagcgggcccggcccccacctcctcctcctcctccagccccaccccggcccccacctgctgcccccagccccccagctgcccctggcccccggggcggcggggccagccctggggccaggagaagtgacttcctgcagaagacaggcagcaacagcttcaccgtgcacccccggggcctgcacagaggagctggggcccggctgctgagcaatggccacagcgcccctgagcccagggctggccctgccaaccggctggccggcagccccccaggcagcggccagtggaagcccaaggtggagagcggggaccccagcctgcaccccccacccagccctggcacccccagcgccaccccagccagccccccagccagcgccacccccagccagaggcagtgtgtgtctgctgccaccagcaccaatgacagctttgagatccggcctgcccccaagcctgtgatggagaccatccccctgggggacctgcaggcccgggccctggccagcctgcgggccaacagcagaaattccttcatggtgatccccaagagcaaggccagcggggcccctcctcctgagggccggcagagcgtggagctgcccaagggggacctgggccctgccagccccagccaggagctgggcagccagcctgtgcctggaggagatggagccccagccctgggcaagagccccctggaggtggaggcccagtgggccgtggaggagggcgcctgccccaggacagccacagccctggccgaccgggccatccgctggcagaggcccagcagccccccacccttcctgcctgctgccagcgaggaggccgagcctgctgagggcctgcgggtgcccggcctggccaagaacagccgggagtatgtgcggcccggcctgcctgtgaccttcattgatgaggtggacagcgaggaggccccccaggccgccaagctgccctacctgccccacccagcccggcccctgcacccagcccggcccggctgtgtggccgagctgcagccccggggcagcaacaccttcaccgtggtgcccaagaggaagccaggcaccctgcaggaccagcacttcagccaggccaaccgggagccccggccccgggaggccgaggaggaggaggccagctgcctgctgggccccaccctgaagaagcgctaccccaccgtgcatgaaattgaagtcatcggcggctacctggccctgcagaagagctgcctgaccaaggccggcagcagcaggaagaagatgaagatctccttcaatgacaagagcctgcagaccacctttgagtaccccagcgagagcagcctggagcaggaggaggaggtggaccagcaggaggaggaggaggaggaggaggaggaggaggaggaggaggaggagggcagcggcagcgaggagaagccctttgccctcttcctgccccgggccacctttgtgtcctctgtgcggcctgagagcagccggctgcctgagggcagcagcggcctgagcagctacacccccaagcacagcgtggccttcagcaagtggcaggagcaggccctggagcaggccccccgggaggccgagcccccacctgtggaggccatggtgcgctgtggcggcgtggagcgctggggcgagagtgacacccgggccagcccctgtgtgcacatcctgagcagccacttccagctgaccccagccagccagaatgacctgagtgacttccgctctgagcccgccctgtacttctag

SEQ ID NO: 172641 - DNA, 2136 bp, Artificial Sequence
  Description of Artificial Sequence: Synthetic coding sequence
atggccgccctgggccggcccggcagcggccccagggctgctgtgcctgcctggaagcgggagatcctggagaggaagagggccaagctggccgccctgggcggcggggccggccctggagctgctgagcctgagcagagggtgctggccgagagcctgggccccctgcgggagaaccccttcatgctgctggaggccgagaggagaagaggaggaggagctgctggggcccggctgctggagcgctaccgccgggtgcctggggtgcgggccctgcgggctgacagcgtgctgatcatcgagaccgtgcccggcttccccccagcccccccagcccctggagctgcccagatccgggctgctgaggtgctggtgtatggagcccctcctggccgggtgtcccggctgctggagagatttgaccccccagctgccccccggcggcggggcagccctgagcgggcccggcccccacctcctcctcctcctccagccccacccaggcctcctcctgctgcccccagccccccagctgcccctggcccccggggcggcggggccagccctggggcccggcggagtgacttcctgcagaagacaggcagcaacagcttcaccgtgcacccccggggcctgcacagaggagctggggcccggctgctgagcaatggccacagcgcccctgagccccgggccggccctgccaaccggctggccggcagccccccaggcagcggccagtggaagcccaaggtggagagcggggaccccagcctgcaccccccacccagccctggcaccccatctgccaccccagccagccccccagccagcgccacccccagccagaggcagtgtgtgtctgctgccaccagcaccaatgacagctttgagatccggcctgcccccaagcctgtgatggagaccatccccctgggggacctgcaggcccgggccctggccagcctgcgggccaacagcaggaacagcttcatggtgatccccaagagcaaggccagcggggcccctcctcctgagggccggcagagcgtggagctgcccaagggggacctgggccctgccagccccagccaggagctgggcagccagcctgtgcctggaggagatggagccccagccctgggcaagagccccctggaggtggaggcccagtgggccgtggaggagggcgcctgccccaggacagccacagccctggccgaccgggccatccgctggcagaggcccagcagccccccacccttcctgcctgctgccagcgaggaggccgagcctgctgagggcctgcgggtgcccggcctggccaagaacagccgggagtatgtgcggcccggcctgcctgtgaccttcattgatgaggtggacagcgaggaggccccccaggccgccaagctgccctacctgccccacccagcccggcccctgcacccagcccggcccggctgtgtggccgagctgcagccccggggcagcaacaccttcaccgtggtgcccaagaggaagccaggcaccctgcaggaccagcacttcagccaggccaaccgggagccccggccccgggaggccgaggaggaggaggccagctgcctgctgggccccaccctgaagaagcgctaccccaccgtgcatgaaattgaggtgattggaggctacctggccctgcagaagagctgcctgaccaaggccggcagcagcaggaagaagatgaagatctccttcaatgacaagagcctgcagaccacctttgagtaccccagcgagagcagcctggagcaggaggaggaggtggaccagcaggaggaggaggaggaggaggaggaggaggaggaggaggaggaggagggcagcggcagcgaggagaagccctttgccctcttcctgccccgggccacctttgtgtcctctgtgcggcctgagagcagccggctgcctgagggcagcagcggcctgagcagctacacccccaagcacagcgtggccttcagcaagtggcaggagcaggccctggagcaggccccccgggaggccgagcccccacctgtggaggccatgctgaccccagccagccagaatgacctgagtgacttccgctctgagcccgccctgtacttctag

SEQ ID NO: 172642 - DNA, 4866 bp, Artificial Sequence
  Description of Artificial Sequence: Synthetic coding sequence
atggagtgggtgctggccgaggccctgctgagccagagccgggacccccgggccctgctgggcgccctgtgccagggcgaggccagcgctgagcgggtggagaccctgcgcttcctgctgcagaggctggaggatgaggaggcccggggcagcggcggggccggggccctgcctgaggccgcccgggaggtggccgccggctacctggtgcccctgctgcggagcctgcggggccggcctgctgggggccctgaccccagcctgcagcccaggcacagaagaagagtgctgcgggccgccggggccgccctgcggagctgtgtgcggctggccggccggccccagctggccgccgccctggccgaggaggccctgcgggacctgctggccggctggagggcccctggagctgaggccgctgtggaggtgctggccgctgtgggcccctgcctgcggcccagagaagatggccccctgctggagcgggtggccggcacagctgtggccctggccctgggcggcggcggagatggagatgaagctggccctgcagaagatgctgctgccctggtggccggccgcctgctgcctgtgctggtgcagtgtggcggggccgccctgcgggctgtgtggggcggcctggccgcccctggggccagcctgggcagcggccgggtggaggagaagctgctggtgctgagcgccctggccgagaagctgctgcctgagcccggcggggaccgggcccggggggcccgggaggccggcccagatgcccggcgctgctggaggttctggaggacagtgcaggccggcctgggccaggctgatgccctgaccaggaagagggcccgctacctgctgcagagagctgtggaggtgtctgctgagctgggcgctgactgcacctgtggcccccaggagggcaatggccccagcctcttctggtggagcgagaggaagaaggatgagctgctgaagttctgggagaactacatcctgatcatggagaccctggagggcaaccagatccacgtgatcaagcctgtgctgcccaagctgaacaacctgtttgaatatgctgtgtctgaagaaaatggctgctggctgttccaccccagctggcacatgtgcatctacaagaggatgtttgaaagtgagaacaagatcctgagcaaggagggcgtcatccacttcctggagctgtatgagaccaagatcctgcccttcagccctgagttcagcgagttcatcatcggccccctgatggatgccctgtctgagagcagcctgtacagccgcagccctggccagcccatcggcagctgcagccccctgggcctgaagctgcagaagttcctggtgacctacatcagcctgctgcctgaggagatcaagagcagcttcctgctgaagttcatcaggaagatgaccagccgccactggtgtgctgtgcccatcctcttcctgagcaaggccctggccaacgtgcccaggcacaaggccctgggcattgatggcctgctggccctgagagatgtgatccactgcaccatgatcacccaccagatcctgctgcggggagctgcccagtgctacctgctgcagacagccatgaacctgctggatgtggagaaggtgtccctgagtgatgtgtccaccttcctgatgagcctgcggcaggaggagagcctgggccggggcaccagcctgtggacagagctgtgtgactggctgcgggtgaatgaaagctacttcaagcccagccccacctgcagcagcatcggcctgcacaagaccagcctgaatgcctacgtgaagagcatcgtgcaggagtatgtgaagagcagcgcctgggagactggagagaactgcttcatgccagactggtttgaggccaagctggtgtccctgatggtgctgctggccgtggatgtggagggcatgaagacccagtacagcggcaagcagaggacagaaaatgtgctgcgcatcttcctggaccccctgctggatgtgctgatgaagttcagcaccaatgcctacatgcccctgctgaagacagaccgctgcctgcagctgctgctgaagctgctgaacacctgccgcctgaagggcagcagcgcccaggatgatgaggtgtccacagtgctgcagaacttcttcatgagcaccacagagagcatcagcgagttcatcctgcggcggctgaccatgaatgagctgaacagcgtgtctgacctggaccgctgccacctgtacctgatggtgctgacagagctgatcaacctgcacctgaaggtgggctggaagaggggcaaccccatctggagggtcatcagcctgctgaagaatgccagcatccagcacctgcaggagatggacagcggccaggagcccaccgtgggcagccagatccagagggtggtgtccatggccgccctggccatggtgtgtgaggccatcgaccagaagccagagctgcagctggacagcctgcatgctggccccctggagagcttcctgagcagcctgcagctgaaccagaccctgcagaagccccacgccgaggagcagagcagctatgcccaccccctggagtgcagctctgtgctggaggagagcagcagcagccagggctggggcaagatcgtggcccagtacatccatgaccagtgggtgtgcctgtccttcctgctgaagaagtaccacaccctcatccccaccaccggcagcgagatcctggagcccttcctgcctgctgtgcagatgcccatccgcaccctgcagagcgccctggaggccctgactgtgctgagcagtgaccaggtgctgcccgtcttccactgcctgaaggtgctggtgcccaagctgctgaccagcagcgagagcctgtgcatcgagagctttgacatggcctggaagatcatcagcagcctgagcaacacccagctgatcttctgggccaacctgaaggcctttgtgcagtttgtgtttgacaacaaggtgctgaccatcgccgccaagatcaagggccaggcctacttcaagatcaaggagatcatgtacaagatcatcgagatgtctgccatcaagacaggagtcttcaacaccctcatctcctactgctgccagagctggatcgtgtctgccagcaatgtgtcccagggcagcctgagcagcgccaagaactacagcgagctgatcctggaggcctgcatctttggaacagtgttccggcgggaccagaggctggtgcaggatgtgcagaccttcatcgagaacctgggccatgactgtgccgccaacatcgtgatggagaacaccaagcgggaggaccactacgtgcgcatctgtgctgtgaagttcctgtgcctgctggatggcagcaacatgagccacaagctgttcatcgaggacctggccatcaagctgctggacaaggatgagctggtgtccaagagcaagaagcgctactacgtgaacagcctgcagcaccgggtgaagaacagagtgtggcagaccctgctggtgctcttcccccggctggaccagaacttcctgaatggcatcatcgaccgcatcttccaggccggcttcaccaacaaccaggccagcatcaagtacttcatcgagtggatcatcatcctgatcctgcacaagttcccccagttcctgcccaagttctgggactgcttctcctatggagaggagaacctgaagaccagcatctgcaccttcctggccgtgctgagccacctggacatcatcacccagaacatccctgagaagaagctgatcctgaagcaggccctgattgtggtgctgcagtggtgcttcaaccacaacttctctgtgcggctgtatgccctggtggccctgaagaagctgtggacagtgtgcaaggtgctgtctgtggaggagtttgatgccctgacccctgtgattgagagcagcctgcaccaggtggagagcatgcatggagctggaaatgccaagaagaactggcagaggatccaggagcacttcttctttgccaccttccaccccctgaaggactactgcctggagaccatcttctacatcctgccccggctgagcggcctgattgaagatgagtggatcaccatcgacaagttcacccgcttcacagatgtgcccctggccgccggcttccagtggtacctgagccagacccagctgagcaagctgaagccaggggactggagccagcaggacatcggcaccaacctggtggaggccgacaaccaggccgagtggacagatgtgcagaagaagatcatcccctggaacagccgggtgtctgacctggacctggagctgctcttccaggaccgggccgcccggctgggcaagagcatcagccggctgattgtggtggccagcctgattgacaagcccaccaacctgggcggcctgtgcaggacctgtgaggtgtttggagcctctgtgctggtggtgggcagcctgcagtgcatcagtgacaagcagttccagcacctgtctgtgtctgctgagcagtggctgcccctggtggaggtgaagccaccccagctgattgactacctgcagcagaagaagacagagggctacaccatcattggagtggagcagacagccaagagcctggacctgacccagtactgcttccctgagaagagcctgctgctgctgggcaatgaaagagagggcatcccagccaacctgatccagcagctggatgtgtgtgtggagatcccccagcagggcatcatccgcagcctgaatgtgcacgtgtctggggccctgctgatctgggagtacacccggcagcagctgctgagccacggggacaccaagccctag

SEQ ID NO: 172643 - DNA, 1101 bp, Artificial Sequence
  Description of Artificial Sequence: Synthetic coding sequence
atgtctgaggaggagcagggcagcggcaccaccaccggctgcggcctgcccagcattgagcagatgctggccgccaaccctgggaagacccccatcagcctgctgcaggagtatggcacccgcatcggcaagacccctgtgtatgacctgctgaaggccgagggccaggcccaccagcccaacttcaccttccgggtgacagtgggggacaccagctgcaccggccagggccccagcaagaaggccgccaagcacaaggctgctgaggtggccctgaagcacctgaagggcggctccatgctggagcccgccctggaggacagcagcagcttcagccccctggacagcagcctgcctgaggacatccctgtgttcaccgctgctgctgctgccacccctgtgcccagcgtggtgctgaccaggagcccccccatggagctgcagccccctgtgagcccccagcagagcgagtgcaaccctgtgggcgccctgcaggagctggtggtgcagaagggctggaggctgcctgagtacacagtgacccaggagagcggccctgcccacaggaaggagttcaccatgacctgccgggtggagcgcttcatcgagatcggcagcggcaccagcaagaagctggccaagagaaatgctgctgccaagatgctgctgcgggtgcacacagtgcccctggatgccagagatggaaatgaggtggagccagatgatgaccacttcagcattggagtgggcagccggctggatggcctgaggaacagaggccctggctgcacctgggacagcctgagaaattctgtgggggagaagatcctgagcctgcggagctgcagcctgggcagcctgggcgccctgggccctgcctgctgccgggtgctgtctgagctgtctgaggagcaggccttccacgtgtcctacctggacatcgaggagctgagcctgagcggcctgtgccagtgcctggtggagctgagcacccagcctgccaccgtgtgccacggcagcgccaccacccgggaggccgcccggggggaggccgcccggcgggccctgcagtacctgaagatcatggccggcagcaagtag

SEQ ID NO: 172644 - DNA, 1038 bp, Artificial Sequence
  Description of Artificial Sequence: Synthetic coding sequence
atgctggccgccaaccctgggaagacccccatcagcctgctgcaggagtatggcaccagaattggcaagacccctgtgtatgacctgctgaaggccgagggccaggcccaccagcccaacttcaccttccgggtgacagtgggggacaccagctgcaccggccagggccccagcaagaaggccgccaagcacaaggctgctgaggtggccctgaagcacctgaagggcggctccatgctggagcccgccctggaggacagcagcagcttcagccccctggacagcagcctgcctgaggacatccctgtgttcaccgctgctgctgctgccacccctgtgcccagcgtggtgctgaccaggagcccccccatggagctgcagccccctgtgagcccccagcagagcgagtgcaaccctgtgggcgccctgcaggagctggtggtgcagaagggctggaggctgcctgagtacacagtgacccaggagagcggccctgcccacaggaaggagttcaccatgacctgccgggtggagcgcttcattgaaattggcagcggcaccagcaagaagctggccaagagaaatgctgctgccaagatgctgctgcgggtgcacacagtgcccctggatgccagagatggaaatgaggtggagccagatgatgaccacttcagcattggagtgggcagccggctggatggcctgaggaacagaggccctggctgcacctgggacagcctgaggaacagcgtgggggagaagatcctgagcctgcggagctgcagcctgggcagcctgggcgccctgggccctgcctgctgccgggtgctgtctgagctgtctgaggagcaggccttccacgtgtcctacctggacatcgaggagctgagcctgagcggcctgtgccagtgcctggtggagctgagcacccagcctgccaccgtgtgccacggcagcgccaccacccgggaggccgcccggggggaggccgcccggcgggccctgcagtacctgaagatcatggccggcagcaagtag

SEQ ID NO: 172645 - DNA, 1038 bp, Artificial Sequence; identical to SEQ ID NO: 172644
  Description of Artificial Sequence: Synthetic coding sequence

SEQ ID NO: 172646 - DNA, 1245 bp, Artificial Sequence
  Description of Artificial Sequence: Synthetic coding sequence
atgtctgagtacatccgggtgacagaagatgaaaatgatgagcccatcgagatccccagtgaagatgatggcaccgtgctgctgagcacagtgacagcccagtttcctggggcctgtggcctgcgctacagaaatcctgtgtcccagtgcatgagaggagtgcggctggtggagggcatcctgcacgccccagatgctggctggggcaacctggtgtatgtggtgaactaccccaaggacaacaagaggaagatggatgaaacagatgccagcagcgctgtgaaggtgaagagagctgtgcagaagaccagtgacctgattgtgctgggcctgccctggaagaccacagagcaggacctgaaggagtacttcagcacctttggagaggtgctgatggtgcaggtgaagaaggacctgaagacaggccacagcaaaggatttggatttgtgcgcttcacagaatatgagacccaggtgaaggtgatgagccagaggcacatgattgatggccgctggtgtgactgcaagctgcccaacagcaagcagagccaggatgagcccctgcggagcaggaaggtgtttgtgggccgctgcacagaggacatgacagaagatgagctgcgggagttcttcagccagtatggagatgtgatggatgtgttcatccccaagcccttccgggcctttgcctttgtgacctttgctgatgaccagatcgcccagagcctgtgtggggaggacctgatcatcaagggcatctctgtgcacatcagcaatgctgagcccaagcacaacagcaaccggcagctggagaggagcggccgctttggaggcaaccctgggggctttggaaaccagggcggctttggaaacagccggggcggcggggccggcctgggcaacaaccagggcagcaacatgggcggcggcatgaactttggagccttcagcatcaacccagccatgatggctgctgcccaggccgccctgcagagctcctggggcatgatgggcatgctggccagccagcagaaccagagcggccccagcggcaacaaccagaaccagggcaacatgcagcgggagcccaaccaggcctttggaagtggcaacaacagctacagcggcagcaacagcggggccgccatcggctggggcagcgccagcaatgccggcagcggcagcggcttcaacggcggcttcggcagctccatggacagcaagagcagcggctggggcatgtag

SEQ ID NO: 172647 - DNA, 888 bp, Artificial Sequence
  Description of Artificial Sequence: Synthetic coding sequence
atgtctgagtacatccgggtgacagaagatgaaaatgatgagcccatcgagatccccagtgaagatgatggcaccgtgctgctgagcacagtgacagcccagtttcctggggcctgtggcctgcgctacagaaatcctgtgtcccagtgcatgagaggagtgcggctggtggagggcatcctgcacgccccagatgctggctggggcaacctggtgtatgtggtgaactaccccaaggacaacaagaggaagatggatgaaacagatgccagcagcgctgtgaaggtgaagagagctgtgcagaagaccagtgacctgattgtgctgggcctgccctggaagaccacagagcaggacctgaaggagtacttcagcacctttggagaggtgctgatggtgcaggtgaagaaggacctgaagacaggccacagcaaaggatttggatttgtgcgcttcacagaatatgagacccaggtgaaggtgatgagccagaggcacatgattgatggccgctggtgtgactgcaagctgcccaacagcaagcagagccaggatgagcccctgcggagcaggaaggtgtttgtgggccgctgcacagaggacatgacagaagatgagctgcgggagttcttcagccagtatggagatgtgatggatgtgttcatccccaagcccttccgggcctttgcctttgtgacctttgctgatgaccagatcgcccagagcctgtgtggggaggacctgatcatcaagggcatctctgtgcacatcagcaatgctgagcccaagcacaacagcaaccggcagctggagaggagcggccgcttcggcgtgcacctgatcagcaatgtgtatggccgcagcaccagcctgaaggtggtgctgtag

SEQ ID NO: 172648 - DNA, 897 bp, Artificial Sequence
  Description of Artificial Sequence: Synthetic coding sequence
atgccccagatgctggccggggagatctggtgcatgctgagcaccatccagaaggtgaagaaggacctgaagacaggccacagcaaaggatttggatttgtgcgcttcacagaatatgagacccaggtgaaggtgatgagccagaggcacatgattgatggccgctggtgtgactgcaagctgcccaacagcaagcagagccaggatgagcccctgcggagcaggaaggtgtttgtgggccgctgcacagaggacatgacagaagatgagctgcgggagttcttcagccagtatggagatgtgatggatgtgttcatccccaagcccttccgggcctttgcctttgtgacctttgctgatgaccagatcgcccagagcctgtgtggggaggacctgatcatcaagggcatctctgtgcacatcagcaatgctgagcccaagcacaacagcaaccggcagctggagaggagcggccgctttggaggcaaccctgggggctttggaaaccagggcggctttggaaacagccggggcggcggggccggcctgggcaacaaccagggcagcaacatgggcggcggcatgaactttggagccttcagcatcaacccagccatgatggctgctgcccaggccgccctgcagagctcctggggcatgatgggcatgctggccagccagcagaaccagagcggccccagcggcaacaaccagaaccagggcaacatgcagcgggagcccaaccaggcctttggaagtggcaacaacagctacagcggcagcaacagcggggccgccatcggctggggcagcgccagcaatgccggcagcggcagcggcttcaacggcggcttcggcagctccatggacagcaagagcagcggctggggcatgtag

SEQ ID NO: 172649 - DNA, 1533 bp, Artificial Sequence
  Description of Artificial Sequence: Synthetic coding sequence
atggctgctgacagtgatgatggagctgtgtctgccccagctgccagtgatggaggagtgtccaagagcaccaccagcggggaggagctggtggtgcaggtgcctgtggtggatgtgcagagcaacaacttcaaggagatgtggcccagcctgctgctggccatcaagacagccaactttgtggccgtggacacagagctgagcggcctgggggacaggaagagcctgctgaaccagtgcatcgaggagcgctacaaggctgtgtgccacgccgcccggaccaggagcatcctgagcctgggcctggcctgcttcaagaggcagcctgacaagggggagcacagctacctggcccaggtgttcaacctgaccctgctgtgcatggaggagtatgtgattgagcccaagtctgtgcagttcctgatccagcacggcttcaacttcaaccagcagtatgcccagggcatcccctaccacaagggaaatgacaagggagatgagagccagagccagagcgtgaggaccctcttcctggagctgatccgggcccggcggcccctggtgctgcacaacggcctgattgacctggtgttcctgtaccagaacttctacgcccacctgcctgagagcctgggcaccttcaccgctgacctgtgtgagatgtttcctgctggcatctatgacaccaagtatgctgctgagttccacgccaggtttgtggccagctacctggagtatgccttcagaaaatgtgagcgggagaatggcaagcagagagctgctggcagcccccacctgaccctggagttctgcaactaccccagctccatgagggaccacatcgactaccgctgctgcctgcccccagccacccaccggccccaccccaccagcatctgtgacaacttcagcgcctacggctggtgccccctgggcccccagtgcccccagagccatgacatcgacctgatcatcgacacagatgaggccgctgctgaggacaagagaagaagaagaagaagaagagagaagaggaagagggccctgctgaacctgcccggcacccagaccagcggggaggccaaggatggcccccccaagaagcaggtgtgtggggacagcatcaagccagaggagacagagcaggaggtggccgcagatgagaccaggaacctgccccacagcaagcagggcaacaagaatgacctggagatgggcatcaaggccgcccggcctgagattgctgaccgggccaccagcgaggtgcccggcagccaggccagccccaaccctgtgcctggagatggcctgcaccgggccggctttgatgccttcatgacaggctacgtgatggcctacgtggaggtgtcccagggcccccagccctgcagcagcggcccctggctgcctgagtgccacaacaaggtgtacctgagcggcaaggctgtgcccctgactgtggccaagagccagttcagccgcagcagcaaggcccacaaccagaagatgaagctgacctggggcagcagctag

SEQ ID NO: 172650 - DNA, 1293 bp, Artificial Sequence
  Description of Artificial Sequence: Synthetic coding sequence
atggctgctgacagtgatgatggagctgtgtctgccccagctgccagtgatggagctgagtgggcctggggccaggaggagtttgctgagcctggagagcacagctacctggcccaggtgttcaacctgaccctgctgtgcatggaggagtatgtgattgagcccaagtctgtgcagttcctgatccagcacggcttcaacttcaaccagcagtatgcccagggcatcccctaccacaagggaaatgacaagggagatgagagccagagccagagcgtgaggaccctcttcctggagctgatccgggcccggcggcccctggtgctgcacaacggcctgattgacctggtgttcctgtaccagaacttctacgcccacctgcctgagagcctgggcaccttcaccgctgacctgtgtgagatgtttcctgctggcatctatgacaccaagtatgctgctgagttccacgccaggtttgtggccagctacctggagtatgccttcagaaaatgtgagcgggagaatggcaagcagagagctgctggcagcccccacctgaccctggagttctgcaactaccccagctccatgagggaccacatcgactaccgctgctgcctgcccccagccacccaccggccccaccccaccagcatctgtgacaacttcagcgcctacggctggtgccccctgggcccccagtgcccccagagccatgacatcgacctgatcatcgacacagatgaggccgctgctgaggacaagagaagaagaagaagaagaagagagaagaggaagagggccctgctgaacctgcccggcacccagaccagcggggaggccaaggatggcccccccaagaagcaggtgtgtggggacagcatcaagccagaggagacagagcaggaggtggccgcagatgagaccaggaacctgccccacagcaagcagggcaacaagaatgacctggagatgggcatcaaggccgcccggcctgagattgctgaccgggccaccagcgaggtgcccggcagccaggccagccccaaccctgtgcctggagatggcctgcaccgggccggctttgatgccttcatgacaggctacgtgatggcctacgtggaggtgtcccagggcccccagccctgcagcagcggcccctggctgcctgagtgccacaacaaggtgtacctgagcggcaaggctgtgcccctgactgtggccaagagccagttcagccgcagcagcaaggcccacaaccagaagatgaagctgacctggggcagcagctag

SEQ ID NO: 172651 - DNA, 1263 bp, Artificial Sequence
  Description of Artificial Sequence: Synthetic coding sequence
atgaccatggagaagggcatgagcagtggagagggcctgcccagccgcagcagccaggtgtctgctgggaagatcacagccaaggagctggagaccaagcagagctacaaggagaagagaggaggctttgtgctggtgcacgccggggccggctaccacagcgagagcaaggccaaggagtacaagcacgtgtgcaagagggcctgccagaaggccatcgagaagctgcaggccggggccctggccacagatgctgtgacagctgccctggtggagctggaggacagccccttcaccaatgccggcatgggcagcaacctgaacctgctgggggagattgaatgtgatgccagcatcatggatggcaagagcctgaactttggagctgtgggcgccctgagcggcatcaagaaccctgtgtctgtggccaaccggctgctgtgtgagggccagaagggcaagctgtctgctggccgcatccccccctgcttcctggtgggggagggcgcctaccgctgggccgtggaccacggcatccccagctgcccccccaacatcatgaccacccgcttcagcctggccgccttcaagaggaacaagaggaagctggagctggccgagcgggtggacacagacttcatgcagctgaagaagaggcggcagagcagcgagaaggaaaatgattctggcaccctggacacagtgggcgctgtggtggtggaccacgagggcaatgtggccgctgctgtgagcagcggcggcctggccctgaagcaccctggccgggtgggccaggccgccctgtatggctgcggctgctgggccgagaacacaggagcccacaacccctacagcacagctgtgtccaccagcggctgtggggagcacctggtgaggaccatcctggccagagaatgtagccacgccctgcaggctgaagatgcccaccaggccctgctggagaccatgcagaacaagttcatcagcagccccttcctggcctctgaagatggagtgctgggcggcgtcatcgtgctgcggagctgccgctgcagcgctgagccagacagcagccagaacaagcagaccctgctggtggagttcctgtggagccacaccacagagagcatgtgtgtgggctacatgtctgcccaggacggcaaggccaagacccacatcagccggctgcccccaggagctgtggccggccagagcgtggccatcgagggcggcgtgtgccgcctggagagccctgtgaactag

SEQ ID NO: 172652 - DNA, 918 bp, Artificial Sequence
  Description of Artificial Sequence: Synthetic coding sequence
atgaccatggagaagggcatgagcagtggagagggcctgcccagccgcagcagccaggtgtctgctgggaagatcacagccaaggagctggagaccaagcagagctacaaggagaagagaggaggctttgtgctggtgcacgccggggccggctaccacagcgagagcaaggccaaggagtacaagcacgtgtgcaagagggcctgccagaaggacagccccttcaccaatgccggcatgggcagcaacctgaacctgctgggggagattgaatgtgatgccagcatcatggatggcaagagcctgaactttggagctgtgggcgccctgagcggcatcaagaaccctgtgtctgtggccaaccggctgctgtgtgagggccagaagggcaagctgtctgctggccgcatccccccctgcttcctggtgggggagggcgcctaccgctgggccgtggaccacggcatccccagctgcccccccaacatcatgaccacccgcttcagcctggccgccttcaagaggaacaagaggaagctggagctggccgagcgggtggacacagacttcatgcagctgaagaagaggcggcagagcagcgagaaggaaaatgacagcggcaccctggacacagtgggcgctgtggtggtggaccacgagggcaatgtggccgctgctgtgtcctctgggggcctggccctgaagcaccctggccgggtgggccaggccgccctgtatggctgcggctgctgggccgagaacacaggagcccacaacccctacagcacagctgtgtccaccagcggctgtggggagcacctggtgaggaccatcctggcccgggagtgcagccacgccctgcaggccgaggatgcccaccaggccctgctggagaccatgcagaacaagttcatctag

SEQ ID NO: 172653 - DNA, 333 bp, Artificial Sequence
  Description of Artificial Sequence: Synthetic coding sequence
tgaaaaatcacagccaaggagctggagaccaagcagagctacaaggagaagagaggaggctttgtgctggtgcacgccggggccggctaccacagcgagagcaaggccaaggagtacaagcacgtgtgcaagagggcctgccagaaggccatcgagaagctgcaggccggggccctggccacagatgctgtgacagctgccctggtggagctggagctgatgtggaagggccagttccaggtgctgtgtgtgctgaccaacctcttcctggacatcatcaagaaccccaccaagaccaagttcaagaccatcagcaatgtgaaggtgtactag

SEQ ID NO: 172654 - DNA, 918 bp, Artificial Sequence; identical to SEQ ID NO: 172652
  Description of Artificial Sequence: Synthetic coding sequence

SEQ ID NO: 172655 - DNA, 438 bp, Artificial Sequence
  Description of Artificial Sequence: Synthetic coding sequence
atgaccatggagaagggcatgagcagtggagagggcctgcccagccgcagcagccaggtgtctgctgggaagatcacagccaaggagctggagaccaagcagagctacaaggagaagagaggaggctttgtgctggtgcacgccggggccggctaccacagcgagagcaaggccaaggagtacaagcacgtgtgcaagagggcctgccagaaggccatcgagaagctgcaggccggggccctggccacagatgctgtgacagctgccctggtggagctggaggatgtggagagcatcctgtgtgccccctactggctggagaatgtgcacatgctgtacaagctgaggatgctgaccaagccctgctggaggctgtgcaagaccagcctgtctgtgcacctgagcctgcctgtgaagatggcctgcctggccgagtag

SEQ ID NO: 172656 - DNA, 390 bp, Artificial Sequence
  Description of Artificial Sequence: Synthetic coding sequence
atgaccatggagaagggcatgagcagtggagagggcctgcccagccgcagcagccaggtgtctgctgggaagatcacagccaaggagctggagaccaagcagagctacaaggagaagagaggaggctttgtgctggtgcacgccggggccggctaccacagcgagagcaaggccaaggagtacaagcacgtgtgcaagagggcctgccagaaggccatcgagaagctgcaggccggggccctggccacagatgctgtgacagctgccctggtggagctggaggtgtacacccacagctacacctcctggagctgcatccagcccagcatccacgtgctgctggtgaagaggcagaggaagagccccctgccccgcatcagcaccttctag

SEQ ID NO: 172657 - DNA, 1443 bp, Artificial Sequence
  Description of Artificial Sequence: Synthetic coding sequence
atgctgctgtgcacagcccggctggtgggcctgcagctgctgatcagctgctgctgggcctttgcctgccacagcacagagagcagcccagacttcaccctgcccggggactacctgctggccggcctcttccccctgcacagcggctgcctgcaggtgcgccacaggcctgaggtgaccctgtgtgacaggagctgcagcttcaatgaacatggctaccacctgttccaggccatgaggctgggcgtggaggagatcaacaacagcacagccctgctgcccaacatcaccctgggctaccagctgtatgatgtgtgcagcgacagcgccaacgtgtatgccaccctgcgggtgctgagcctgcccggccagcaccacatcgagctgcagggcgacctgctgcactacagccccaccgtgctggccgtcatcggccctgacagcaccaacagagctgccaccacagctgccctgctgagccccttcctggtgcccatgatctcctatgctgccagcagcgagaccctgtctgtgaagaggcagtaccccagcttcctgcggaccatccccaatgacaagtaccaggtggagaccatggtgctgctgctgcagaagtttggctggacctggatcagcctggtgggcagcagtgatgattatggccagctgggcgtgcaggccctggagaaccaggccaccggccagggcatctgcatcgccttcaaggacatcatgcccttcagcgcccaggtgggagatgagaggatgcagtgcctgatgaggcacctggcccaggccggggccaccgtggtggtggtgttcagcagccggcagctggcccgggtcttctttgagagcgtggtgctgaccaacctgaccgggaaggtgtgggtggccagcgaggcctgggccctgagccgccacatcaccggggtgcccggcatccagagaattggcatggtgctgggcgtggccatccagaagagagctgtgcccggcctgaaggcctttgaggaggcctatgcccgggctgacaagaaggccccccggccctgccacaagggctcctggtgcagcagcaaccagctgtgccgggagtgccaggccttcatggcccacaccatgcccaagctgaaggccttctccatgagcagcgcctacaatgcctacagagctgtgtatgctgtggcccacggcctgcaccagctgctgggctgtgccagcggggcctgcagccggggccgggtgtacccctggcagaccagcacagatgccagcctggtgggcaagaagagcggccacctgcgggaggcccggcctgccagccgggccctgtggtgcttctggctgtgtgtgtccacccccctgggctgctgctggcagctgacccgctgctgctgctgctgctgcctgggcctgctggcctgcctgcccggcacctag

SEQ ID NO: 172658 - DNA, 2526 bp, Artificial Sequence
  Description of Artificial Sequence: Synthetic coding sequence
atgctgctgtgcacagcccggctggtgggcctgcagctgctgatcagctgctgctgggcctttgcctgccacagcacagagagcagcccagacttcaccctgcccggggactacctgctggccggcctcttccccctgcacagcggctgcctgcaggtgcgccacaggcctgaggtgaccctgtgtgacaggagctgcagcttcaatgaacatggctaccacctgttccaggccatgaggctgggcgtggaggagatcaacaacagcacagccctgctgcccaacatcaccctgggctaccagctgtatgatgtgtgcagcgacagcgccaacgtgtatgccaccctgcgggtgctgagcctgcccggccagcaccacatcgagctgcagggcgacctgctgcactacagccccaccgtgctggccgtcatcggccctgacagcaccaacagagctgccaccacagctgccctgctgagccccttcctggtgcccatgatctcctatgctgccagcagcgagaccctgtctgtgaagaggcagtaccccagcttcctgcggaccatccccaatgacaagtaccaggtggagaccatggtgctgctgctgcagaagtttggctggacctggatcagcctggtgggcagcagtgatgattatggccagctgggcgtgcaggccctggagaaccaggccaccggccagggcatctgcatcgccttcaaggacatcatgcccttcagcgcccaggtgggagatgagaggatgcagtgcctgatgaggcacctggcccaggccggggccaccgtggtggtggtgttcagcagccggcagctggcccgggtcttctttgagagcgtggtgctgaccaacctgaccgggaaggtgtgggtggccagcgaggcctgggccctgagccgccacatcaccggggtgcccggcatccagagaattggcatggtgctgggcgtggccatccagaagagagctgtgcccggcctgaaggcctttgaggaggcctatgcccgggctgacaagaaggccccccggccctgccacaagggctcctggtgcagcagcaaccagctgtgccgggagtgccaggccttcatggcccacaccatgcccaagctgaaggccttctccatgagcagcgcctacaatgcctacagagctgtgtatgctgtggcccacggcctgcaccagctgctgggctgtgccagcggggcctgcagccggggccgggtgtacccctggcagctgctggagcagatccacaaggtgcacttcctgctgcacaaggacacagtggccttcaatgacaacagagaccccctgagcagctacaacatcatcgcctgggactggaatggccccaagtggaccttcaccgtgctgggcagcagcacctggagccctgtgcagctgaacatcaatgagaccaagatccagtggcacggcaaggacaaccaggtgcccaagtctgtgtgcagcagtgactgcctggagggccaccagagggtggtgacaggcttccaccactgctgctttgaatgtgtgccctgtggggccggcaccttcctgaacaagagtgacctgtaccgctgccagccctgtgggaaggaggagtgggcccctgagggcagccagacctgcttccccaggacagtggtgttcctggccctgcgggagcacacctcctgggtgctgctggccgccaacaccctgctgctgctgctgctgctgggcacagctggcctgtttgcctggcacctggacacccctgtggtgcgctctgctgggggccgcctgtgcttcctgatgctgggcagcctggccgccggcagcggcagcctgtatggcttctttggagagcccaccaggcctgcctgcctgctgcggcaggccctgtttgccctgggcttcaccatcttcctgagctgcctgactgtgcgctccttccagctgatcatcatcttcaagttcagcaccaaggtgcccaccttctaccacgcctgggtgcagaaccacggggccggcctgtttgtgatgatcagcagcgctgcccagctgctgatctgcctgacctggctggtggtgtggacccccctgcctgcccgggagtaccagcgcttcccccacctggtgatgctggagtgcacagagaccaacagcctgggcttcatcctggccttcctgtacaacggcctgctgagcatcagcgcctttgcctgcagctacctgggcaaggacctgcctgagaactacaatgaggccaagtgtgtgaccttcagcctgctcttcaactttgtgtcctggatcgccttcttcaccacagcctctgtgtatgatggcaagtacctgcctgctgccaacatgatggccggcctgagcagcctgagcagcggctttggaggctacttcctgcccaagtgctacgtgatcctgtgcaggccagacctgaacagcacagagcacttccaggccagcatccaggactacacccggcgctgtggcagcacctag

SEQ ID NO: 172659 - DNA, 1764 bp, Artificial Sequence
  Description of Artificial Sequence: Synthetic coding sequence
atgctgctgtgcacagcccggctggtgggcctgcagctgctgatcagctgctgctgggcctttgcctgccacagcacagagagcagcccagacttcaccctgcccggggactacctgctggccggcctcttccccctgcacagcggctgcctgcaggtgcgccacaggcctgaggtgaccctgtgtgacaggagctgcagcttcaatgaacatggctaccacctgttccaggccatgaggctgggcgtggaggagatcaacaacagcacagccctgctgcccaacatcaccctgggctaccagctgtatgatgtgtgcagcgacagcgccaacgtgtatgccaccctgcgggtgctgagcctgcccggccagcaccacatcgagctgcagggcgacctgctgcactacagccccaccgtgctggccgtcatcggccctgacagcaccaacagagctgccaccacagctgccctgctgagccccttcctggtgcccatgctgctggagcagatccacaaggtgcacttcctgctgcacaaggacacagtggccttcaatgacaacagagaccccctgagcagctacaacatcatcgcctgggactggaatggccccaagtggaccttcaccgtgctgggcagcagcacctggagccctgtgcagctgaacatcaatgagaccaagatccagtggcacggcaaggacaaccaggtgcccaagtctgtgtgcagcagtgactgcctggagggccaccagagggtggtgacaggcttccaccactgctgctttgaatgtgtgccctgtggggccggcaccttcctgaacaagagtgacctgtaccgctgccagccctgtgggaaggaggagtgggcccctgagggcagccagacctgcttccccaggacagtggtgttcctggccctgcgggagcacacctcctgggtgctgctggccgccaacaccctgctgctgctgctgctgctgggcacagctggcctgtttgcctggcacctggacacccctgtggtgcgctctgctgggggccgcctgtgcttcctgatgctgggcagcctggccgccggcagcggcagcctgtatggcttctttggagagcccaccaggcctgcctgcctgctgcggcaggccctgtttgccctgggcttcaccatcttcctgagctgcctgactgtgcgctccttccagctgatcatcatcttcaagttcagcaccaaggtgcccaccttctaccacgcctgggtgcagaaccacggggccggcctgtttgtgatgatcagcagcgctgcccagctgctgatctgcctgacctggctggtggtgtggacccccctgcctgcccgggagtaccagcgcttcccccacctggtgatgctggagtgcacagagaccaacagcctgggcttcatcctggccttcctgtacaacggcctgctgagcatcagcgcctttgcctgcagctacctgggcaaggacctgcctgagaactacaatgaggccaagtgtgtgaccttcagcctgctcttcaactttgtgtcctggatcgccttcttcaccacagcctctgtgtatgatggcaagtacctgcctgctgccaacatgatggccggcctgagcagcctgagcagcggctttggaggctacttcctgcccaagtgctacgtgatcctgtgcaggccagacctgaacagcacagagcacttccaggccagcatccaggactacacccggcgctgtggcagcacctag

SEQ ID NO: 172660 - DNA, 921 bp, Artificial Sequence
  Description of Artificial Sequence: Synthetic coding sequence
atgaggctgggcgtggaggagatcaacaacagcacagccctgctgcccaacatcaccctgggctaccagctgtatgatgtgtgcagcgacagcgccaacgtgtatgccaccctgcgggtgctgagcctgcccggccagcaccacatcgagctgcagggcgacctgctgcactacagccccaccgtgctggccgtcatcggccctgacagcaccaacagagctgccaccacagctgccctgctgagccccttcctggtgcccatgctgctggagcagatccacaaggtgcacttcctgctgcacaaggacacagtggccttcaatgacaacagagaccccctgagcagctacaacatcatcgcctgggactggaatggccccaagtggaccttcaccgtgctgggcagcagcacctggagccctgtgcagctgaacatcaatgagaccaagatccagtggcacggcaaggacaaccaggtgcccaagtctgtgtgcagcagtgactgcctggagggccaccagagggtggtgacaggcttccaccactgctgctttgaatgtgtgccctgtggggccggcaccttcctgaacaagagtgacctgtaccgctgccagccctgtgggaaggaggagtgggcccctgagggcagccagacctgcttccccaggacagtggtgttcctggccctgcgggagcacacctcctgggtgctgctggccgccaacaccctgctgctgctgctgctgctgggcacagctggcctgtttgcctggcacctggacacccctgtggtgcgctctgctgggggccgcctgtgcttcctgatgctgggcagcctggccgccggcagcggcagcctgtatggcttctttggagagcccagcctgcccctggtgagccccagcagctgcccagcctag

SEQ ID NO: 172661 - DNA, 2520 bp, Artificial Sequence
  Description of Artificial Sequence: Synthetic coding sequence
atgggcccccgggccaagaccatcagcagcctcttcttcctgctgtgggtgctggccgagccagcagaaaattctgacttctacctgcccggggactacctgctgggcggcctcttcagcctgcacgccaacatgaagggcatcgtgcacctgaacttcctgcaggtgcccatgtgcaaggagtatgaggtgaaggtgattggctacaacctgatgcaggccatgagatttgctgtggaggagatcaacaatgacagcagcctgctgcccggggtgctgctgggctatgagatcgtggatgtgtgctacatcagcaacaacgtgcagcctgtgctgtacttcctggcccacgaggacaacctgctgcccatccaggaggactacagcaactacatcagccgggtggtggccgtgattggaccagacaacagcgagagcgtgatgacagtggccaacttcctgagcctcttcctgctgccccagatcacctacagcgccatcagtgatgagctgcgggacaaggtgcgcttccctgccctgctgcggaccacccccagcgctgaccaccacatcgaggccatggtgcagctgatgctgcacttccgctggaactggatcatcgtgctggtgtccagtgacacctacggccgggacaatggccagctgctgggggagcgggtggcccggcgggacatctgcatcgccttccaggagaccctgcccaccctgcagcccaaccagaacatgaccagcgaggagcggcagaggctggtgaccatcgtggacaagctgcagcagagcacagcccgggtggtggtggtgttctccccagacctgaccctgtaccacttcttcaatgaggtgctgcggcagaacttcaccggggctgtgtggatcgccagcgagagctgggccatcgaccctgtgctgcacaacctgacagagctgcggcacctgggcaccttcctgggcatcaccatccagagcgtgcccatccctggcttcagcgagttccgggagtggggcccccaggccggccccccacccctgagcaggaccagccagagctacacctgcaaccaggagtgtgacaactgcctgaatgccaccctgtccttcaacaccatcctgcggctgagcggggagcgggtggtgtacagcgtgtacagcgctgtgtatgctgtggcccacgccctgcacagcctgctgggctgtgacaagagcacctgcaccaagagggtggtgtacccctggcagctgctggaggagatctggaaggtgaacttcaccctgctggaccaccagatcttctttgacccccagggagatgtggccctgcacctggagatcgtgcagtggcagtgggacaggagccagaaccccttccagagcgtggccagctactaccccctgcagaggcagctgaagaacatccaggacatctcctggcacaccatcaacaacaccatccccatgtccatgtgcagcaagcgctgccagagcggccagaagaagaagcctgtgggcatccacgtgtgctgctttgagtgcatcgactgcctgcccggcaccttcctgaaccacacagaagatgaatatgagtgccaggcctgccccaacaatgagtggagctaccagagcgagaccagctgcttcaagaggcagctggtgttcctggagtggcatgaggcccccaccatcgctgtggccctgctggccgccctgggcttcctgagcaccctggccatcctggtgatcttctggaggcacttccagacccccatcgtgcgctctgctgggggccccatgtgcttcctgatgctgaccctgctgctggtggcctacatggtggtgcctgtgtatgtgggcccccccaaggtgtccacctgcctgtgccggcaggccctcttccccctgtgcttcaccatctgcatcagctgcatcgctgtgcgctccttccagatcgtgtgtgccttcaagatggccagccgcttcccccgggcctacagctactgggtgcgctaccagggcccctacgtgtccatggccttcatcaccgtgctgaagatggtgattgtggtgattggcatgctggccaccggcctgagccccaccaccaggacagatcctgatgaccccaagatcaccatcgtgtcctgcaaccccaactacagaaacagcctgctcttcaacaccagcctggacctgctgctgtctgtggtgggcttctcctttgcctacatgggcaaggagctgcccaccaactacaatgaggccaagttcatcaccctgtccatgaccttctacttcaccagctctgtgtccctgtgcaccttcatgtctgcctacagcggcgtgctggtgaccatcgtggacctgctggtgacagtgctgaacctgctggccatcagcctgggctacttcggccccaagtgctacatgatcctcttctacccagagaggaacaccccagcctacttcaacagcatgatccagggctacaccatgagaagagactag

SEQ ID NO: 172662 - DNA, 2559 bp, Artificial Sequence
  Description of Artificial Sequence: Synthetic coding sequence
atgctgggccctgctgtgctgggcctgagcctgtgggccctgctgcaccctggcactggagcccccctgtgcctgagccagcagctgaggatgaagggggactatgtgctgggcggcctcttccccctgggggaggccgaggaggccggcctgcggagcaggacccggcccagcagccctgtgtgcacccgcttcagcagcaatggcctgctgtgggccctggccatgaagatggctgtggaggagatcaacaacaagagtgacctgctgcccggcctgcggctgggctatgacctgtttgacacctgcagcgagcctgtggtggccatgaagcccagcctgatgttcctggccaaggccggcagccgggacattgctgcctactgcaactacacccagtaccagccccgggtgctggccgtcatcggcccccacagcagcgagctggccatggtgacaggcaagttcttctccttcttcctgatgccccaggtgtcctatggagcctccatggagctgctgagcgcccgggagaccttccccagcttcttcagaacagtgcccagcgacagagtgcagctgacagctgctgctgagctgctgcaggagtttggctggaactgggtggccgccctgggcagtgatgatgaatatggccggcagggcctgagcatcttcagcgccctggccgccgcccggggcatctgcatcgcccacgagggcctggtgcccctgcccagggcagatgacagccggctgggcaaggtgcaggatgtgctgcaccaggtgaaccagagctctgtgcaggtggtgctgctgtttgcctctgtgcatgctgcccacgccctcttcaactacagcatcagcagccggctgagccccaaggtgtgggtggccagcgaggcctggctgaccagtgacctggtgatgggcctgcccggcatggcccagatgggcaccgtgctgggcttcctgcagagaggagcccagctgcacgagttcccccagtatgtgaagacccacctggccctggccacagatcctgccttctgcagcgccctgggggagcgggagcagggcctggaggaggatgtggtgggccagcgctgcccccagtgtgactgcatcaccctgcagaatgtgtctgctggcctgaaccaccaccagaccttctctgtgtatgctgctgtgtacagcgtggcccaggccctgcacaacaccctgcagtgcaatgccagcggctgcccagcccaggaccctgtgaagccctggcagctgctggagaacatgtacaacctgaccttccacgtgggcggcctgcccctgcgctttgacagcagtggaaatgtggacatggagtatgacctgaagctgtgggtgtggcagggctctgtgccccggctgcatgatgtgggccgcttcaacggcagcctgaggacagagcggctgaagatccgctggcacaccagtgacaaccagaagcctgtgagccgctgcagccggcagtgccaggagggccaggtgagaagagtgaagggcttccacagctgctgctatgactgtgtggactgtgaggccggcagctaccggcagaacccagatgacatcgcctgcaccttctgtggccaggatgagtggagccctgagaggagcacccgctgcttcagaagaagaagccgcttcctggcctggggcgagcctgctgtgctgctgctgctgctgctgctgagcctggccctgggcctggtgctggccgccctgggcctgtttgtgcaccaccgggacagccccctggtgcaggccagcggcggccccctggcctgcttcggcctggtgtgcctgggcctggtgtgcctgtctgtgctgctcttccctggccagcccagccctgcccgctgcctggcccagcagcccctgagccacctgcccctgaccggctgcctgagcaccctcttcctgcaggccgctgagatctttgtggagagcgagctgcccctgtcctgggccgaccggctgagcggctgcctgcggggcccctgggcctggctggtggtgctgctggccatgctggtggaggtggccctgtgcacctggtacctggtggccttccccccagaggtggtgacagactggcacatgctgcccacagaggccctggtgcactgcaggaccaggtcctgggtgtcctttggcctggcccacgccaccaatgccaccctggccttcctgtgcttcctgggcaccttcctggtgcgcagccagcccggctgctacaacagagcccggggcctgacctttgccatgctggcctacttcatcacctgggtgtcctttgtgcccctgctggccaacgtgcaggtggtgctgcggcctgctgtgcagatgggcgccctgctgctgtgtgtgctgggcatcctggccgccttccacctgccccgctgctacctgctgatgaggcagcccggcctgaacaccccagagttcttcctgggcggcggccctggagatgcccagggccagaatgatggcaacacaggcaaccagggcaagcatgaatag

SEQ ID NO: 172663 - DNA, 876 bp, Artificial Sequence
  Description of Artificial Sequence: Synthetic coding sequence
atgatccccatccagctgactgtgttcttcatgatcatctacgtgctggagagcctgaccatcatcgtgcagagcagcctcatcgtggccgtgctgggccgggagtggctgcaggtgcggcggctgatgcctgtggacatgatcctgatcagcctgggcatcagccgcttctgcctgcagtgggcctccatgctgaacaacttctgcagctacttcaacctgaactacgtgctgtgcaacctgaccatcacctgggagttcttcaacatcctgaccttctggctgaacagcctgctgaccgtcttctactgcatcaaggtgtcctccttcacccaccacatcttcctgtggctgcgctggaggatcctgcggctcttcccctggatcctgctgggcagcctgatgatcacctgtgtgaccatcatccccagcgccatcggcaactacatccagatccagctgctgaccatggagcacctgcccaggaacagcacagtgacagacaagctggagaacttccaccagtaccagttccaggcccacacagtggccctggtgatccccttcatcctcttcctggccagcaccatcttcctgatggccagcctgaccaagcagatccagcaccacagcacaggccactgcaaccccagcatgaaggcccgcttcaccgccctgcggagcctggccgtgctcttcatcgtgttcaccagctacttcctgaccatcctgatcaccatcatcggcaccctgtttgacaagcgctgctggctgtgggtgtgggaggcctttgtgtatgccttcatcctgatgcacagcaccagcctgatgctgagcagccccaccctgaagaggatcctgaagggcaagtgctag

SEQ ID NO: 172664 - DNA, 900 bp, Artificial Sequence
  Description of Artificial Sequence: Synthetic coding sequence
atgatgtgcttcctgctgatcatcagcagcatcctggtggtgtttgcctttgtgctgggcaatgtggccaacggcttcatcgccctggtgaatgtgattgactgggtgaacaccaggaagatcagcagcgctgagcagatcctgacagccctggtggtgagccgcatcggcctgctgtgggtgatgctgttcctgtggtacgccaccgtcttcaacagcgccctgtatggcctggaggtgcgcatcgtggccagcaatgcctgggccgtgaccaaccacttctccatgtggctggccgccagcctgagcatcttctgcctgctgaagatcgccaacttcagcaacctgatcagcctgcacctgaagaagaggatcaagtctgtggtgctggtgatcctgctgggccccctggtgttcctgatctgcaacctggccgtcatcaccatggatgagcgggtgtggaccaaggagtatgagggcaatgtgacctggaagatcaagctgagaaatgccatccacctgagcagcctgactgtgaccaccctggccaacctgatccccttcaccctgagcctcatctgcttcctgctgctgatctgcagcctgtgcaagcacctgaagaagatgaggctgcacagcaagggcagccaggaccccagcaccaaggtgcacatcaaggccctgcagacagtgaccagcttcctgatgctgtttgccatctacttcctgtgcatcatcaccagcacctggaacctgcggacccagcagagcaagctggtgctgctgctgtgccagacagtggccatcatgtaccccagcttccacagcttcatcctgatcatgggcagcaggaagctgaagcagaccttcctgtctgtgctgtggcagatgaccaggtag

SEQ ID NO: 172665 - DNA, 930 bp, Artificial Sequence
  Description of Artificial Sequence: Synthetic coding sequence
atgatgtccttcctgcacatcgtgttcagcatcctggtggtggtggccttcatcctgggcaactttgccaacggcttcatcgccctgatcaacttcatcgcctgggtgaagaggcagaagatcagcagcgctgaccagatcatcgccgccctggccgtgtcccgggtgggcctgctgtgggtgatcctgctgcactggtacagcacagtgctgaaccccaccagcagcaacctgaaggtgatcatcttcatcagcaatgcctgggccgtgaccaaccacttcagcatctggctggccaccagcctgagcatcttctacctgctgaagatcgtgaacttcagccgcctcatcttccaccacctgaagaggaaggccaagtctgtggtgctggtgattgtgctgggcagcctcttcttcctggtgtgccacctggtgatgaagcacacctacatcaacgtgtggacagaagaatgtgagggcaatgtgacctggaagatcaagctgagaaatgccatgcacctgagcaacctgactgtggccatgctggccaacctgatccccttcaccctgaccctcatctccttcctgctgctgatctacagcctgtgcaagcacctgaagaagatgcagctgcacggcaagggcagccaggaccccagcaccaagatccacatcaaggccctgcagacagtgaccagcttcctgatcctgctggccatctacttcctgtgcctgatcatctccttctggaacttcaagatgaggcccaaggagatcgtgctgatgctgtgccaggccttcggcatcatctaccccagcttccacagcttcatcctgatctggggcaacaagaccctgaagcagaccttcctgtctgtgctgtggcaggtgacctgctgggccaagggccagaaccagagcaccccctag

SEQ ID NO: 172666 - DNA, 951 bp, Artificial Sequence
  Description of Artificial Sequence: Synthetic coding sequence
atgatgggcctgacagaaggagtcttcctgatcctgagcggcacccagttcaccctgggcatcctggtgaactgcttcatcgagctggtgaatggcagctcctggttcaagaccaagaggatgagcctgagtgacttcatcatcaccaccctggccctgctgcgcatcatcctgctgtgcatcatcctgacagacagcttcctgattgagttcagccccaacacccatgacagcggcatcatcatgcagatcattgatgtgtcctggaccttcaccaaccacctgagcatctggctggccacctgcctgggcgtgctgtactgcctgaagatcgccagcttcagccaccccaccttcctgtggctgaagtggagggtgtcccgggtgatggtgtggatgctgctgggcgccctgctgctgagctgtggcagcacagccagcctcatcaatgagttcaagctgtacagcgtcttccggggcatcgaggccaccagaaatgtgacagagcacttcaggaagaagaggtctgagtactacctgatccacgtgctgggcaccctgtggtacctgcccccactcatcgtgtccctggccagctacagcctgctgatcttcagcctgggccgccacacccggcagatgctgcagaatggcaccagcagccgggaccccaccacagaggcccacaagagggccatccgcatcatcctgtccttcttcttcctgttcctgctgtacttcctggccttcctgattgccagctttggaaacttcctgcccaagaccaagatggccaagatgattggagaggtgatgaccatgttctacccagctggccacagcttcatcctgatcctgggcaacagcaagctgaagcagacctttgtggtgatgctgcgctgtgagagcggccacctgaagccaggcagcaagggccccatcttctcctag

SEQ ID NO: 172667 - DNA, 960 bp, Artificial Sequence
  Description of Artificial Sequence: Synthetic coding sequence
atgatcaccttcctgcccatcatcttcagcatcctgattgtggtgatctttgtgattggcaactttgccaacggcttcatcgccctggtgaacagcattgagtgggtgaagaggcagaagatcagctttgtggaccagatcctgacagccctggccgtgtcccgggtgggcctgctgtgggtgctgctgctgcactggtacgccacccagctgaacccagccttctacagcgtggaggtgcgcatcacagcctacaacgtgtgggccgtgaccaaccacttcagctcctggctggccaccagcctgtccatgttctacctgctgcgcatcgccaacttcagcaacctgatcttcctgcgcatcaagagaagagtgaagtctgtggtgctggtgatcctgctgggccccctgctcttcctggtgtgccacctgtttgtgatcaacatggatgagaccgtgtggaccaaggagtatgagggcaatgtgacctggaagatcaagctgcggagcgccatgtaccacagcaacatgaccctgaccatgctggccaactttgtgcccctgaccctgaccctcatctccttcctgctgctgatctgcagcctgtgcaagcacctgaagaagatgcagctgcacggcaagggcagccaggaccccagcaccaaggtgcacatcaaggccctgcagacagtgaccagcttcctgctgctgtgtgccatctacttcctgtccatgatcatctctgtgtgcaactttggccgcctggagaagcagcctgtgttcatgttctgccaggccatcatcttctcctaccccagcacccaccccttcatcctgatcctgggcaacaagaagctgaagcagatcttcctgtctgtgctgcggcacgtgcgctactgggtgaaggacaggagcctgcggctgcaccgcttcaccaggggggccctgtgtgtgttctag

SEQ ID NO: 172668 - DNA, 930 bp, Artificial Sequence
  Description of Artificial Sequence: Synthetic coding sequence
atgaccaccttcatccccatcatcttcagctctgtggtggtggtgctgtttgtgattggcaactttgccaacggcttcatcgccctggtgaacagcattgagcgggtgaagaggcagaagatcagctttgctgaccagatcctgacagccctggccgtgtcccgggtgggcctgctgtgggtgctgctgctgaactggtacagcacagtgttcaacccagccttctacagcgtggaggtgaggaccacagcctacaacgtgtgggccgtgacaggccacttcagcaactggctggccaccagcctgagcatcttctacctgctgaagatcgccaacttcagcaacctgatcttcctgcacctgaagagaagagtgaagagcgtcatcctggtgatgctgctgggccccctgctcttcctggcctgccagctgtttgtgatcaacatgaaggagatcgtgaggaccaaggagtatgagggcaacctgacctggaagatcaagctgcggtctgctgtgtacctgagtgatgccaccgtgaccaccctgggcaacctggtgcccttcaccctgaccctgctgtgcttcctgctgctgatctgcagcctgtgcaagcacctgaagaagatgcagctgcacggcaagggcagccaggaccccagcaccaaggtgcacatcaaggccctgcagaccgtcatcttcttcctgctgctgtgtgctgtgtacttcctgagcatcatgatctctgtgtggagctttggcagcctggagaacaagcctgtgttcatgttctgcaaggccatccgcttctcctaccccagcatccaccccttcatcctgatctggggcaacaagaagctgaagcagaccttcctgtctgtgctgcggcaggtgcgctactgggtgaagggggagaagcccagcagcccctag

SEQ ID NO: 172669 - DNA, 1002 bp, Artificial Sequence
  Description of Artificial Sequence: Synthetic coding sequence
atgctgaccctgacccgcatcagaacagtgtcctatgaggtgcgcagcaccttcctgttcatctctgtgctggagtttgctgtgggcttcctgaccaatgcctttgtgttcctggtgaacttctgggatgtggtgaagaggcaggccctgagcaacagcgactgtgtgctgctgtgcctgagcatcagccgcctcttcctgcacggcctgctcttcctgagcgccatccagctgacccacttccagaagctgtctgagcccctgaaccacagctaccaggccatcatcatgctgtggatgattgccaaccaggccaacctgtggctggccgcctgcctgagcctgctgtactgcagcaagctgatccgcttcagccacaccttcctgatctgcctggcctcctgggtgtccaggaagatcagccagatgctgctgggcatcatcctgtgcagctgcatctgcaccgtgctgtgtgtgtggtgcttcttcagccggccccacttcaccgtgaccaccgtgctcttcatgaacaacaacacccggctgaactggcagatcaaggacctgaacctcttctacagcttcctgttctgctacctgtggagcgtgccccccttcctgctcttcctggtgagcagcggcatgctgactgtgtccctgggccgccacatgaggaccatgaaggtgtacaccaggaacagccgggaccccagcctggaggcccacatcaaggccctgaagagcctggtgtccttcttctgcttcttcgtcatcagcagctgtgccgccttcatctctgtgcccctgctgatcctgtggagggacaagattggagtgatggtgtgtgtgggcatcatggccgcctgccccagcggccacgccgccatcctgatctctggaaatgccaagctgcggcgggctgtgatgaccatcctgctgtgggcccagagcagcctgaaggtgcgggctgaccacaaggctgacagcaggaccctgtgctag

SEQ ID NO: 172670 - DNA, 900 bp, Artificial Sequence
  Description of Artificial Sequence: Synthetic coding sequence
atgctgcggctcttctacttcagcgccatcatcgccagcgtcatcctgaactttgtgggcatcatcatgaacctcttcatcaccgtggtgaactgcaagacctgggtgaagagccaccgcatcagcagcagtgaccgcatcctcttcagcctgggcatcacccgcttcctgatgctgggcctcttcctggtgaacaccatctactttgtgagcagcaacacagagaggtctgtgtacctgagcgccttctttgtgctgtgcttcatgttcctggacagcagctctgtgtggtttgtgaccctgctgaacatcctgtactgtgtgaagatcaccaacttccagcacagcgtcttcctgctgctgaagaggaacatcagccccaagatcccccggctgctgctggcctgtgtgctgatcagcgccttcaccacctgcctgtacatcaccctgagccaggccagccccttccctgagctggtgaccaccaggaacaacaccagcttcaacatcagcgagggcatcctgagcctggtggtgtccctggtgctgagcagcagcctgcagttcatcatcaacgtgaccagcgccagcctgctgatccacagcctgcggcggcacatccagaagatgcagaagaatgccaccggcttctggaacccccagacagaggcccacgtgggcgccatgaagctgatggtgtacttcctgatcctgtacatcccctacagcgtggccaccctggtgcagtacctgcccttctacgccggcatggacatgggcaccaagagcatctgcctgatctttgccaccctgtacagccctggccacagcgtgctgatcatcatcacccaccccaagctgaagaccacagccaagaagatcctgtgcttcaagaagtag

SEQ ID NO: 172671 - DNA, 972 bp, Artificial Sequence
  Description of Artificial Sequence: Synthetic coding sequence
atggccaccgtgaacacagatgccacagacaaggacatcagcaagttcaaggtgaccttcaccctggtggtgtctggaattgagtgcatcaccggcatcctgggcagcggcttcatcacagccatctatggagctgagtgggcccggggcaagaccctgcccactggagaccgcatcatgctgatgctgtccttcagccggctgctgctgcagatctggatgatgctggagaacatcttcagcctgctcttccgcatcgtgtacaaccagaacagcgtgtacatcctcttcaaggtgatcaccgtcttcctgaaccacagcaacctgtggtttgctgcctggctgaaggtgttctactgcctgagaattgccaacttcaaccaccccctcttcttcctgatgaagaggaagatcatcgtgctgatgccctggctgctgcggctgtctgtgctggtgtccctgtccttctccttccccctgagcagagatgtgttcaacgtgtatgtgaacagcagcatccccatccccagcagcaacagcacagagaagaagtacttcagcgagaccaacatggtgaacctggtgttcttctacaacatgggcatctttgtgcccctcatcatgttcatcctggccgccaccctgctgatcctgagcctgaagaggcacaccctgcacatgggcagcaatgccaccggcagccgggaccccagcatgaaggcccacatcggggccatcaaggccaccagctacttcctgatcctgtacatcttcaatgccatcgccctcttcctgagcaccagcaacatctttgacacctacagctcctggaacatcctgtgcaagatcatcatggccgcctacccagctggccacagcgtgcagctgatcctgggcaaccctggcctgcggcgggcctggaagcgcttccagcaccaggtgcccctgtacctgaagggccagaccctgtag

SEQ ID NO: 172672 - DNA, 924 bp, Artificial Sequence
  Description of Artificial Sequence: Synthetic coding sequence
atgcaggccgccctgacagccttctttgtgctgctcttcagcctgctgagcctgctgggcattgctgccaacggcttcatcgtgctggtgctgggccgggagtggctgcgctatggccgcctgctgcccctggacatgatcctgatcagcctgggcgccagccgcttctgcctgcagctggtgggcaccgtgcacaacttctactacagcgcccagaaggtggagtacagcggcggcctgggccggcagttcttccacctgcactggcacttcctgaacagcgccaccttctggttctgctcctggctgtctgtgctcttctgtgtgaagatcgccaacatcacccacagcaccttcctgtggctgaagtggaggtttcctggctgggtgccctggctgctgctgggctctgtgctgatctccttcatcatcaccctgctcttcttctgggtgaactaccctgtgtaccaggagttcctgatcaggaagttcagcggcaacatgacctacaagtggaacacccgcatcgagacctactacttccccagcctgaagctggtgatctggagcatccccttcagcgtcttcctggtgtccatcatgctgctgatcaacagcctgcggcggcacacccagaggatgcagcacaacggccacagcctgcaggaccccagcacccaggcccacacccgggccctgaagagcctcatctccttcctgatcctgtatgccctgtccttcctgagcctcatcattgatgctgccaagttcatctccatgcagaatgacttctactggccctggcagattgctgtgtacctgtgcatctctgtgcaccccttcatcctgatcttcagcaacctgaagctgcggagcgtcttcagccagctgctgctgctggcccggggcttctgggtggcctag

SEQ ID NO: 172673 - DNA, 945 bp, Artificial Sequence
  Description of Artificial Sequence: Synthetic coding sequence
atggccacagagctggacaagatcttcctgatcctggccatcgccgagttcatcatctccatgctgggcaatgtgttcatcggcctggtgaactgcagcgagggcatcaagaaccagaaggtgttttctgctgacttcatcctgacctgcctggccatcagcaccatcggccagctgctggtgatcctgtttgacagcttcctggtgggcctggccagccacctgtacaccacctaccgcctgggcaagacagtcatcatgctgtggcacatgaccaaccacctgaccacctggctggccacctgcctgagcatcttctacttcttcaagatcgcccacttcccccacagcctcttcctgtggctgcgctggaggatgaatggcatgattgtgatgctgctgatcctgagcctcttcctgctgatctttgacagcctggtgctggagatcttcatcgacatcagcctgaacatcatcgacaagagcaacctgaccctgtacctggatgagagcaagaccctgtatgacaagctgagcatcctgaagaccctgctgagcctgaccagcttcatccccttcagcctcttcctgaccagcctgctcttcctgttcctgagcctggtgcgccacaccaggaacctgaagctgagcagcctgggcagccgggacagcagcacagaggcccaccggcgggccatgaagatggtgatgtccttcctgttcctgttcatcgtgcacttcttcagcctgcaggtggccaacggcatcttcttcatgctgtggaacaacaagtacatcaagtttgtgatgctggccctgaatgccttccccagctgccacagcttcatcctgatcctgggcaacagcaagctgcggcagacagctgtgcggctgctgtggcacctgaggaactacaccaagaccccaaatgccctgcccctgtag

SEQ ID NO: 172674 - DNA, 930 bp, Artificial Sequence
  Description of Artificial Sequence: Synthetic coding sequence
atgatcaccttcctgcccatcatcttcagcagcctggtggtggtgacctttgtgattggcaactttgccaacggcttcatcgccctggtgaacagcattgagtggttcaagaggcagaagatcagctttgctgaccagatcctgacagccctggccgtgtcccgggtgggcctgctgtgggtgctgctgctgaactggtacagcacagtgctgaacccagccttcaacagcgtggaggtgaggaccacagcctacaacatctgggccgtcatcaaccacttcagcaactggctggccaccaccctgagcatcttctacctgctgaagatcgccaacttcagcaacttcatcttcctgcacctgaagagaagagtgaagagcgtcatcctggtgatgctgctgggccccctgctcttcctggcctgccacctgtttgtgatcaacatgaatgagatcgtgaggaccaaggagtttgagggcaacatgacctggaagatcaagctgaagagcgccatgtacttcagcaacatgacagtgaccatggtggccaacctggtgcccttcaccctgaccctgctgtccttcatgctgctgatctgcagcctgtgcaagcacctgaagaagatgcagctgcacggcaagggcagccaggaccccagcaccaaggtgcacatcaaggccctgcagaccgtcatctccttcctgctgctgtgtgccatctacttcctgagcatcatgatctctgtgtggagctttggcagcctggagaacaagcctgtgttcatgttctgcaaggccatccgcttctcctaccccagcatccaccccttcatcctgatctggggcaacaagaagctgaagcagaccttcctgagcgtcttctggcagatgagatactgggtgaagggggagaagaccagcagcccctag

SEQ ID NO: 172675 - DNA, 930 bp, Artificial Sequence
  Description of Artificial Sequence: Synthetic coding sequence
atgatcaccttcctgcccatcatcttcagcatcctgattgtggtgacctttgtgattggcaactttgccaacggcttcatcgccctggtgaacagcattgagtggttcaagaggcagaagatcagctttgctgaccagatcctgacagccctggccgtgtcccgggtgggcctgctgtgggtgctggtgctgaactggtacgccacagagctgaacccagccttcaacagcattgaggtgcgcatcacagcctacaacgtgtgggccgtcatcaaccacttcagcaactggctggccaccagcctgagcatcttctacctgctgaagatcgccaacttcagcaacctgatcttcctgcacctgaagagaagagtgaagtctgtggtgctggtgatcctgctgggccccctgctcttcctggtgtgccacctgtttgtgatcaacatgaaccagatcatctggaccaaggagtatgagggcaacatgacctggaagatcaagctgcggagcgccatgtacctgagcaacaccaccgtgaccatcctggccaacctggtgcccttcaccctgaccctcatctccttcctgctgctgatctgcagcctgtgcaagcacctgaagaagatgcagctgcacggcaagggcagccaggaccccagcatgaaggtgcacatcaaggccctgcagacagtgaccagcttcctgctgctgtgtgccatctacttcctgagcatcatcatgtctgtgtggagctttgagagcctggagaacaagcctgtgttcatgttctgtgaggccatcgccttctcctaccccagcacccaccccttcatcctgatctggggcaacaagaagctgaagcagaccttcctgtctgtgctgtggcacgtgcgctactgggtgaagggggagaagcccagcagcagctag

SEQ ID NO: 172676 - DNA, 900 bp, Artificial Sequence
  Description of Artificial Sequence: Synthetic coding sequence
atgctgtctgctggcctgggcctgctgatgctggtggccgtggtggagttcctgattggcctgattggaaatggcagcctggtggtgtggagcttccgggagtggatcaggaagttcaactggagcagctacaacctgatcatcctgggcctggccggctgccgcttcctgctgcagtggctgatcatcctggacctgagcctcttccccctcttccagagcagccgctggctgcgctacctgagcatcttctgggtgctggtgtcccaggccagcctgtggtttgccaccttcctgagcgtcttctactgcaagaagatcaccacctttgacaggcctgcctacctgtggctgaagcagagggcctacaacctgagcctgtggtgcctgctgggctacttcatcatcaacctgctgctgactgtgcagatcggcctgaccttctaccaccccccccagggcaacagcagcatccgctacccctttgagagctggcagtacctgtatgccttccagctgaacagcggcagctacctgcccctggtggtgttcctggtgagcagcggcatgctgattgtgtccctgtacacccaccacaagaagatgaaggtgcacagcgctggaagaagagatgtgcgggccaaggcccacatcacagccctgaagagcctgggctgcttcctgctgctgcacctggtgtacatcatggccagccccttcagcatcaccagcaagacctaccccccagacctgacctctgtgttcatctgggagaccctgatggccgcctaccccagcctgcacagcctcatcctgatcatgggcatcccccgggtgaagcagacctgccagaagatcctgtggaagacagtgtgtgcccggcgctgctggggcccctag

SEQ ID NO: 172677 - DNA, 900 bp, Artificial Sequence
  Description of Artificial Sequence: Synthetic coding sequence
atgatcaccttcctgtacatcttcttcagcatcctgatcatggtgctgtttgtgctgggcaactttgccaacggcttcatcgccctggtgaacttcatcgactgggtgaagaggaagaagatcagcagcgctgaccagatcctgacagccctggccgtgagccgcatcggcctgctgtgggccctgctgctgaactggtacctgactgtgctgaacccagccttctacagcgtggagctgcgcatcaccagctacaatgcctgggtggtgaccaaccacttctccatgtggctggccgccaacctgagcatcttctacctgctgaagatcgccaacttcagcaacctgctcttcctgcacctgaagagaagagtgcgcagcgtcatcctggtgatcctgctgggcaccctcatcttcctggtgtgccacctgctggtggccaacatggatgagagcatgtgggccgaggagtatgagggcaacatgaccgggaagatgaagctgaggaacacagtgcacctgagctacctgactgtgaccaccctgtggagcttcatccccttcaccctgagcctcatctccttcctgatgctgatctgcagcctgtgcaagcacctgaagaagatgcagctgcacggggagggcagccaggacctgagcaccaaggtgcacatcaaggccctgcagaccctcatctccttcctgctgctgtgtgccatcttcttcctgttcctgattgtgtctgtgtggagcccccggcggctgagaaatgaccctgtggtgatggtgtccaaggctgtgggcaacatctacctggcctttgacagcttcatcctgatctggaggaccaagaagctgaagcacaccttcctgctgatcctgtgccagatccgctgctag

SEQ ID NO: 172678 - DNA, 957 bp, Artificial Sequence
  Description of Artificial Sequence: Synthetic coding sequence
atgaatggagaccacatggtgctgggcagctctgtgacagacaagaaggccatcatcctggtgaccatcctgctgctgctgcggctggtggccatcgctggaaatggcttcatcacagctgccctgggcgtggagtgggtgctgcggaggatgctgctgccctgtgacaagctgctggtgtccctgggcgccagccgcttctgcctgcagagcgtggtgatgggcaagaccatctacgtgttcctgcaccccatggccttcccctacaaccctgtgctgcagttcctggccttccagtgggacttcctgaatgctgccaccctgtggagcagcacctggctgtctgtgttctactgtgtgaagatcgccaccttcacccaccctgtgttcttctggctgaagcacaagctgagcggctggctgccctggatgctgttcagctctgtgggcctgagcagcttcaccaccatcctcttcttcatcggcaaccacaggatgtaccagaactacctgaggaaccacctgcagccctggaatgtgactggagacagcatccgcagctactgtgagaagttctacctgttccccctgaagatgatcacctggaccatgcccacagctgtgttcttcatctgcatgatcctgctgatcaccagcctgggccgccacaggaagaaggccctgctgaccaccagcggcttccgggagcccagcgtgcaggcccacatcaaggccctgctggccctgctgagctttgccatgctgttcatctcctacttcctgagcctggtgttttctgctgctggcatcttcccccccctggacttcaagttctgggtgtgggagagcgtcatctacctgtgtgccgctgtgcaccccatcatcctgctcttcagcaactgccgcctgcgggctgtgctgaagagccgccgcagcagccgctgtggcaccccctag

SEQ ID NO: 172679 - DNA, 1314 bp, Artificial Sequence
  Description of Artificial Sequence: Synthetic coding sequence
atgcccaagttcaaggccgcccggggcgtgggcggccaggagaagcacgcccccctggccgaccagatcctggccggaaatgctgtgcgggccggcgtgcgggagaagagaagaggccggggcaccggggaggccgaggaggagtatgtgggcccccggctgagccgccgcatcctgcagcaggcccggcagcagcaggaggagctggaggccgagcacggcactggagacaagccagctgccccccgggagaggaccacccggctgggccccaggatgccccaggacggcagtgatgatgaagatgaggagtggcccaccctggagaaggccgccaccatgacagctgctggccaccacgccgaggtggtggtggaccctgaagatgagcgggccatcgagatgttcatgaacaagaaccccccagcccggaggaccctggccgacatcatcatggagaagctgacagagaagcagacagaggtggagaccgtgatgtctgaggtgtctggcttccccatgccccagctggacccccgggtgctggaggtgtacagaggagtgcgggaggtgctgagcaagtacagaagtggcaagctgcccaaggccttcaagatcatcccagccctgagcaactgggagcagatcctgtatgtgacagagcctgaggcctggacagctgctgccatgtaccaggccacccgcatctttgccagcaacctgaaggagaggatggcccagcgcttctacaacctggtgctgctgccccgggtgagagatgatgtggccgagtacaagaggctgaacttccacctgtacatggccctgaagaaggccctcttcaagccaggggcctggttcaagggcatcctgatccccctgtgtgagagcggcacctgcaccctgcgggaggccatcatcgtgggcagcatcatcaccaagtgcagcatccctgtgctgcacagcagcgctgccatgctgaagattgctgagatggagtacagcggggccaacagcatcttcctgcggctgctgctggacaagaagtatgccctgccctacagagtgctggatgccctggtgttccacttcctgggcttcagaacagagaagcgggagctgcctgtgctgtggcaccagtgcctgctgaccctggtgcagcgctacaaggctgacctggccacagaccagaaggaggccctgctggagctgctgcggctgcagccccacccccagctgagccctgagatccggcgggagctgcagagcgctgtgcccagagatgtggaggatgtgcccatcaccgtggagtag

SEQ ID NO: 172680 - DNA, 951 bp, Artificial Sequence
  Description of Artificial Sequence: Synthetic coding sequence
atggaccagaacaacagcctgcccccctatgcccagggcctggccagcccccagggcgccatgaccccaggcatccccatcttcagccccatgatgccctacggcaccggcctgaccccccagcccatccagaacaccaacagcctgagcatcctggaggagcagcagaggcagcagcagcagcagcagcagcagcagcagcagcagcagcagcaggccgtggccgctgctgctgtgcagcagagcaccagccagcaggccacccagggcaccagcggccaggccccccagctgttccacagccagaccctgaccacagcccccctgcccggcaccacccccctgtaccccagccccatgacccccatgacccccatcaccccagccaccccagccagcgagagcagcggcatcgtgccccagctgcagaacatcgtgtccacagtgaacctgggctgcaagctggacctgaagaccatcgccctgcgggccagaaatgctgagtacaaccccaagagatttgctgctgtgatcatgaggatccgggagcccaggaccacagccctgatcttcagcagcggcaagatggtgtgcacaggagccaagtctgaggagcagagccggctggccgccaggaaatatgcccgggtggtgcagaagctgggcttccctgccaagttcctggacttcaagatccagaacatggtgggcagctgtgatgtgaagttccccatccggctggagggcctggtgctgacccaccagcagttcagcagctatgagcctgagctgtttcctggcctcatctacaggatgatcaagcccagaattgtgctgctgatctttgtgtctgggaaggtggtgctgaccggggccaaggtgcgggcagagatctatgaggcctttgagaacatctaccccatcctgaagggcttcaggaagaccacctag

SEQ ID NO: 172681 - DNA, 1020 bp, Artificial Sequence; identical to SEQ ID NO: 154797
  Description of Artificial Sequence: Synthetic coding sequence

SEQ ID NO: 172682 - DNA, 627 bp, Artificial Sequence
  Description of Artificial Sequence: Synthetic coding sequence
atggaccagaacaacagcctgcccccctatgcccagggcctggccagcccccagggcgccatgaccccaggcatccccatcttcagccccatgatgccctacggcaccggcctgaccccccagcccatccagaacaccaacagcctgagcatcctggaggagcagcagaggcagcagcagcagcagcagcagcagcagcagcagcagcagcagcagcagcagcagcagcagcagcagcagcagcagcagcagcagcagcagcagcagcagcagcagcagcagcaggccgtggccgctgctgctgtgcagcagagcaccagccagcaggccacccagggcaccagcggccaggccccccagctgttccacagccagaccctgaccacagcccccctgcccggcaccacccccctgtaccccagccccatgacccccatgacccccatcaccccagccaccccagccagcgagagcagcggcatcgtgccccagctgcagaacatcgtgtccacagtgaacctgggctgcaagctggacctgaagaccatcgccctgcgggccagaaatgctgagtacaaccccaagagatttgctgctgtgatcatgaggatccgggagcccaggtag

SEQ ID NO: 172683 - DNA, 456 bp, Artificial Sequence
  Description of Artificial Sequence: Synthetic coding sequence
atggaccagaacaacagcctgcccccctatgcccagggcctggccagcccccagggcgccatgaccccaggcatccccatcttcagccccatgatgccctacggcaccggcctgaccccccagcccatccagaacaccaacagcctgagcatcctggaggagcagcagaggcagcagcagcagcagcagcagcagcagcagcagcagcagcagcagcagcagcagcagcagcagcagcagcagcagcagcagcagcagcagcagcagcagcagcagcagcagcaggccgtggccgctgctgctgtgcagcagagcaccagccagcaggccacccagggcaccagcggccaggccccccagctgttccacagccagaccctgaccacagcccccctgcccggcaccacccccctgtaccccagccccatgacccccatgacccccatcaccccctag

SEQ ID NO: 172684 - DNA, 306 bp, Artificial Sequence
  Description of Artificial Sequence: Synthetic coding sequence
tgagaagagcagagccggctggccgccaggaaatatgcccgggtggtgcagaagctgggcttccctgccaagttcctggacttcaagatccagaacatggtgggcagctgtgatgtgaagttccccatctcctatgagcctgagctgtttcctggcctcatctacaggatgatcaagccccgcatcgtgctgctgatctttgtgtctgggaaggtggtgctgactggagccaaggtgcgggcagagatctatgaggcctttgagaacatctaccccatcctgaagggcttcaggaagaccacctag

SEQ ID NO: 172685 - DNA, 960 bp, Artificial Sequence
  Description of Artificial Sequence: Synthetic coding sequence
atgaccccaggcatccccatcttcagccccatgatgccctacggcaccggcctgaccccccagcccatccagaacaccaacagcctgagcatcctggaggagcagcagaggcagcagcagcagcagcagcagcagcagcagcagcagcagcagcagcagcagcagcagcagcagcagcagcagcagcagcagcagcagcagcagcagcagcagcagcagcagcaggccgtggccgctgctgctgtgcagcagagcaccagccagcaggccacccagggcaccagcggccaggccccccagctgttccacagccagaccctgaccacagcccccctgcccggcaccacccccctgtaccccagccccatgacccccatgacccccatcaccccagccaccccagccagcgagagcagcggcatcgtgccccagctgcagaacatcgtgtccacagtgaacctgggctgcaagctggacctgaagaccatcgccctgcgggccagaaatgctgagtacaaccccaagagatttgctgctgtgatcatgaggatccgggagcccaggaccacagccctgatcttcagcagcggcaagatggtgtgcaccggggccaagtctgaggagcagagccggctggccgccaggaaatatgcccgggtggtgcagaagctgggcttccctgccaagttcctggacttcaagatccagaacatggtgggcagctgtgatgtgaagttccccatccggctggagggcctggtgctgacccaccagcagttcagcagctatgagcctgagctgtttcctggcctcatctacaggatgatcaagccccgcatcgtgctgctgatctttgtgtctgggaaggtggtgctgactggagccaaggtgcgggcagagatctatgaggcctttgagaacatctaccccatcctgaagggcttcaggaagaccacctag

SEQ ID NO: 172686 - DNA, 2610 bp, Artificial Sequence
  Description of Artificial Sequence: Synthetic coding sequence
atggacttccccagcagcctgcggcctgccctcttcctgaccggccccctgggcctgagtgatgtgcctgacctgtccttcatgtgctcctggagagatgccctgaccctgcctgaggcccagccccagaacagtgaaaatggagccctgcacgtgaccaaggacctgctgtgggagcccgccaccccaggccccctgcccatgctgccccccctgattgacccctgggaccccggcctgacagcccgggacctgctcttccggggcggctgccgctacaggaagaggccccgggtggtgctggatgtgacagagcagatcagccgcttcctgctggaccatggagatgtggcctttgcccccctgggcaagctgatgctggagaacttcaagctggagggcgccggcagcaggaccaagaagaagacagtggtgtctgtgaagaagctgctgcaggacctgggcggccaccagccctggggctgcccctgggcctacctgagcaaccggcagaggcgcttcagcatcctgggcggccccatcctgggcacctctgtggccagccacctggccgagctgctgcacgaggagctggtgctgcgctgggagcagctgctgctggatgaggcctgcaccggcggggccctggcctgggtgcccggccgcaccccccagtttggccagctggtgtacccagctggaggagcccaggaccggctgcacttccaggaggtggtgctgacccctggggacaacccccagttcctgggcaagccaggccgcatccagctgcagggccctgtgcggcaggtggtgacctgcaccgtgcagggcgagagcaaggccctgatctacaccttcctgccccactggctgacctgctacctgaccccaggccccttccaccccagcagcgccctgctggccgtgcggagtgactaccactgtgctgtgtggaagtttgggaagcagtggcagcccaccctgctgcaggccatgcaggtggagaagggggccaccggcatcagcctgagcccccacctgcctggagagctggccatctgcagccgcagcggggctgtgtgcctgtggagcccagaagatggcctgcggcagatctacagagatcctgagaccctggtgttccgggacagcagctcctggcgctgggccgacttcaccgcccacccccgggtgctgactgtgggggacagaactggagtgaagatgctggacacccagggccccccaggctgcggcctgctgctcttccggctgggcgctgaggccagctgccagaagggggagcgggtgctgctgacccagtacctgggccacagcagccccaagtgcctgccccccaccctgcacctggtgtgcacccagttcagcctgtacctggtggatgagcggctgcccctggtgcccatgctgaagtggaaccacggcctgcccagccccctgctgctggcccggctgctgcccccaccccggcccagctgtgtgcagcccctgctgctgggcggccagggcggccagctgcagctgctgcacctggccggggagggcgcctctgtgccccggctggccggccccccccagagcctgcccagcagaattgacagcctgcctgccttccccctgctggagcccaagatccagtggaggctgcaggagcggctgaaggcccccaccatcggcctggccgctgtggtgccccccctgcccagcgcccccaccccaggcctggtgctcttccagctgtctgctgctggagatgtgttctaccagcagctgcggccccaggtggacagcagcctgcggagagatgctggccccccaggggacacccagcctgactgccacgcccccacagcctcctggaccagccaggacacagctggctgcagccagtggctgaaggccctgctgaaggtgcccctggcccctcctgtgtggacagcccccaccttcacccaccggcagatgctgggcagcacagagctgcggcgggaggaggaggagggccagaggctgggcgtgctgaggaaggccatggcccggggccagctgctgctgcagagggacctgggcagcctgcctgctgctgagcccccaccagcccctgagagcggcctggaggacaagctgtctgagcggctgggggaggcctgggccggccgcggggccgcctggtgggagcggcagcagggccgcaccagcgagcccggccggcagacccggcggcccaagaggaggacccagctgagcagcagcttcagcctgagcggccacgtggaccccagcgaggacaccagcagcccccacagccctgagtggcccccagcagatgccctgcccctgccccccaccaccccacccagccaggagctgaccccagatgcctgtgcccagggcgtgcccagcgagcagaggcagatgctgcgggactacatggccaagctgcccccccagagggacaccccaggctgtgccaccaccccaccccacagccaggccagctctgtgcgggccaccaggagccagcagcacacccctgtgctgagcagcagccagcccctgaggaagaagcccaggatgggcttctag

SEQ ID NO: 172687 - DNA, 1353 bp, Artificial Sequence
  Description of Artificial Sequence: Synthetic coding sequence
atgtctgacttcagcgaggagctgaagggccctgtgacagatgatgaggaggtggagacctctgtgctgagcggggccggcatgcacttcccctggctgcagacctacgtggagaccgtggccatcggcggcaagaggaggaaggactttgcccagaccaccagcgcctgcctgtccttcatccaggaggccctgctgaagcaccagtggcagcaggccgctgagtacatgtacagctacttccagaccctggaggacagcgacagctacaagaggcaggccgcccctgagatcatctggaagctgggcagcgagatcctcttctaccaccccaagagcaacatggagagcttcaacacctttgccaacaggatgaagaacatcggcgtgatgaactacctgaagatcagcctgcagcacgccctgtacctgctgcaccacggcatgctgaaggatgccaagaggaacctgtctgaggccgagacctggaggcatggagagaacaccagcagccgggagatcctgatcaacctgatccaggcctacaagggcctgctgcagtactacacctggagcgagaagaagatggagctgagcaagctggacaaggatgattatgcctacaatgctgtggcccaggatgtgttcaaccacagctggaagaccagcgccaacatcagcgccctgatcaagatccctggggtgtgggacccctttgtgaagagctatgtggagatgctggagttctacggggacagagatggagcccaggaggtgctgaccaactatgcctatgatgagaagttccccagcaaccccaatgcccacatctacctgtacaacttcctgaagaggcagaaggcccccaggagcaagctgatctctgtgctgaagatcctgtaccagatcgtgcccagccacaagctgatgctggagttccacaccctgctgaggaagtctgagaaggaggagcacaggaagctgggcctggaggtgctgtttggagtgctggactttgctggctgcaccaagaacatcacagcctggaagtacctggccaagtacctgaagaacatcctgatgggcaaccacctggcctgggtgcaggaggagtggaacagcaggaagaactggtggccaggcttccacttctcctacttctgggccaagagtgactggaaggaggacacagccctggcctgtgagaaggcctttgtggccggcctgctgctgggcaagggctgccgctacttccgctacatcctgaagcaggaccaccagatcctgggcaagaagatcaagaggatgaagaggtctgtgaagaagtacagcatcgtgaacccccggctgtag

SEQ ID NO: 172688 - DNA, 1353 bp, Artificial Sequence; identical to SEQ ID NO: 172687
  Description of Artificial Sequence: Synthetic coding sequence

SEQ ID NO: 172689 - DNA, 1011 bp, Artificial Sequence
  Description of Artificial Sequence: Synthetic coding sequence
atggagagcttcaacacctttgccaacaggatgaagaacatcggcgtgatgaactacctgaagatcagcctgcagcacgccctgtacctgctgcaccacggcatgctgaaggatgccaagaggaacctgtctgaggccgagacctggaggcatggagagaacaccagcagccgggagatcctgatcaacctgatccaggcctacaagggcctgctgcagtactacacctggagcgagaagaagatggagctgagcaagctggacaaggatgattatgcctacaatgctgtggcccaggatgtgttcaaccacagctggaagaccagcgccaacatcagcgccctgatcaagatccctggggtgtgggacccctttgtgaagagctatgtggagatgctggagttctacggggacagagatggagcccaggaggtgctgaccaactatgcctatgatgagaagttccccagcaaccccaatgcccacatctacctgtacaacttcctgaagaggcagaaggcccccaggagcaagctgatctctgtgctgaagatcctgtaccagatcgtgcccagccacaagctgatgctggagttccacaccctgctgaggaagtctgagaaggaggagcacaggaagctgggcctggaggtgctgtttggagtgctggactttgctggctgcaccaagaacatcacagcctggaagtacctggccaagtacctgaagaacatcctgatgggcaaccacctggcctgggtgcaggaggagtggaacagcaggaagaactggtggccaggcttccacttctcctacttctgggccaagagtgactggaaggaggacacagccctggcctgtgagaaggcctttgtggccggcctgctgctgggcaagggctgccgctacttccgctacatcctgaagcaggaccaccagatcctgggcaagaagatcaagaggatgaagaggtctgtgaagaagtacagcatcgtgaacccccggctgtag

SEQ ID NO: 172690 - DNA, 1011 bp, Artificial Sequence; identical to SEQ ID NO: 172689
  Description of Artificial Sequence: Synthetic coding sequence

SEQ ID NO: 172691 - DNA, 861 bp, Artificial Sequence
  Description of Artificial Sequence: Synthetic coding sequence
atgtctgacttcagcgaggagctgaagggccctgtgacagatgatgaggaggtggagacctctgtgctgagcggggccggcatgcacttcccctggctgcagacctacgtggagaccgtggccatcggcggcaagaggaggaaggactttgcccagaccaccagcgcctgcctgtccttcatccaggaggccctgctgaagcaccagtggcagcaggccgctgagtacatgtacagctacttccagaccctggaggacagcgacagctacaagaggcaggccgcccctgagatcagcctgcagcacgccctgtacctgctgcaccacggcatgctgaaggatgccaagaggaacctgtctgaggccgagacctggaggcatggagagaacaccagcagccgggagatcctgatcaacctgatccaggcctacaagggcctgctgcagtactacacctggagcgagaagaagatggagctgagcaagctggacaaggatgattatgcctacaatgctgtggcccaggatgtgttcaaccacagctggaagaccagcgccaacatcagcgccctgatcaagatccctggggtgtgggacccctttgtgaagagctatgtggagatgctggagttctacggggacagagatggagcccaggaggtgctgaccaactatgcctatgatgagaagttccccagcaaccccaatgcccacatctacctgtacaacttcctgaagaggcagaaggcccccaggagcaagctgatctctgtgctgaagatcctgtaccagatcgtgcccagccacaagctgatgctggagttccacaccctgctgaggaagtctgagaaggaggagtag

SEQ ID NO: 172692 - DNA, 849 bp, Artificial Sequence
  Description of Artificial Sequence: Synthetic coding sequence
atgtctgacttcagcgaggagctgaagggccctgtgacagatgatgaggaggtggagacctctgtgctgagcggggccggcatgcacttcccctggctgcagacctacgtggagaccgtggccatcggcggcaagaggaggaaggactttgcccagaccaccagcgcctgcctgtccttcatccaggaggccctgctgaagcaccagtggcagcaggccgctgagtacatgtacagctacttccagaccctggaggacagcgacagctacaagaggcaggccgcccctgagatcagcctgcagcacgccctgtacctgctgcaccacggcatgctgaaggatgccaagaggaacctgtctgaggccgagacctggaggcatggagagaacaccagcagccgggagatcctgatcaacctgatccaggcctacaagggcctgctgcagtactacacctggagcgagaagaagatggagctgagcaagctggacaaggatgattatgcctacaatgctgtggcccaggatgtgttcaaccacagctggaagaccagcgccaacatcagcgccctgatcaagatccctggggtgtgggacccctttgtgaagagctatgtggagatgctggagttctacggggacagagatggagcccaggaggtgctgaccaactatgcctatgatgagaagttccccagcaaccccaatgcccacatctacctgtacaacttcctgaagaggcagaaggcccccaggagcaagctgatctctgtgctgaagatcctgtaccagatcgtgcccagccacaagctgatgctggagttccacaccctgctgaggaagagctag

SEQ ID NO: 172693 - DNA, 936 bp, Artificial Sequence
  Description of Artificial Sequence: Synthetic coding sequence
atgtctgacttcagcgaggagctgaagggccctgtgacagatgatgaggaggtggagacctctgtgctgagcggggccggcatgcacttcccctggctgcagacctacgtggagaccgtggccatcggcggcaagaggaggaaggactttgcccagaccaccagcgcctgcctgtccttcatccaggaggccctgctgaagcaccagtggcagcaggccgctgagtacatgtacagctacttccagaccctggaggacagcgacagctacaagaggcaggccgcccctgagatcatctggaagctgggcagcgagatcctcttctaccaccccaagagcaacatggagagcttcaacacctttgccaacaggatgaagaacatcggcgtgatgaactacctgaagatcagcctgcagcacgccctgtacctgctgcaccacggcatgctgaaggatgccaagaggaacctgtctgaggccgagacctggaggcatggagagaacaccagcagccgggagatcctgatcaacctgatccaggcctacaagggcctgctgcagtactacacctggagcgagaagaagatggagctgagcaagctggacaaggatgattatgcctacaatgctgtggcccaggatgtgttcaaccacagctggaagaccagcgccaacatcagcgccctgatcaagatccctggggtgtgggacccctttgtgaagagctatgtggagatgctggagttctacggggacagagatggagcccaggaggtgctgaccaactatgcctatgatgagaagttccccagcaaccccaatgcccacatctacctgtacaacttcctgaagaggcagaaggcccccaggagcaagctgatctctgtgctgaagcacctgcagaagatcagcatcatgtacagcaccctgaggtag

SEQ ID NO: 172694 - DNA, 2328 bp, Artificial Sequence
  Description of Artificial Sequence: Synthetic coding sequence
atgctgccccccctgattgacccctgggaccccggcctgacagcccgggacctgctcttccggggcggctgccgctacaggaagaggccccgggtggtgctggatgtgacagagcagatcagccgcttcctgctggaccatggagatgtggcctttgcccccctgggcaagctgatgctggagaacttcaagctggagggcgccggcagcaggaccaagaagaagacagtggtgtctgtgaagaagctgctgcaggacctgggcggccaccagccctggggctgcccctgggcctacctgagcaaccggcagaggcgcttcagcatcctgggcggccccatcctgggcacctctgtggccagccacctggccgagctgctgcacgaggagctggtgctgcgctgggagcagctgctgctggatgaggcctgcacaggaggagccctggcctgggtgcccggccgcaccccccagtttggccagctggtgtacccagctgggggcgcccaggaccggctgcacttccaggaggtggtgctgacccctggggacaacccccagttcctgggcaagccaggccgcatccagctgcagggccctgtgcggcaggtggtgacctgcaccgtgcagggcgagaccctgctggccgtgcggagtgactaccactgtgctgtgtggaagtttgggaagcagtggcagcccaccctgctgcaggccatgcaggtggagaagggggccaccggcatcagcctgagcccccacctgcccggggagctggccatctgcagccgctctggagctgtgtgcctgtggagcccagaagatggcctgcggcagatctacagagatcctgagaccctggtgttccgggacagcagctcctggcgctgggccgacttcaccgcccacccccgggtgctgactgtgggggacagaactggagtgaagatgctggacacccagggccccccaggctgcggcctgctgctcttccggctgggcgctgaggccagctgccagaagggggagcgggtgctgctgacccagtacctgggccacagcagccccaagtgcctgccccccaccctgcacctggtgtgcacccagttcagcctgtacctggtggatgagcggctgcccctggtgcccatgctgaagtggaaccacggcctgcccagccccctgctgctggcccggctgctgcccccaccccggcccagctgtgtgcagcccctgctgctgggcggccagggcggccagctgcagctgctgcacctggccgagggcgcctctgtgccccggctggccggccccccccagagcctgcccagcagaattgacagcctgcctgccttccccctgctggagcccaagatccagtggaggctgcaggagcggctgaaggcccccaccatcggcctggccgctgtggtgccccccctgcccagcgcccccaccccaggcctggtgctcttccagctgtctgctgctggagatgtgttctaccagcagctgcggccccaggtggacagcagcctgcggagagatgctggccccccaggggacacccagcctgactgccacgcccccacagcctcctggaccagccaggacacagctggctgcagccagtggctgaaggccctgctgaaggtgcccctggcccctcctgtgtggacagcccccaccttcacccaccggcagatgctgggcagcacagagctgcggcgggaggaggaggagggccagaggctgggcgtgctgaggaaggccatggcccggggccagctgctgctgcagagggacctgggcagcctgcctgctgctgagcccccaccagcccctgagagcggcctggaggacaagctgtctgagcggctgggggaggcctgggccggccgcggggccgcctggtgggagcggcagcagggccgcaccagcgagcccggccggcagacccggcggcccaagaggaggacccagctgagcagcagcttcagcctgagcggccacgtggaccccagcgaggacaccagcagcccccacagccctgagtggcccccagcagatgccctgcccctgccccccaccaccccacccagccaggagctgaccccagatgcctgtgcccagggcgtgcccagcgagcagaggcagatgctgcgggactacatggccaagctgcccccccagagggacaccccaggctgtgccaccaccccaccccacagccaggccagctctgtgcgggccaccaggagccagcagcacacccctgtgctgagcagcagccagcccctgaggaagaagcccaggatgggcttctag

SEQ ID NO: 172695 - DNA, 2610 bp, Artificial Sequence; identical to SEQ ID NO: 172686
  Description of Artificial Sequence: Synthetic coding sequence

SEQ ID NO: 172696 - DNA, 1047 bp, Artificial Sequence
  Description of Artificial Sequence: Synthetic coding sequence
atggacttccccagcagcctgcggcctgccctcttcctgaccggccccctgggcctgagtgatgtgcctgacctgtccttcatgtgctcctggagagatgccctgaccctgcctgaggcccagccccagaacagtgaaaatggagccctgcacgtgaccaaggacctgctgtgggagcccgccaccccaggccccctgcccatgctgccccccctgattgacccctgggaccccggcctgacagcccgggacctgctcttccggggcggctgccgctacaggaagaggccccgggtggtgctggatgtgacagagcagatcagccgcttcctgctggaccatggagatgtggcctttgcccccctgggcaagctgatgctggagaacttcaagctggagggcgccggcagcaggaccaagaagaagacagtggtgtctgtgaagaagctgctgcaggacctgggcggccaccagccctggggctgcccctgggcctacctgagcaaccggcagaggcgcttcagcatcctgggcggccccatcctgggcacctctgtggccagccacctggccgagctgctgcacgaggagctggtgctgcgctgggagcagctgctgctggatgaggcctgcaccggcggggccctggcctgggtgcccggccgcaccccccagtttggccagctggtgtacccagctggaggagcccaggaccggctgcacttccaggaggtggtgctgacccctggggacaacccccagttcctgggcaagccaggccgcatccagctgcagggccctgtgcggcaggtggtgacctgcaccgtgcagggcgagaccctgctggccgtgcggagtgactaccactgtgctgtgtggaagtttgggaagcagtggcagcccaccctgctgcaggccatgcaggtggagaagggggccaccggcatcagcctgagcccccacctgcctggagagctggccatctgcagccgcagcggggctgtgtgcctgtggagcccagaagatggctaccgccgcttcctgtag

SEQ ID NO: 172697 - DNA, 2331 bp, Artificial Sequence
  Description of Artificial Sequence: Synthetic coding sequence
atgctgccccccctgattgacccctgggaccccggcctgacagcccgggacctgctcttccggggcggctgccgctacaggaagaggccccgggtggtgctggatgtgacagagcagatcagccgcttcctgctggaccatggagatgtggcctttgcccccctgggcaagctgatgctggagaacttcaagctggagggcgccggcagcaggaccaagaagaagacagtggtgtctgtgaagaagctgctgcaggacctgggcggccaccagccctggggctgcccctgggcctacctgagcaaccggcagaggcgcttcagcatcctgggcggccccatcctgggcacctctgtggccagccacctggccgagctgctgcacgaggagctggtgctgcgctgggagcagctgctgctggatgaggcctgcacaggaggagccctggcctgggtgcccggccgcaccccccagtttggccagctggtgtacccagctgggggcgcccaggaccggctgcacttccaggaggtggtgctgacccctggggacaacccccagttcctgggcaagccaggccgcatccagctgcagggccctgtgcggcaggtggtgacctgcaccgtgcagggcgagaccctgctggccgtgcggagtgactaccactgtgctgtgtggaagtttgggaagcagtggcagcccaccctgctgcaggccatgcaggtggagaagggggccaccggcatcagcctgagcccccacctgcccggggagctggccatctgcagccgctctggagctgtgtgcctgtggagcccagaagatggcctgcggcagatctacagagatcctgagaccctggtgttccgggacagcagctcctggcgctgggccgacttcaccgcccacccccgggtgctgactgtgggggacagaactggagtgaagatgctggacacccagggccccccaggctgcggcctgctgctcttccggctgggcgctgaggccagctgccagaagggggagcgggtgctgctgacccagtacctgggccacagcagccccaagtgcctgccccccaccctgcacctggtgtgcacccagttcagcctgtacctggtggatgagcggctgcccctggtgcccatgctgaagtggaaccacggcctgcccagccccctgctgctggcccggctgctgcccccaccccggcccagctgtgtgcagcccctgctgctgggcggccagggcggccagctgcagctgctgcacctggccggggagggcgcctctgtgccccggctggccggccccccccagagcctgcccagcagaattgacagcctgcctgccttccccctgctggagcccaagatccagtggaggctgcaggagcggctgaaggcccccaccatcggcctggccgctgtggtgccccccctgcccagcgcccccaccccaggcctggtgctcttccagctgtctgctgctggagatgtgttctaccagcagctgcggccccaggtggacagcagcctgcggagagatgctggccccccaggggacacccagcctgactgccacgcccccacagcctcctggaccagccaggacacagctggctgcagccagtggctgaaggccctgctgaaggtgcccctggcccctcctgtgtggacagcccccaccttcacccaccggcagatgctgggcagcacagagctgcggcgggaggaggaggagggccagaggctgggcgtgctgaggaaggccatggcccggggccagctgctgctgcagagggacctgggcagcctgcctgctgctgagcccccaccagcccctgagagcggcctggaggacaagctgtctgagcggctgggggaggcctgggccggcagaggagctgcctggtgggagcggcagcagggccgcaccagcgagcccggccggcagacccggcggcccaagaggaggacccagctgagcagcagcttcagcctgagcggccacgtggaccccagcgaggacaccagcagcccccacagccctgagtggcccccagcagatgccctgcccctgccccccaccaccccacccagccaggagctgaccccagatgcctgtgcccagggcgtgcccagcgagcagaggcagatgctgcgggactacatggccaagctgcccccccagagggacaccccaggctgtgccaccaccccaccccacagccaggccagctctgtgcgggccaccaggagccagcagcacacccctgtgctgagcagcagccagcccctgaggaagaagcccaggatgggcttctag

SEQ ID NO: 172698 - DNA, 1179 bp, Artificial Sequence
  Description of Artificial Sequence: Synthetic coding sequence
atgctgaagtggaaccacggcctgcccagccccctgctgctggcccggctgctgcccccaccccggcccagctgtgtgcagcccctgctgctgggcggccagggcggccagctgcagctgctgcacctggccgagggcgcctctgtgccccggctggccggccccccccagagcctgcccagcagaattgacagcctgcctgccttccccctgctggagcccaagatccagtggaggctgcaggagcggctgaaggcccccaccatcggcctggccgctgtggtgccccccctgcccagcgcccccaccccaggcctggtgctcttccagctgtctgctgctggagatgtgttctaccagcagctgcggccccaggtggacagcagcctgcggagagatgctggccccccaggggacacccagcctgactgccacgcccccacagcctcctggaccagccaggacacagctggctgcagccagtggctgaaggccctgctgaaggtgcccctggcccctcctgtgtggacagcccccaccttcacccaccggcagatgctgggcagcacagagctgcggcgggaggaggaggagggccagaggctgggcgtgctgaggaaggccatggcccggggccagctgctgctgcagagggacctgggcagcctgcctgctgctgagcccccaccagcccctgagagcggcctggaggacaagctgtctgagcggctgggggaggcctgggccggcagaggagctgcctggtgggagcggcagcagggccgcaccagcgagcccggccggcagacccggcggcccaagaggaggacccagctgagcagcagcttcagcctgagcggccacgtggaccccagcgaggacaccagcagcccccacagccctgagtggcccccagcagatgccctgcccctgccccccaccaccccacccagccaggagctgaccccagatgcctgtgcccagggcgtgcccagcgagcagaggcagatgctgcgggactacatggccaagctgcccccccagagggacaccccaggctgtgccaccaccccaccccacagccaggccagctctgtgcgggccaccaggagccagcagcacacccctgtgctgagcagcagccagcccctgaggaagaagcccaggatgggcttctag

SEQ ID NO: 172699 - DNA, 837 bp, Artificial Sequence
  Description of Artificial Sequence: Synthetic coding sequence
atggacaagagcggcatcgacagcctggaccacgtgaccagtgatgctgtggagctggccaacagaagtgacaacagcagtgacagcagcctcttcaagacccagtgcatcccctacagccccaagggggagaagaggaaccccatcaggaagtttgtgaggaccccagagagcgtgcacgccagtgacagcagcagtgacagcagctttgagcccatccccctgaccatcaaggccatctttgagcgcttcaagaacaggaagaagcgctacaagaagaagaagaagaggcgctaccagcccaccggccggccccggggccggcctgagggcagaagaaaccccatctacagcctgattgacaagaagaagcagttccgcagccggggcagcggcttccccttcctggagagtgaaaatgagaagaatgccccctggaggaagatcctgacctttgagcaggccgtggcccggggcttcttcaactacatcgagaagctgaagtatgagcaccacctgaaggagagcctgaagcagatgaatgtgggggaggacctggagaatgaagattttgacagccgccgctacaagttcctggatgatgatggcagcatcagccccatcgaggagagcacagcagaagatgaagatgccacccacctggaggacaatgaatgtgacatcaagctggccggggacagcttcatcgtgtcctctgagttccctgtgcggctgtctgtgtacctggaggaggaggacatcacagaggaggccgccctgagcaagaagagggccaccaaggccaagaacacaggccagaggggcctgaagatgtag

SEQ ID NO: 172700 - DNA, 837 bp, Artificial Sequence; identical to SEQ ID NO: 172699
  Description of Artificial Sequence: Synthetic coding sequence

SEQ ID NO: 172701 - DNA, 837 bp, Artificial Sequence; identical to SEQ ID NO: 172699
  Description of Artificial Sequence: Synthetic coding sequence

SEQ ID NO: 172702 - DNA, 27 bp, Artificial Sequence
  Description of Artificial Sequence: Synthetic coding sequence
atggacaagagcggcatcgacagctag

SEQ ID NO: 172703 - DNA, 3030 bp, Artificial Sequence
  Description of Artificial Sequence: Synthetic coding sequence
atgtcctggttcaatgccagccagctgagcagctttgccaagcaggccctgagccaggcccagaagagcattgacagagtgctggacatccaggaggaggagcccagcatctgggccgagaccatcccctacggggagcccggcatcagcagccctgtgtctgggggctgggacaccagcacctggggcctgaagagcaacacagagccccagagcccccccatcgccagccccaaggccatcaccaagcctgtgcggaggacagtggtggatgaaagtgagaacttcttcagcgccttcctgagccccaccgtgtccctgaaggtgtctgagagcgtgattgatgtgaagaccaccatggagagcatcagcaacaccagcacccagagcctgacagctgagaccaaggacatcgccctggagcccaaggagcagaagcatgaggaccggcagagcaacacccccagcccccctgtgtccaccttcagcagcggcaccagcaccaccagtgacatcgaggtgctggaccatgaatctgtcatcagcgagagcagcgccagcagccggcaggagaccacagacagcaagagcagcctgcacctgatgcagaccagcttccagctgctgagcgccagcgcctgcccagagtacaaccggctggatgacttccagaagctgacagagagctgctgcagcagtgatgcctttgaaagaattgacagcttctctgtgcagagcctggacagccgctctgtgtctgagatcaacagtgatgatgagctgagcggcaagggctacgccctggtgcccatcatcgtgaacagcagcacccccaagagcaagacagtggagagcgctgagggcaagtctgaggaggtgaatgagaccctggtgatccccacagaggaggccgagatggaggagagcggccgcagcgccacccctgtgaactgtgagcagcctgacatcctggtgagcagcacccccatcaatgaaggccagacagtgctggacaaggtggccgagcagtgtgagcctgctgagagccagcctgaggccctgtctgagaaggaggatgtgtgcaaggtgaccctgactgtggagttcctgaatgagaagctggagaagcgggaggcccagctgctgagcctgagcaaggagaaggccctgctggaggaggcctttgacaacctgaaggatgagatgttccgggtgaaggaggagagcagcagcatcagcagcctgaaggatgagttcacccagagaattgctgaggccgagaagaaggtgcagctggcctgcaaggagagagatgctgccaagaaggagatcaagaacatcaaggaggagctggccacccggctgaacagcagcgagacagctgacctgctgaaggagaaggatgagcagatccggggcctgatggaggagggggagaagctgagcaagcagcagctgcacaacagcaacatcatcaagaagctgcgggccaaggacaaggaaaatgaaaacatggtggccaagctgaacaagaaggtgaaggagctggaggaggagctgcagcacctgaagcaggtgctggatggcaaggaggaggtggagaagcagcaccgggagaacatcaagaagctgaacagcatggtggagcggcaggagaaggacctgggccgcctgcaggtggacatggatgagctggaggagaagaacagaagcatccaggccgccctggacagcgcctacaaggagctgacagacctgcacaaggccaatgctgccaaggacagcgaggcccaggaggccgccctgagccgggagatgaaggccaaggaggagctgtctgctgccctggagaaggcccaggaggaggcccggcagcagcaggagaccctggccatccaggtgggggacctgcggctggccctgcagaggacagagcaggccgccgccaggaaggaggactacctgcggcatgaaattggagagctgcagcagaggctgcaggaggccgagaacagaaaccaggagctgagccagagcgtgagcagcaccacccggcccctgctgcggcagatcgagaacctgcaggccaccctgggcagccagaccagctcctgggagaagctggagaagaacctgagtgaccggctgggggagagccagaccctgctggccgctgctgtggagcgggagcgggccgccacagaggagctgctggccaacaagatccagatgagctccatggagagccagaacagcctgctgcggcaggagaacagccgcttccaggcccagctggagagcgagaagaaccggctgtgcaagctggaggatgagaacaaccgctaccaggtggagctggagaacctgaaggatgaatatgtgaggaccctggaggagaccaggaaggagaagaccctgctgaacagccagctggagatggagaggatgaaggtggagcaggagaggaagaaggccatcttcacccaggagaccatcaaggagaaggagaggaagcccttctctgtgagcagcacccccaccatgagccgcagcagcagcatctctggagtggacatggccggcctgcagaccagcttcctgagccaggatgagagccatgaccacagctttggccccatgcccatcagcgccaacggcagcaacctgtatgatgctgtgaggatgggcgccggcagcagcatcatcgagaacctgcagagccagctgaagctgcgggagggggagatcacccacctgcagctggagatcggcaacctggagaagaccaggagcatcatggccgaggagctggtgaagctgaccaaccagaatgatgagctggaggagaaggtgaaggagatccccaagctgcggacccagctgcgggacctggaccagcgctacaacaccatcctgcagatgtatggagagaaggccgaggaggccgaggagctgcggctggacctggaggatgtgaagaacatgtacaagacccagattgatgagctgctgcggcagagcctgtcctag

SEQ ID NO: 172704 - DNA, 3282 bp, Artificial Sequence
  Description of Artificial Sequence: Synthetic coding sequence
atgtcctggttcaatgccagccagctgagcagctttgccaagcaggccctgagccaggcccagaagagcattgacagagtgctggacatccaggaggaggagcccagcatctgggccgagaccatcccctacggggagcccggcatcagcagccctgtgtctgggggctgggacaccagcacctggggcctgaagagcaacacagagccccagagcccccccatcgccagccccaaggccatcaccaagcctgtgcggaggacagtggtggatgaaagtgagaacttcttcagcgccttcctgagccccacagatgtgcagaccatccagaagagccctgtggtgtccaagcccccagccaagagccagaggcctgaggaggaggtgaagagcagcctgcacgagagcctgcacatcggccagagcaggaccccagagaccacagagagccaggtgaaggacagcagcctgtgtgtgtctggagagaccctggccgccggcaccagcagccccaagacagagggcaagcatgaggagaccgtgaacaaggagagtgacatgaaggtgcccaccgtgtccctgaaggtgtctgagagcgtgattgatgtgaagaccaccatggagagcatcagcaacaccagcacccagagcctgacagctgagaccaaggacatcgccctggagcccaaggagcagaagcatgaagatcggcagagcaacacccccagcccccctgtgtccaccttcagcagcggcaccagcaccaccagtgacatcgaggtgctggaccacgagagcgtcatcagcgagagcagcgccagcagccggcaggagaccacagacagcaagagcagcctgcacctgatgcagaccagcttccagctgctgagcgccagcgcctgcccagagtacaaccggctggatgacttccagaagctgacagagagctgctgcagcagtgatgcctttgaaagaattgacagcttctctgtgcagagcctggacagccgctctgtgtctgagatcaacagtgatgatgagctgagcggcaagggctacgccctggtgcccatcatcgtgaacagcagcacccccaagagcaagacagtggagagcgctgagggcaagtctgaggaggtgaatgagaccctggtgatccccacagaggaggccgagatggaggagagcggccgcagcgccacccctgtgaactgtgagcagcctgacatcctggtgagcagcacccccatcaatgaaggccagacagtgctggacaaggtggccgagcagtgtgagcctgctgagagccagcctgaggccctgtctgagaaggaggatgtgtgcaagacagtggagttcctgaatgagaagctggagaagcgggaggcccagctgctgagcctgagcaaggagaaggccctgctggaggaggcctttgacaacctgaaggatgagatgttccgggtgaaggaggagagcagcagcatcagcagcctgaaggatgagttcacccagagaattgctgaggccgagaagaaggtgcagctggcctgcaaggagagagatgctgccaagaaggagatcaagaacatcaaggaggagctggccacccggctgaacagcagcgagacagctgacctgctgaaggagaaggatgagcagatccggggcctgatggaggagggggagaagctgagcaagcagcagctgcacaacagcaacatcatcaagaagctgcgggccaaggacaaggaaaatgaaaacatggtggccaagctgaacaagaaggtgaaggagctggaggaggagctgcagcacctgaagcaggtgctggatggcaaggaggaggtggagaagcagcaccgggagaacatcaagaagctgaacagcatggtggagcggcaggagaaggacctgggccgcctgcaggtggacatggatgagctggaggagaagaacagaagcatccaggccgccctggacagcgcctacaaggagctgacagacctgcacaaggccaatgctgccaaggacagcgaggcccaggaggccgccctgagccgggagatgaaggccaaggaggagctgtctgctgccctggagaaggcccaggaggaggcccggcagcagcaggagaccctggccatccaggtgggggacctgcggctggccctgcagaggacagagcaggccgccgccaggaaggaggactacctgcggcatgaaattggagagctgcagcagaggctgcaggaggccgagaacagaaaccaggagctgagccagagcgtgagcagcaccacccggcccctgctgcggcagatcgagaacctgcaggccaccctgggcagccagaccagctcctgggagaagctggagaagaacctgagtgaccggctgggggagagccagaccctgctggccgctgctgtggagcgggagcgggccgccacagaggagctgctggccaacaagatccagatgagctccatggagagccagaacagcctgctgcggcaggagaacagccgcttccaggcccagctggagagcgagaagaaccggctgtgcaagctggaggatgagaacaaccgctaccaggtggagctggagaacctgaaggatgaatatgtgaggaccctggaggagaccaggaaggagaagaccctgctgaacagccagctggagatggagaggatgaaggtggagcaggagaggaagaaggccatcttcacccaggagaccatcaaggagaaggagaggaagcccttctctgtgagcagcacccccaccatgagccgcagcagcagcatctctggagtggacatggccggcctgcagaccagcttcctgagccaggatgagagccatgaccacagctttggccccatgcccatcagcgccaacggcagcaacctgtatgatgctgtgaggatgggcgccggcagcagcatcatcgagaacctgcagagccagctgaagctgcgggagggggagatcacccacctgcagctggagatcggcaacctggagaagaccaggagcatcatggccgaggagctggtgaagctgaccaaccagaatgatgagctggaggagaaggtgaaggagatccccaagctgcggacccagctgcgggacctggaccagcgctacaacaccatcctgcagatgtatggagagaaggccgaggaggccgaggagctgcggctggacctggaggatgtgaagaacatgtacaagacccagattgatgagctgctgcggcagagcctgtcctag

SEQ ID NO: 172705 - DNA, 1602 bp, Artificial Sequence
  Description of Artificial Sequence: Synthetic coding sequence
atgtcctggttcaatgccagccagctgagcagctttgccaagcaggccctgagccaggcccagaagagcattgacagagtgctggacatccaggaggaggagcccagcatctgggccgagaccatcccctacggggagcccggcatcagcagccctgtgtctgggggctgggacaccagcacctggggcctgaagagcaacacagagccccagagcccccccatcgccagccccaaggccatcaccaagcctgtgcggaggacagtggtggatgaaagtgagaacttcttcagcgccttcctgagccccacagatgtgcagaccatccagaagagccctgtggtgtccaagcccccagccaagagccagaggcctgaggaggaggtgaagagcagcctgcacgagagcctgcacatcggccagagcaggaccccagagaccacagagagccaggtgaaggacagcagcctgtgtgtgtctggagagaccctggccgccggcaccagcagccccaagacagagggcaagcatgaggagaccgtgaacaaggagagtgacatgaaggtgcccaccgtgtccctgaaggtgtctgagagcgtgattgatgtgaagaccaccatggagagcatcagcaacaccagcacccagagcctgacagctgagaccaaggacatcgccctggagcccaaggagcagaagcatgaagatcggcagagcaacacccccagcccccctgtgtccaccttcagcagcggcaccagcaccaccagtgacatcgaggtgctggaccacgagagcgtcatcagcgagagcagcgccagcagccggcaggagaccacagacagcaagagcagcctgcacctgatgcagaccagcttccagctgctgagcgccagcgcctgcccagagtacaaccggctggatgacttccagaagctgacagagagctgctgcagcagtgatgcctttgaaagaattgacagcttctctgtgcagagcctggacagccgctctgtgtctgagatcaacagtgatgatgagctgagcggcaagggctacgccctggtgcccatcatcgtgaacagcagcacccccaagagcaagacagtggagagcgctgagggcaagtctgaggaggtgaatgagaccctggtgatccccacagaggaggccgagatggaggagagcggccgcagcgccacccctgtgaactgtgagcagcctgacatcctggtgagcagcacccccatcaatgaaggccagacagtgctggacaaggtggccgagcagtgtgagcctgctgagagccagcctgaggccctgtctgagaaggaggatgtgtgcaagacagtggagttcctgaatgagaagctggagaagcgggaggcccagctgctgagcctgagcaaggagaaggccctgctggaggaggcctttgacaacctgaaggatgagatgttccgggtgaaggaggagagcagcagcatcagcagcctgaaggatgagttcacccagagaattgctgaggccgagaagaaggtgcagctggcctgcaaggagagagatgctgccaagaaggaggtgaagaggaagaagaggtag

SEQ ID NO: 172706 - DNA, 3291 bp, Artificial Sequence
  Description of Artificial Sequence: Synthetic coding sequence
atgtcctggttcaatgccagccagctgagcagctttgccaagcaggccctgagccaggcccagaagagcattgacagagtgctggacatccaggaggaggagcccagcatctgggccgagaccatcccctacggggagcccggcatcagcagccctgtgtctgggggctgggacaccagcacctggggcctgaagagcaacacagagccccagagcccccccatcgccagccccaaggccatcaccaagcctgtgcggaggacagtggtggatgaaagtgagaacttcttcagcgccttcctgagccccacagatgtgcagaccatccagaagagccctgtggtgtccaagcccccagccaagagccagaggcctgaggaggaggtgaagagcagcctgcacgagagcctgcacatcggccagagcaggaccccagagaccacagagagccaggtgaaggacagcagcctgtgtgtgtctggagagaccctggccgccggcaccagcagccccaagacagagggcaagcatgaggagaccgtgaacaaggagagtgacatgaaggtgcccaccgtgtccctgaaggtgtctgagagcgtgattgatgtgaagaccaccatggagagcatcagcaacaccagcacccagagcctgacagctgagaccaaggacatcgccctggagcccaaggagcagaagcatgaagatcggcagagcaacacccccagcccccctgtgtccaccttcagcagcggcaccagcaccaccagtgacatcgaggtgctggaccacgagagcgtcatcagcgagagcagcgccagcagccggcaggagaccacagacagcaagagcagcctgcacctgatgcagaccagcttccagctgctgagcgccagcgcctgcccagagtacaaccggctggatgacttccagaagctgacagagagctgctgcagcagtgatgcctttgaaagaattgacagcttctctgtgcagagcctggacagccgctctgtgtctgagatcaacagtgatgatgagctgagcggcaagggctacgccctggtgcccatcatcgtgaacagcagcacccccaagagcaagacagtggagagcgctgagggcaagtctgaggaggtgaatgagaccctggtgatccccacagaggaggccgagatggaggagagcggccgcagcgccacccctgtgaactgtgagcagcctgacatcctggtgagcagcacccccatcaatgaaggccagacagtgctggacaaggtggccgagcagtgtgagcctgctgagagccagcctgaggccctgtctgagaaggaggatgtgtgcaaggtgaccctgactgtggagttcctgaatgagaagctggagaagcgggaggcccagctgctgagcctgagcaaggagaaggccctgctggaggaggcctttgacaacctgaaggatgagatgttccgggtgaaggaggagagcagcagcatcagcagcctgaaggatgagttcacccagagaattgctgaggccgagaagaaggtgcagctggcctgcaaggagagagatgctgccaagaaggagatcaagaacatcaaggaggagctggccacccggctgaacagcagcgagacagctgacctgctgaaggagaaggatgagcagatccggggcctgatggaggagggggagaagctgagcaagcagcagctgcacaacagcaacatcatcaagaagctgcgggccaaggacaaggaaaatgaaaacatggtggccaagctgaacaagaaggtgaaggagctggaggaggagctgcagcacctgaagcaggtgctggatggcaaggaggaggtggagaagcagcaccgggagaacatcaagaagctgaacagcatggtggagcggcaggagaaggacctgggccgcctgcaggtggacatggatgagctggaggagaagaacagaagcatccaggccgccctggacagcgcctacaaggagctgacagacctgcacaaggccaatgctgccaaggacagcgaggcccaggaggccgccctgagccgggagatgaaggccaaggaggagctgtctgctgccctggagaaggcccaggaggaggcccggcagcagcaggagaccctggccatccaggtgggggacctgcggctggccctgcagaggacagagcaggccgccgccaggaaagaagactacctgcggcatgagatcggggagctgcagcagaggctgcaggaggctgaaaatagaaaccaggagctgagccagagcgtgagcagcaccacccggcccctgctgcggcagatcgagaacctgcaggccaccctgggcagccagaccagctcctgggagaagctggagaagaacctgagtgaccggctgggggagagccagaccctgctggccgctgctgtggagcgggagagagctgccacagaggagctgctggccaacaagatccagatgagctccatggagagccagaacagcctgctgcggcaggagaacagccgcttccaggcccagctggagagcgagaagaaccggctgtgcaagctggaggatgagaacaaccgctaccaggtggagctggagaacctgaaggatgaatatgtgaggaccctggaggagaccaggaaggagaagaccctgctgaacagccagctggagatggagaggatgaaggtggagcaggagaggaagaaggccatcttcacccaggagaccatcaaggagaaggagaggaagcccttctctgtgagcagcacccccaccatgagccgcagcagcagcatcagcggcgtggacatggccggcctgcagaccagcttcctgagccaggatgagagccatgaccacagctttggccccatgcccatcagcgccaacggcagcaacctgtatgatgctgtgaggatgggcgccggcagcagcatcatcgagaacctgcagagccagctgaagctgcgggagggggagatcacccacctgcagctggagatcggcaacctggagaagaccaggagcatcatggccgaggagctggtgaagctgaccaaccagaatgatgagctggaggagaaggtgaaggagatccccaagctgcggacccagctgcgggacctggaccagcgctacaacaccatcctgcagatgtacggggagaaggccgaggaggccgaggagctgcggctggacctggaggatgtgaagaacatgtacaagacccagattgatgagctgctgcggcagagcctgtcctag

SEQ ID NO: 172707 - DNA, 4950 bp, Artificial Sequence
  Description of Artificial Sequence: Synthetic coding sequence
atggagagcgtggagaaggactggggctggggcctgtggaggaacctgcgctgcctgggccacgcccaccagggcaagtgctgcacagaaggaggcatcagcagcaccaccaagaccagcagtgaaaatggcagctgctgctttgagaaggccgccaggaaggaccacgtgtgccgcttcatcggctgcggcagaaatgaccgcttcaactacgtggtgatgcagctgcagggcaggaacctggccgacctgcggcgcagccagagccggggcaccttcaccatcagcaccaccctgcggctgggccggcagatcctggagagcattgagagcatccacagcgtgggcttcctgcaccgggacatcaagcccagcaactttgccatgggccgcttccccagcacctgcaggaagtgctacatgctggactttggcctggcccggcagttcaccaacagctgtggagatgtgcggccccccagggctgtggccggcttccggggcaccgtgcgctatgccagcatcaatgcccacaggaaccgggagatgggcagacatgatgacctgtggagcctcttctacatgctggtggagtttgtggtgggccagctgccctggaggaagatcaaggacaaggagcaggtgggcagcatcaaggagagatatgaccaccggctgatgctgaagcacctgcccccagagttcagcatcttcctggaccacatcagcagcctggactacttcaccaagccagactaccagatgagcatccgggtgaccaggaagagctacaaggtgtccaccagcggcccccaggccttcaacagcctgagctacaccagcggccctggggcctgcatcagcagcagcagcttcagcaggatgggcagcagcagcttccggggcggcctgggcgccggctacggcggggccagcggcggcatcaccaccatcaccgtgaaccagagcctgctgagccccctgaacctggaggtggaccccaacatccaggccgtgaggacccaggaggagaagcagatcaagaccctgaacaacaagttcttctccttcatcgacaaggtgcgcttcctggagcagcagaacaagatgctggagaccaagtggagcctggtgcagcagcagaagatggcccggagcaacatggacaacatgtttgagagctacatcaacaacctgaagtggcagctggagaccctgggccaggagaagctgaagctggaggccgagctgggcaacatgcacggcctggtggaggacttcaggaacaagtatgaggtggagatcagcaaatgtacagagatggagaatgaatttgtgctgatcaaggagtatgtggatgaggcctacatgaacaagatggagctggagagcagcctgaaggagctgacagccaagatctccttcctgcggcagctgtatgaggaggagatcggcagctgcagccccaggagccgcatccacctgtggtgctgctcctggaccacagctgcctcctggacctggacagccagcagcctgcggagcaggcctgagggcttccctgggggctgccacgccgacacagagcagagaggagagctggccatcaaggatgccaatgccaagctgtctgagctggaggccgccctgcagctggccagccaggacatggcccggcagctgcgggagtaccaggagctgatgaatgtgaagctggccctggacatcaagatcgccacctacaggaagctgctggagggggaggagagctggctggagagcggcatgcagaacatgagcatccacatgaagaccaccagcagctatgctgggggccagagcctggcctatggaggcctgaccagccctggcctgtcctatggcctgggcagcagctttggaagtggcatgggcagcagcagcttcagccacaccagcagcagcagagctgtggtgatgaagaagattgagaccagagatggcaagctggtgtctgagagcagcaatgtgctgcccaacctgcgcatcacagccaccctgctgacctctgtgtttgacaacagcatcaagaccttcggcgtgattgaaagtgacccctttgactgggagaagacaggaaatgatggcagcctgaccaccaccaccaccagcaccaccccccagctgcacacccggctgaccccagctgccatcggcatcgccaatgccacccccatccctggggacctgctgcgggagaacacagatgaggtgtttcctgatgagcagctgagtgatggagaaaatggcatccctgtgggcgtgtccccagacaagctgcccggcagcctgggccacccccggccccaggagaaggatgtgtgggaggagatggatgccaacaagaacaagatcaagctgggcatctgcaaggccgccacagaggaggagaacagccacggccaggccaacggcctgctgaatgcccccagcctgggcagccccatccgggtgcgctctgagatcacccagcctgaccgggacatccccctggtgaggaagctgcggagcatccacagctttgagctggagaagaggctgaccctggagcccaagccagacacagacaagttcctggagacctgcctggagaagatgcagaaggacaccagcgctgggaaggagagcatcctgcctgccctgctgcacaagccctgtgtgcctgctgtgtccaggacagaccacatctggcactatgatgaggagtacctgcctgatgccagcaagccagccagcgccaacaccccagagcaggctgatggcggcggcagcaatggcttcatcgctgtgaacctgagcagctgcaagcaggagattgacagcaaggagtgggtgattgtggacaaggagcaggacctgcaggacttccgcaccaatgaggccgtgggccacaagaccaccggcagccccagtgatgaggagcctgaggtgctgcaggtgctggaggccagcccccaggatgagaagctgcagctgggcccctgggccgagaatgaccacctgaagaaggagaccagcggcgtggtgctggccctgtctgctgagggccccccaacagctgccagcgagcagtacacagaccggctggagctgcagcccggggccgccagccagttcatcgccgccacccccaccagcctgatggaggcccaggccgagggccccctgacagccatcaccatcccccggcccagcgtggccagcacccagagcaccagcggcagcttccactgcggccagcagcctgagaagaaggacctgcagcccatggagcccaccgtggagctgtacagcccccgggagaacttcagcggcctggtggtgacagaaggagagccccccagcggcggcagcaggacagacctgggcctgcagattgaccacatcggccatgacatgctgcccaacatccgggagagcaacaagagccaggacctgggccccaaggagctgcctgaccacaaccggctggtggtgcgggagtttgagaacctgcctggagaaacagaggagaagagcatcctgctggagagtgacaatgaagatgagaagctgagccggggccagcactgcatcgagatcagcagcctgcccggggacctggtgattgtggagaaggaccacagcgccaccacagagcccctggatgtgaccaagacccagaccttctctgtggtgcccaaccaggacaagaacaatgagatcatgaagctgctgactgtgggcaccagcgagatcagcagccgggacatcgacccccacgtggagggccagatcggccaggtggccgagatgcagaagaacaagatcagcaaggatgatgacatcatgtctgaggacctgcccggccaccagggcgacctgagcaccttcctgcaccaggagggcaagcgggagaagatcaccccaagaaatggagagctgttccactgtgtgtctgaaaatgagcacggggcccccaccaggaaggacatggtgcgcagcagctttgtgaccaggcacagccgcatccctgtgctggcccaggagattgacagcaccctggagagcagcagccctgtgtctgccaaggagaagctgctgcagaagaaggcctaccagcctgacctggtgaagctgctggtggagaagaggcagttcaagagcttcctgggggacctgagcagcgccagtgacaagctgctggaggagaagctggccaccgtgcctgcccccttctgtgaggaggaggtgctgacccccttcagccggctgactgtggacagccacctgagccgctctgctgaggacagcttcctgagccccatcatcagccagagcaggaagagcaagatccccaggcctgtgtcctgggtgaacacagaccaggtgaacagcagcaccagcagccagttcttcccccggcccccacctgggaagccacccaccaggcctggggtggaggcccggctgcggcgctacaaggtgctgggcagcagcaacagcgacagcgacctcttcagccggctggcccagatcctgcagaatggcagccagaagcccaggagcaccacccagtgcaagagccctggcagcccccacaaccccaagaccccacccaagagccctgtggtgcccaggaggagccccagcgccagccccaggagcagcagcctgcccaggaccagcagcagcagccccagccgggccggccggccccaccacgaccagaggagcagcagcccccacctgggccgcagcaagagcccccccagccacagcggcagcagcagcagccgccgcagctgccagcaggagcactgcaagcccagcaagaatggcctgaagggcagcggcagcctgcaccaccacagcgccagcaccaagaccccccagggcaagagcaagccagccagcaagctgagcaggtag

SEQ ID NO: 172708 - DNA, 3735 bp, Artificial Sequence
  Description of Artificial Sequence: Synthetic coding sequence
atgtctgggggcggggagcagctggacatcctgtctgtgggcatcctggtgaaggagcgctggaaggtgctgaggaagattggaggcggcggctttggagagatctatgatgccctggacatgctgaccagagaaaatgtggccctgaaggtggagagcgcccagcagcccaagcaggtgctgaagatggaggtggccgtgctgaagaagctgcagggcaaggaccacgtgtgccgcttcatcggctgcggcagaaatgaccgcttcaactacgtggtgatgcagctgcagggcaggaacctggccgacctgcggcgcagccagagccggggcaccttcaccatcagcaccaccctgcggctgggccggcagatcctggagagcattgagagcatccacagcgtgggcttcctgcaccgggacatcaagcccagcaactttgccatgggccgcttccccagcacctgcaggaagtgctacatgctggactttggcctggcccggcagttcaccaacagctgtggagatgtgcggccccccagggctgtggccggcttccggggcaccgtgcgctatgccagcatcaatgcccacaggaaccgggagatgggcagacatgatgacctgtggagcctcttctacatgctggtggagtttgtggtgggccagctgccctggaggaagatcaaggacaaggagcaggtgggcagcatcaaggagagatatgaccaccggctgatgctgaagcacctgcccccagagttcagcatcttcctggaccacatcagcagcctggactacttcaccaagccagactaccagctgctgacctctgtgtttgacaacagcatcaagacctttggagtcatcgagagtgacccctttgactgggagaagacaggaaatgatggcagcctgaccaccaccaccaccagcaccaccccccagctgcacacccggctgaccccagctgccatcggcatcgccaatgccacccccatccctggggacctgctgagagaaaatacagatgaggtgtttcctgatgagcagctgagtgatggagaaaatggcatccctgtgggcgtgtccccagacaagctgcccggcagcctgggccacccccggccccaggagaaggatgtgtgggaggagatggatgccaacaagaacaagatcaagctgggcatctgcaaggccgccacagaggaggagaacagccacggccaggccaacggcctgctgaatgcccccagcctgggcagccccatccgggtgcgctctgagatcacccagcctgaccgggacatccccctggtgaggaagctgcggagcatccacagctttgagctggagaagaggctgaccctggagcccaagccagacacagacaagttcctggagacctgcctggagaagatgcagaaggacaccagcgctgggaaggagagcatcctgcctgccctgctgcacaagccctgtgtgcctgctgtgtccaggacagaccacatctggcactatgatgaggagtacctgcctgatgccagcaagccagccagcgccaacaccccagagcaggctgatggcggcggcagcaatggcttcatcgctgtgaacctgagcagctgcaagcaggagattgacagcaaggagtgggtgattgtggacaaggagcaggacctgcaggacttccgcaccaatgaagctgtgggccacaagaccaccggcagccccagtgatgaggagcctgaggtgctgcaggtgctggaggccagcccccaggatgagaagctgcagctgggcccctgggccgagaatgaccacctgaagaaggagaccagcggcgtggtgctggccctgtctgctgagggccccccaacagctgccagcgagcagtacacagaccggctggagctgcagcctggagctgccagccagttcatcgccgccacccccaccagcctgatggaggcccaggccgagggccccctgacagccatcaccatcccccggcccagcgtggccagcacccagagcaccagcggcagcttccactgcggccagcagcctgagaagaaggacctgcagcccatggagcccaccgtggagctgtacagcccccgggagaacttcagcggcctggtggtgacagaaggagagcccccatctgggggcagcaggacagacctgggcctgcagattgaccacatcggccatgacatgctgcccaacatccgggagagcaacaagagccaggacctgggccccaaggagctgcctgaccacaaccggctggtggtgcgggagtttgagaacctgcccggggagacagaggagaagagcatcctgctggagagtgacaatgaagatgagaagctgagccggggccagcactgcatcgagatcagcagcctgcccggggacctggtgattgtggagaaggaccacagcgccaccacagagcccctggatgtgaccaagacccagaccttctctgtggtgcccaaccaggacaagaacaatgagatcatgaagctgctgactgtgggcaccagcgagatcagcagccgggacatcgacccccacgtggagggccagatcggccaggtggccgagatgcagaagaacaagatcagcaaggatgatgacatcatgtctgaggacctgcccggccaccagggcgacctgagcaccttcctgcaccaggagggcaagcgggagaagatcaccccaagaaatggagagctgttccactgtgtgtctgaaaatgaacatggagcccccaccaggaaggacatggtgcgcagcagctttgtgaccaggcacagccgcatccctgtgctggcccaggagattgacagcaccctggagagcagcagccctgtgtctgccaaggagaagctgctgcagaagaaggcctaccagcctgacctggtgaagctgctggtggagaagaggcagttcaagagcttcctgggggacctgagcagcgccagtgacaagctgctggaggagaagctggccaccgtgcctgcccccttctgtgaggaggaggtgctgacccccttcagccggctgactgtggacagccacctgagccgctctgcagaagattccttcctgagccccatcatcagccagagcaggaagagcaagatccccaggcctgtgtcctgggtgaacacagaccaggtgaacagcagcaccagcagccagttcttccccaggcctcctcctgggaagccacccaccaggcctggggtggaggcccggctgcggcgctacaaggtgctgggcagcagcaacagcgacagcgacctcttcagccggctggcccagatcctgcagaatggcagccagaagcccaggagcaccacccagtgcaagagccctggcagcccccacaaccccaagaccccacccaagagccctgtggtgccccggcgcagccccagcgccagccccaggagcagcagcctgcccaggaccagcagcagcagccccagcagagctggccggccccaccacgaccagaggagcagcagcccccacctgggccgcagcaagagcccccccagccacagcggcagcagcagcagcagaagaagctgccagcaggagcactgcaagcccagcaagaatggcctgaagggcagcggcagcctgcaccaccacagcgccagcaccaagaccccccagggcaagagcaagccagccagcaagctgagcaggtag

SEQ ID NO: 172709 - DNA, 3525 bp, Artificial Sequence
  Description of Artificial Sequence: Synthetic coding sequence
gagcccgggaaggaccacgtgtgccgcttcatcggctgcggcagaaatgaccgcttcaactacgtggtgatgcagctgcagggcaggaacctggccgacctgcggcgcagccagagccggggcaccttcaccatcagcaccaccctgcggctgggccggcagatcctggagagcattgagagcatccacagcgtgggcttcctgcaccgggacatcaagcccagcaactttgccatgggccgcttccccagcacctgcaggaagtgctacatgctggactttggcctggcccggcagttcaccaacagctgtggagatgtgcggccccccagggctgtggccggcttccggggcaccgtgcgctatgccagcatcaatgcccacaggaaccgggagatgggcagacatgatgacctgtggagcctcttctacatgctggtggagtttgtggtgggccagctgccctggaggaagatcaaggacaaggagcaggtgggcagcatcaaggagagatatgaccaccggctgatgctgaagcacctgcccccagagttcagcatcttcctggaccacatcagcagcctggactacttcaccaagccagactaccagctgctgacctctgtgtttgacaacagcatcaagacctttggagtcatcgagagtgacccctttgactgggagaagacaggaaatgatggcagcctgaccaccaccaccaccagcaccaccccccagctgcacacccggctgaccccagctgccatcggcatcgccaatgccacccccatccctggggacctgctgagagaaaatacagatgaggtgtttcctgatgagcagctgagtgatggagaaaatggcatccctgtgggcgtgtccccagacaagctgcccggcagcctgggccacccccggccccaggagaaggatgtgtgggaggagatggatgccaacaagaacaagatcaagctgggcatctgcaaggccgccacagaggaggagaacagccacggccaggccaacggcctgctgaatgcccccagcctgggcagccccatccgggtgcgctctgagatcacccagcctgaccgggacatccccctggtgaggaagctgcggagcatccacagctttgagctggagaagaggctgaccctggagcccaagccagacacagacaagttcctggagacctgcctggagaagatgcagaaggacaccagcgctgggaaggagagcatcctgcctgccctgctgcacaagccctgtgtgcctgctgtgtccaggacagaccacatctggcactatgatgaggagtacctgcctgatgccagcaagccagccagcgccaacaccccagagcaggctgatggcggcggcagcaatggcttcatcgctgtgaacctgagcagctgcaagcaggagattgacagcaaggagtgggtgattgtggacaaggagcaggacctgcaggacttccgcaccaatgaagctgtgggccacaagaccaccggcagccccagtgatgaggagcctgaggtgctgcaggtgctggaggccagcccccaggatgagaagctgcagctgggcccctgggccgagaatgaccacctgaagaaggagaccagcggcgtggtgctggccctgtctgctgagggccccccaacagctgccagcgagcagtacacagaccggctggagctgcagcctggagctgccagccagttcatcgccgccacccccaccagcctgatggaggcccaggccgagggccccctgacagccatcaccatcccccggcccagcgtggccagcacccagagcaccagcggcagcttccactgcggccagcagcctgagaagaaggacctgcagcccatggagcccaccgtggagctgtacagcccccgggagaacttcagcggcctggtggtgacagaaggagagcccccatctgggggcagcaggacagacctgggcctgcagattgaccacatcggccatgacatgctgcccaacatccgggagagcaacaagagccaggacctgggccccaaggagctgcctgaccacaaccggctggtggtgcgggagtttgagaacctgcccggggagacagaggagaagagcatcctgctggagagtgacaatgaagatgagaagctgagccggggccagcactgcatcgagatcagcagcctgcccggggacctggtgattgtggagaaggaccacagcgccaccacagagcccctggatgtgaccaagacccagaccttctctgtggtgcccaaccaggacaagaacaatgagatcatgaagctgctgactgtgggcaccagcgagatcagcagccgggacatcgacccccacgtggagggccagatcggccaggtggccgagatgcagaagaacaagatcagcaaggatgatgacatcatgtctgaggacctgcccggccaccagggcgacctgagcaccttcctgcaccaggagggcaagcgggagaagatcaccccaagaaatggagagctgttccactgtgtgtctgaaaatgaacatggagcccccaccaggaaggacatggtgcgcagcagctttgtgaccaggcacagccgcatccctgtgctggcccaggagattgacagcaccctggagagcagcagccctgtgtctgccaaggagaagctgctgcagaagaaggcctaccagcctgacctggtgaagctgctggtggagaagaggcagttcaagagcttcctgggggacctgagcagcgccagtgacaagctgctggaggagaagctggccaccgtgcctgcccccttctgtgaggaggaggtgctgacccccttcagccggctgactgtggacagccacctgagccgctctgcagaagattccttcctgagccccatcatcagccagagcaggaagagcaagatccccaggcctgtgtcctgggtgaacacagaccaggtgaacagcagcaccagcagccagttcttccccaggcctcctcctgggaagccacccaccaggcctggggtggaggcccggctgcggcgctacaaggtgctgggcagcagcaacagcgacagcgacctcttcagccggctggcccagatcctgcagaatggcagccagaagcccaggagcaccacccagtgcaagagccctggcagcccccacaaccccaagaccccacccaagagccctgtggtgccccggcgcagccccagcgccagccccaggagcagcagcctgcccaggaccagcagcagcagccccagcagagctggccggccccaccacgaccagaggagcagcagcccccacctgggccgcagcaagagcccccccagccacagcggcagcagcagcagcagaagaagctgccagcaggagcactgcaagcccagcaagaatggcctgaagggcagcggcagcctgcaccaccacagcgccagcaccaagaccccccagggcaagagcaagccagccagcaagctgagcaggtag

SEQ ID NO: 172710 - DNA, 2244 bp, Artificial Sequence
  Description of Artificial Sequence: Synthetic coding sequence
atgaccagcttccaggaggtgcccctgcagaccagcaactttgcccacgtgatcttccagaatgtggccaagagctacctgcccaatgcccacctggagtgccactacaccctgaccccctacatccacccccaccccaaggactgggtgggcatcttcaaggtgggctggagcacagcccgggactactacaccttcctgtggagccccatgcctgagcactacgtggagggcagcacagtgaactgtgtgctggccttccagggctactacctgcccaatgatgatggagagttctaccagttctgctacgtgacccacaagggggagatccggggggccagcacccccttccagttccgggccagcagccctgtggaggagctgctgaccatggaggatgagggcaacagcgacatgctggtggtgaccaccaaggccggcctgctggagctgaagattgagaagaccatgaaggagaaggaggagctgctgaagctgattgctgtgctggagaaggagacagcccagctgcgggagcaggtgggccgcatggagcgggagctgaaccacgagaaggagcgctgtgaccagctgcaggccgagcagaagggcctgacagaggtgacccagagcctgaagatggagaatgaggagttcaagaagcgcttcagtgatgccaccagcaaggcccaccagctggaggaggacatcgtgtctgtgacccacaaggccatcgagaaggagacagagctggacagcctgaaggacaagctgaagaaggcccagcacgagcgggagcagctggagtgccagctgaagacagagaaggatgagaaggagctgtacaaggtgcacctgaagaacacagaaattgagaacaccaagctgatgtctgaggtgcagaccctgaagaacctggatggcaacaaggagagcgtcatcacccacttcaaggaggagatcggccgcctgcagctgtgcctggccgagaaggagaacctgcagaggaccttcctgctgaccaccagcagcaaagaagacacctgcttcctgaaggagcagctgaggaaggccgaggagcaggtgcaggccacccggcaggaggtggtgttcctggccaaggagctgagtgatgctgtgaatgtgcgggacaggaccatggctgacctgcacacagcccggctggagaatgagaaggtgaagaagcagctggctgatgctgtggccgagctgaagctgaatgccatgaagaaggaccaggacaagacagacaccctggagcacgagctgcggcgggaggtggaggacctgaagctgcggctgcagatggctgctgaccactacaaggagaagttcaaggagtgccagaggctgcagaagcagatcaacaagctgagtgaccagagcgccaacaacaacaacgtgttcaccaagaagacaggcaaccagcagaaggtgaatgatgcctctgtgaacacagatcctgccaccagcgccagcacagtggatgtgaagcccagccccagcgctgctgaggccgactttgacatcgtgaccaagggccaggtgtgtgagatgaccaaggagattgctgacaagacagagaagtacaacaagtgcaagcagctgctgcaggatgagaaggccaagtgcaacaagtatgcagatgagctggccaagatggagctgaagtggaaggagcaggtgaagattgctgaaaatgtgaagctggagctggccgaggtgcaggacaactacaaggagctgaagaggagcctggagaacccagctgagaggaagatggaggatggagcagatggagccttctacccagatgagatccagaggcctcctgtgcgggtgcccagctggggcctggaggacaacgtggtgtgcagccagcctgccaggaacttcagcaggccagatggcctggaggacagcgaggacagcaaggaggatgaaaatgtgcccacagccccagacccccccagccagcacctgcggggccacggcaccggcttctgctttgacagcagctttgatgtgcacaagaagtgccccctgtgtgagctgatgttcccccccaactatgaccagagcaagtttgaggagcacgtggagagccactggaaggtgtgccccatgtgcagcgagcagtttcctccagactatgaccagcaggtgtttgagcggcacgtgcagacccactttgaccagaatgtgctgaactttgattag

SEQ ID NO: 172711 - DNA, 2370 bp, Artificial Sequence
  Description of Artificial Sequence: Synthetic coding sequence
atgaccagcttccaggaggtgcccctgcagaccagcaactttgcccacgtgatcttccagaatgtggccaagagctacctgcccaatgcccacctggagtgccactacaccctgaccccctacatccacccccaccccaaggactgggtgggcatcttcaaggtgggctggagcacagcccgggactactacaccttcctgtggagccccatgcctgagcactacgtggagggcagcacagtgaactgtgtgctggccttccagggctactacctgcccaatgatgatggagagttctaccagttctgctacgtgacccacaagggggagatccggggggccagcacccccttccagttccgggccagcagccctgtggaggagctgctgaccatggaggatgagggcaacagcgacatgctggtggtgaccaccaaggccggcctgctggagctgaagattgagaagaccatgaaggagaaggaggagctgctgaagctgattgctgtgctggagaaggagacagcccagctgcgggagcaggtgggccgcatggagcgggagctgaaccacgagaaggagcgctgtgaccagctgcaggccgagcagaagggcctgacagaggtgacccagagcctgaagatggagaatgaggagttcaagaagcgcttcagtgatgccaccagcaaggcccaccagctggaggaggacatcgtgtctgtgacccacaaggccatcgagaaggagacagagctggacagcctgaaggacaagctgaagaaggcccagcacgagcgggagcagctggagtgccagctgaagacagagaaggatgagaaggagctgtacaaggtgcacctgaagaacacagaaattgagaacaccaagctgatgtctgaggtgcagaccctgaagaacctggatggcaacaaggagagcgtcatcacccacttcaaggaggagatcggccgcctgcagctgtgcctggccgagaaggagaacctgcagaggaccttcctgctgaccaccagcagcaaagaagacacctgcttcctgaaggagcagctgaggaaggccgaggagcaggtgcaggccacccggcaggaggtggtgttcctggccaaggagctgagtgatgctgtgaatgtgcgggacaggaccatggctgacctgcacacagcccggctggagaatgagaaggtgaagaagcagctggctgatgctgtggccgagctgaagctgaatgccatgaagaaggaccaggacaagacagacaccctggagcacgagctgcggcgggaggtggaggacctgaagctgcggctgcagatggctgctgaccactacaaggagaagttcaaggagtgccagaggctgcagaagcagatcaacaagctgagtgaccagagcgccaacaacaacaacgtgttcaccaagaagacaggcaaccagcagaaggtgaatgatgcctctgtgaacacagatcctgccaccagcgccagcacagtggatgtgaagcccagccccagcgctgctgaggccgactttgacatcgtgaccaagggccaggtgtgtgagatgaccaaggagattgctgacaagacagagaagtacaacaagtgcaagcagctgctgcaggatgagaaggccaagtgcaacaagtatgcagatgagctggccaagatggagctgaagtggaaggagcaggtgaagattgctgaaaatgtgaagctggagctggccgaggtgcaggacaactacaaggagctgaagaggagcctggagaacccagctgagaggaagatggagggccagaacagccagagcccccagtgcttcaagacctgcagcgagcagaatggctacgtgctgaccctgagcaatgcccagcctgtgctgcagtatggcaacccctatgccagccaggagaccagagatggagcagatggagccttctacccagatgagatccagaggcctcctgtgcgggtgcccagctggggcctggaggacaacgtggtgtgcagccagcctgccaggaacttcagcaggccagatggcctggaggacagcgaggacagcaaggaggatgaaaatgtgcccacagccccagacccccccagccagcacctgcggggccacggcaccggcttctgctttgacagcagctttgatgtgcacaagaagtgccccctgtgtgagctgatgttcccccccaactatgaccagagcaagtttgaggagcacgtggagagccactggaaggtgtgccccatgtgcagcgagcagtttcctccagactatgaccagcaggtgtttgagcggcacgtgcagacccactttgaccagaatgtgctgaactttgattag

SEQ ID NO: 172712 - DNA, 417 bp, Artificial Sequence
  Description of Artificial Sequence: Synthetic coding sequence
atgaccagcttccaggaggtgcccctgcagaccagcaactttgcccacgtgatcttccagaatgtggccaagagctacctgcccaatgcccacctggagtgccactacaccctgaccccctacatccacccccaccccaaggactgggtgggcatcttcaaggtgggctggagcacagcccgggactactacaccttcctgtggagccccatgcctgagcactacgtggagggcagcacagtgaactgtgtgctggccttccagggctactacctgcccaatgatgatggagagttctaccagttctgctacgtgacccacaagggggagatccggggggccagcacccccttccagttccgggccagcagccctgtggaggagctgctgaccatggaggatgagggcaacagctag

SEQ ID NO: 172713 - DNA, 297 bp, Artificial Sequence
  Description of Artificial Sequence: Synthetic coding sequence
atgaccagcttccaggaggtgcccctgcagaccagcaactttgcccacgtgatcttccagaatgtggccaagagctacctgcccaatgcccacctggagtgccactacaccctgaccccctacatccacccccaccccaaggactgggtgggcatcttcaaggtgggctggagcacagcccgggactactacaccttcctgtggagccccatgcctgagcactacgtggagggcagcacagtgaactgtgtgctggccttccagggctactacctgcccaatgatgatggagagtag

SEQ ID NO: 172714 - DNA, 1773 bp, Artificial Sequence
  Description of Artificial Sequence: Synthetic coding sequence
atgaaggagaaggaggagctgctgaagctgattgctgtgctggagaaggagacagcccagctgcgggagcaggtgggccgcatggagcgggagctgaaccacgagaaggagcgctgtgaccagctgcaggccgagcagaagggcctgacagaggtgacccagagcctgaagatggagaatgaggagttcaagaagcgcttcagtgatgccaccagcaaggcccaccagctggaggaggacatcgtgtctgtgacccacaaggccatcgagaaggagacagagctggacagcctgaaggacaagctgaagaaggcccagcacgagcgggagcagctggagtgccagctgaagacagagaaggatgagaaggagctgtacaaggtgcacctgaagaacacagaaattgagaacaccaagctgatgtctgaggtgcagaccctgaagaacctggatggcaacaaggagagcgtcatcacccacttcaaggaggagatcggccgcctgcagctgtgcctggccgagaaggagaacctgcagaggaccttcctgctgaccaccagcagcaaggaggacacctgcttcctgaaggagcagctgaggaaggccgaggagcaggtgcaggccacccggcaggaggtggtgttcctggccaaggagctgagtgatgctgtgaatgtgcgggacaggaccatggctgacctgcacacagcccggctggagaatgagaaggtgaagaagcagctggctgatgctgtggccgagctgaagctgaatgccatgaagaaggaccaggacaagacagacaccctggagcacgagctgcggcgggaggtggaggacctgaagctgcggctgcagatggctgctgaccactacaaggagaagttcaaggagtgccagaggctgcagaagcagatcaacaagctgagtgaccagagcgccaacaacaacaacgtgttcaccaagaagacaggcaaccagcagaaggtgaatgatgcctctgtgaacacagatcctgccaccagcgccagcacagtggatgtgaagcccagccccagcgctgctgaggccgactttgatattgtgaccaagggccaggtgtgtgagatgaccaaggagattgctgacaagacagagaagtacaacaagtgcaagcagctgctgcaggatgagaaggccaagtgcaacaagtatgcagatgagctggccaagatggagctgaagtggaaggagcaggtgaagattgctgaaaatgtgaagctggagctggccgaggtgcaggacaactacaaggagctgaagaggagcctggagaacccagctgagaggaagatggaggatggagcagatggagccttctacccagatgagatccagaggcctcctgtgcgggtgcccagctggggcctggaggacaacgtggtgtgcagccagcctgccaggaacttcagcaggccagatggcctggaggacagcgaggacagcaaagaagatgaaaatgtgcccacagccccagacccccccagccagcacctgcggggccatggaacaggcttctgctttgacagcagctttgatgtgcacaagaagtgccccctgtgtgagctgatgtttcctcccaactatgaccagagcaagtttgaggagcacgtggagagccactggaaggtgtgccccatgtgcagcgagcagttccccccagactatgaccagcaggtgtttgaaagacatgtgcagacccactttgaccagaatgtgctgaactttgattag

SEQ ID NO: 172715 - DNA, 2244 bp, Artificial Sequence; identical to SEQ ID NO: 172710
  Description of Artificial Sequence: Synthetic coding sequence

SEQ ID NO: 172716 - DNA, 3480 bp, Artificial Sequence
  Description of Artificial Sequence: Synthetic coding sequence
atggagcccatcaccttcaccgccaggaagcacctgctgagcaatgaggtgtctgtggactttggcctgcagctggtgggcagcctgcctgtgcacagcctgaccaccatgcccatgctgccctgggtggtggccgaggtgcggcggctgagccggcagagcaccaggaaggagcctgtgaccaagcaggtgcggctgtgtgtgagccccagcggcctgcgctgtgagcctgagcccggccgcagccagcagtgggaccccctcatctacagcagcatctttgagtgcaagccccagagggtgcacaagctgatccacaacagccatgaccccagctactttgcctgcctgatcaaggaggatgctgtgcaccggcagagcatctgctacgtgttcaaggcagatgaccagaccaaggtgcctgagatcatcagcagcatccggcaggccggcaagatcgcccggcaggaggagctgcactgccccagcgagtttgatgacaccttcagcaagaagtttgaggtgctcttctgtggccgggtgacagtggcccacaagaaggcccccccagccctgattgatgaatgtattgagaagttcaaccacgtgtctggcagccggggcagcgagagcccccggcccaacccccctcatgctgcccccaccggcagccaggagcctgtgagaagacccatgaggaagagcttcagccagcccggcctgcggagcctggccttcaggaaggagctgcaggacggcggcctgcggagcagcggcttcttcagcagctttgaggagagtgacatcgagaaccacctgatcagcggccacaacatcgtgcagcccacagacattgaagaaaatagaaccatgctgttcaccatcggccagagcgaggtgtacctgatcagcccagacaccaagaagatcgccctggagaagaacttcaaggagatctccttctgcagccagggcatccgccacgtggaccacttcggcttcatctgccgggagagcagcggcggcggcggcttccactttgtgtgctacgtgttccagtgcaccaatgaggccctggtggatgagatcatgatgaccctgaagcaggccttcaccgtggccgctgtgcagcagacagccaaggccccagcccagctgtgtgagggctgccccctgcagagcctgcacaagctgtgtgagcgcatcgagggcatgaacagcagcaagaccaagctggagctgcagaagcacctgaccaccctgaccaaccaggagcaggccaccatctttgaggaggtgcagaagctgcggcccagaaatgagcagcgggagaatgaactcatcatctccttcctgcgctgcctgtatgaggagaagcagaaggagcacatccacatcggggagatgaagcagaccagccagatggctgctgagaacatcggcagcgagctgcccccatctgccacccgcttccggctggacatgctgaagaacaaggccaagaggagcctgacagagagcctggagagcatcctgagccggggcaacaaggcccggggcctgcaggagcacagcatctctgtggacctggacagcagcctgagcagcaccctgagcaacaccagcaaggagcccagcgtgtgtgagaaggaggccctgcccatcagcgagagcagcttcaagctgctgggcagcagcgaggacctgagcagtgacagcgagagccacctgcctgaggagcccgcccccctgagcccccagcaggccttcagaagaagagccaacaccctgagccacttccccatcgagtgccaggagcccccccagcctgcccggggcagccctggggtgtcccagaggaagctgatgagataccacagcgtgtccacagagacccctcatgaaagaaatgtggaccccagccctgtgggggagagcaagcaccggcccggccagagcagcgccccagcccccccaccccggctgaaccccagcgccagcagccccaacttcttcaagtacctgaagcacaacagcagcggggagcagagcggaaatgctgtgcccaagagcatctcctacagaaatgccctgaggaagaagctgcacagcagcagctctgtgcccaacttcctgaagttcctggcccctgtggatgagaacaacaccagtgacttcatgaacaccaagagggactttgagagcaaggccaaccacctgggggacagcggcggcacccctgtgaagaccaggaggcacagctggaggcagcagatcttcctgcgggtggccaccccccagaaggcctgtgacagcagcagccgctatgaggactacagcgagctgggggagctgccccccaggagccccctggagcctgtgtgtgaagatggccccttcggccccccacctgaggagaagaagaggaccagccgggagctgcgggagctgtggcagaaggccatcctgcagcagatcctgctgctgaggatggagaaggagaaccagaagctgcaggcctctgaaaatgacctgctgaacaagaggctgaagctggactatgaggagatcaccccctgcctgaaggaggtgaccaccgtgtgggagaagatgctgagcaccccaggccgcagcaagatcaagtttgacatggagaagatgcacagcgctgtgggccagggcgtgcccaggcaccacagaggagagatctggaagttcctggccgagcagttccacctgaagcaccagttccccagcaagcagcagcccaaggatgtgccctacaaggagctgctgaagcagctgaccagccagcagcacgccatcctgattgacctgggccgcaccttccccacccacccctacttcagcgcccagctgggcgccggccagctgagcctgtacaacatcctgaaggcctacagcctgctggaccaggaggtgggctactgccagggcctgagctttgtggccggcatcctgctgctgcacatgtctgaggaggaggccttcaagatgctgaagttcctgatgtttgacatgggcctgaggaagcagtacagaccagacatgatcatcctgcagatggagaagaccatcaaccaggtgtttgagatggacatcgccaagcagctgcaggcctatgaggtggagtaccacgtgctgcaggaggagctgattgacagcagccccctgagtgacaaccagaggatggacaagctggagaagaccaacagcagcctgaggaagcagaacctggacctgctggagcagctgcaggtggccaacggccgcatccagagcctggaggccaccatcgagaagctgctgagcagcgagagcaagctgaagcaggccatgctgaccctggagctggagaggtctgccctgctgcagacagtggaggagctgcggaggagatctgctgagcccagcgaccgggagcctgagtgcacccagcctgagcccactggagactag

SEQ ID NO: 172717 - DNA, 3507 bp, Artificial Sequence
  Description of Artificial Sequence: Synthetic coding sequence
atggagcccatcaccttcaccgccaggaagcacctgctgagcaatgaggtgtctgtggactttggcctgcagctggtgggcagcctgcctgtgcacagcctgaccaccatgcccatgctgccctgggtggtggccgaggtgcggcggctgagccggcagagcaccaggaaggagcctgtgaccaagcaggtgcggctgtgtgtgagccccagcggcctgcgctgtgagcctgagcccggccgcagccagcagtgggaccccctcatctacagcagcatctttgagtgcaagccccagagggtgcacaagctgatccacaacagccatgaccccagctactttgcctgcctgatcaaggaggatgctgtgcaccggcagagcatctgctacgtgttcaaggcagatgaccagaccaaggtgcctgagatcatcagcagcatccggcaggccggcaagatcgcccggcaggaggagctgcactgccccagcgagtttgatgacaccttcagcaagaagtttgaggtgctcttctgtggccgggtgacagtggcccacaagaaggcccccccagccctgattgatgaatgtattgagaagttcaaccacgtgtctggcagccggggcagcgagagcccccggcccaacccccctcatgctgcccccaccggcagccaggagcctgtgagaagacccatgaggaagagcttcagccagcccggcctgcggagcctggccttcaggaaggagctgcaggacggcggcctgcggagcagcggcttcttcagcagctttgaggagagtgacatcgagaaccacctgatcagcggccacaacatcgtgcagcccacagacattgaagaaaatagaaccatgctgttcaccatcggccagagcgaggtgtacctgatcagcccagacaccaagaagatcgccctggagaagaacttcaaggagatctccttctgcagccagggcatccgccacgtggaccacttcggcttcatctgccgggagagcagcggcggcggcggcttccactttgtgtgctacgtgttccagtgcaccaatgaggccctggtggatgagatcatgatgaccctgaagcaggccttcaccgtggccgctgtgcagcagacagccaaggccccagcccagctgtgtgagggctgccccctgcagagcctgcacaagctgtgtgagcgcatcgagggcatgaacagcagcaagaccaagctggagctgcagaagcacctgaccaccctgaccaaccaggagcaggccaccatctttgaggaggtgcagaagctgcggcccagaaatgagcagcgggagaatgaactcatcatctccttcctgcgctgcctgtatgaggagaagcagaaggagcacatccacatcggggagatgaagcagaccagccagatggctgctgagaacatcggcagcgagctgcccccatctgccacccgcttccggctggacatgctgaagaacaaggccaagaggagcctgacagagagcctggagagcatcctgagccggggcaacaaggcccggggcctgcaggagcacagcatctctgtggacctggacagcagcctgagcagcaccctgagcaacaccagcaaggagcccagcgtgtgtgagaaggaggccctgcccatcagcgagagcagcttcaagctgctgggcagcagcgaggacctgagcagtgacagcgagagccacctgcctgaggagcccgcccccctgagcccccagcaggccttcagaagaagagccaacaccctgagccacttccccatcgagtgccaggagcccccccagcctgcccggggcagccctggggtgtcccagaggaagctgatgagataccacagcgtgtccacagagacccctcatgagaggaaggactttgagagcaaggccaaccacctgggggacagcggcggcacccctgtgaagaccaggaggcacagctggaggcagcagatcttcctgcgggtggccaccccccagaaggcctgtgacagcagcagccgctatgaggactacagcgagctgggggagctgccccccaggagccccctggagcctgtgtgtgaagatggccccttcggccccccacctgaggagaagaagaggaccagccgggagctgcgggagctgtggcagaaggccatcctgcagcagatcctgctgctgaggatggagaaggagaaccagaagctgcaggcctctgaaaatgacctgctgaacaagaggctgaagctggactatgaggagatcaccccctgcctgaaggaggtgaccaccgtgtgggagaagatgctgagcaccccaggccgcagcaagatcaagtttgacatggagaagatgcacagcgctgtgggccagggcgtgcccaggcaccacagaggagagatctggaagttcctggccgagcagttccacctgaagcaccagttccccagcaagcagcagcccaaggatgtgccctacaaggagctgctgaagcagctgaccagccagcagcacgccatcctgattgacctgggccgcaccttccccacccacccctacttcagcgcccagctgggcgccggccagctgagcctgtacaacatcctgaaggcctacagcctgctggaccaggaggtgggctactgccagggcctgagctttgtggccggcatcctgctgctgcacatgtctgaggaggaggccttcaagatgctgaagttcctgatgtttgacatgggcctgaggaagcagtacagaccagacatgatcatcctgcagatccagatgtaccagctgagccggctgctgcatgactaccaccgggacctgtacaaccacctggaggagcacgagatcggccccagcctgtatgctgccccctggttcctgaccatgtttgccagccagttccccctgggctttgtggcccgggtgtttgacatgatcttcctgcagggcacagaggtgatcttcaaggtggccctgagcctgctgggcagccacaagcccctcatcctgcagcacgagaacctggagaccatcgtggacttcatcaagagcaccctgcccaacctgggcctggtgcagatggagaagaccatcaaccaggtgtttgagatggacatcgccaagcagctgcaggcctatgaggtggagtaccacgtgctgcaggaggagctgattgacagcagccccctgagtgacaaccagaggatggacaagctggagaagaccaacagcagcctgaggaagcagaacctggacctgctggagcagctgcaggtggccaacggccgcatccagagcctggaggccaccatcgagaagctgctgagcagcgagagcaagctgaagcaggccatgctgaccctggagctggagaggtctgccctgctgcagacagtggaggagctgcggcggcgctctgctgagcccagcgaccgggagccagaatgtacccagcctgagcccaccggggactag

SEQ ID NO: 172718 - DNA, 1299 bp, Artificial Sequence
  Description of Artificial Sequence: Synthetic coding sequence
atggagaaggagaaccagaagctgcaggcctctgaaaatgacctgctgaacaagaggctgaagctggactatgaggagatcaccccctgcctgaaggaggtgaccaccgtgtgggagaagatgctgagcaccccaggccgcagcaagatcaagtttgacatggagaagatgcacagcgctgtgggccagggcgtgcccaggcaccacagaggagagatctggaagttcctggccgagcagttccacctgaagcaccagttccccagcaagcagcagcccaaggatgtgccctacaaggagctgctgaagcagctgaccagccagcagcacgccatcctgattgacctgggccgcaccttccccacccacccctacttcagcgcccagctgggcgccggccagctgagcctgtacaacatcctgaaggcctacagcctgctggaccaggaggtgggctactgccagggcctgagctttgtggccggcatcctgctgctgcacatgtctgaggaggaggccttcaagatgctgaagttcctgatgtttgacatgggcctgaggaagcagtacagaccagacatgatcatcctgcagatccagatgtaccagctgagccggctgctgcatgactaccaccgggacctgtacaaccacctggaggagcacgagatcggccccagcctgtatgctgccccctggttcctgaccatgtttgccagccagttccccctgggctttgtggcccgggtgtttgacatgatcttcctgcagggcacagaggtgatcttcaaggtggccctgagcctgctgggcagccacaagcccctcatcctgcagcacgagaacctggagaccatcgtggacttcatcaagagcaccctgcccaacctgggcctggtgcagatggagaagaccatcaaccaggtgtttgagatggacatcgccaagcagctgcaggcctatgaggtggagtaccacgtgctgcaggaggagctgattgacagcagccccctgagtgacaaccagaggatggacaagctggagaagaccaacagcagcctgaggaagcagaacctggacctgctggagcagctgcaggtggccaacggccgcatccagagcctggaggccaccatcgagaagctgctgagcagcgagagcaagctgaagcaggccatgctgaccctggagctggagaggtctgccctgctgcagacagtggaggagctgcggcggcgctctgctgagcccagcgaccgggagccagaatgtacccagcctgagcccaccggggactag

SEQ ID NO: 172719 - DNA, 933 bp, Artificial Sequence
  Description of Artificial Sequence: Synthetic coding sequence
atggcccaggccctgggggaggacctggtgcagcccccagagctgcaggatgacagcagcagcctgggcagtgacagcgagctgagcggccctggcccctaccggcaggccgacagatatggcttcatcggcggcagcagcgctgagcccggccctggccaccccccagctgacctgatccggcagcgggagatgaagtgggtggagatgaccagccactgggagaagaccatgagccgccgctacaagaaggtgaagatgcagtgcaggaagggcatccccagcgccctgcgggcccgctgctggcccctgctgtgtggggcccacgtgtgccagaagaacagccctggcacctaccaggagctggccgaggcccctggggacccccagtggatggagaccatcggccgggacctgcaccggcagttccccctgcacgagatgtttgtgagcccccagggccacggccggggcagctgccgctgcagccggcccaccccctgcatcgacaggagccgggccacagcccggccccggggcccctggctgctgtgctgcagctgcacctgcccccagaggcggcccagcggggcctggtgccgctctgtgcgcagcaccagcctgggcaccaccggccccacctggtgccagagcacagtgccctgtggggctgacaccggggcccctggagctggccactgccgggccgcccggggcctgccctggcccccaggggacaccggcagccccagcagccacccccccagggctgctgctgggggcggcctgcacgtgactggagcccagagaggagctgtgcgggccggccctgctgctggggaccagggccctgctggccctgctgcccgcttccgggccggcaccccagccccagccaccggccccccccggcggggccccagccacctgtag

SEQ ID NO: 172720 - DNA, 1662 bp, Artificial Sequence
  Description of Artificial Sequence: Synthetic coding sequence
atggacagccctggctacaactgctttgtggacaaggacaagatggatgctgccatccaggacctgggccccaaggagctgagctgcacagagctgcaggagctgaagcagctggcccggcagggctactgggcccagagccacgccctgcggggcaaggtgtaccagaggctcatccgggacatcccctgcaggacagtgaccccagatgcctctgtgtacagcgacatcgtgggcaagatcgtgggcaagcacagcagcagctgcctgcccctgcctgagtttgtggacaacacccaggtgcccagctactgcctgaatgcccggggggagggcgctgtgaggaagatcctgctgtgcctggccaaccagttcccagacatctccttctgcccagccctgcctgctgtggtggccctgctgctgcactacagcattgatgaagctgagtgctttgagaaggcctgccgcatcctggcctgcaatgaccccggccggcggctgattgaccagagcttcctggcctttgagagcagctgcatgacctttggagacctggtgaacaagtactgccaggccgcccacaagctgatggtggccgtgtctgaagatgtgctgcaggtgtatgctgactggcagcgctggctgtttggagagctgcccctgtgctactttgcccgggtgtttgatgtgttcctggtggagggctacaaggtgctgtacagagtggccctggccatcctgaagttcttccacaaggtgcgggccggccagcccctggagagtgacagcgtgaagcaggacatccgcacctttgtgcgggacatcgccaagacagtgtccccagagaagctgctggagaaggcctttgccatccgcctcttcagcaggaaggagatccagctgctgcagatggccaatgagaaggccctgaagcagaagggcatcaccgtgaagcagaagaggcagtttgtgcacctggccgtgcatgctgagaacttccgctctgagatcgtgtctgtgcgggagatgagggacatctggagctgggtgcctgagagatttgccctgtgccagcccctgctgctcttcagcagcctgcagcacggctacagcctggcccgcttctacttccagtgtgagggccacgagcccaccctgctgctgatcaagaccacccagaaggaggtgtgtggggcctacctgagcacagactggagcgagaggaacaagtttggaggcaagctgggcttctttggaactggagaatgttttgtgttccggctgcagcctgaggtgcagagatatgagtgggtggtgatcaagcaccctgagctgaccaagcccccacccctgatggctgctgagcccacagcccccctgagccacagcgccagcagtgaccctgctgaccggctgagccccttcctggccgcccggcacttcaacctgcccagcaagacagagagcatgttcatggccggcggcagtgactgcctgattgtgggcggcggcggcggccaggccctgtacattgatggagacctgaacagaggccgcaccagccactgtgacaccttcaacaaccagcccctgtgcagcgagaacttcctgattgctgctgtggaggcctggggcttccaggaccctgacacccagtag

SEQ ID NO: 172721 - DNA, 759 bp, Artificial Sequence
  Description of Artificial Sequence: Synthetic coding sequence
atgggcgtgctgctgacccagaggaccctgctgagcctggtgctggccctgctcttccccagcatggcctccatggccgccatcggcagctgcagcaaggagtacagagtgctgctgggccagctgcagaagcagacagacctgatgcaggacaccagccggctgctggacccctacatccgcatccagggcctggatgtgcccaagctgcgggagcactgccgggagaggcctggggccttccccagcgaggagaccctgcggggcctgggccggcggggcttcctgcagaccctgaatgccaccctgggctgtgtgctgcaccggctggccgacctggagcagaggctgcccaaggcccaggacctggagaggagcggcctgaacatcgaggacctggagaagctgcagatggcccggcccaacatcctgggcctgaggaacaacatctactgcatggcccagctgctggacaacagcgacacagctgagcccaccaaggccggccgcggggccagccagccccccacccccaccccagccagtgatgccttccagaggaagctggagggctgccgcttcctgcacggctaccaccgcttcatgcacagcgtgggccgggtcttcagcaagtggggcgagagccccaacagaagccgccgccacagcccccaccaggccctgaggaagggcgtgcggaggacccggcccagcaggaagggcaagaggctgatgacccggggccagctgcccaggtag

SEQ ID NO: 172722 - DNA, 1263 bp, Artificial Sequence
  Description of Artificial Sequence: Synthetic coding sequence
atgctgaacaactgggacaagtggatggccaagaagcacaagaagatccggctgcgctgccagaagggcatcccccccagcctgcggggccgggcctggcagtacctgagcggcggcaaggtgaagctgcagcagaaccctgggaagtttgatgagctggacatgagccctggggaccccaagtggctggatgtgattgaaagagacctgcaccggcagttccccttccacgagatgtttgtgtcccggggcggccacggccagcaggacctcttccgggtgctgaaggcctacaccctgtacagacctgaggagggctactgccaggcccaggcccccatcgctgctgtgctgctgatgcacatgcctgctgagcaggccttctggtgcctggtgcagatctgtgagaagtacctgcccggctactacagcgagaagctggaggccatccagctggatggagagatcctcttcagcctgctgcagaaggtgtcccctgtggcccacaagcacctgagccggcagaagattgaccccctgctgtacatgacagagtggttcatgtgtgccttcagcaggaccctgccctggagctctgtgctgcgggtgtgggacatgttcttctgtgaaggagtgaagatcatcttccgggtgggcctggtgctgctgaagcacgccctgggcagccctgagaaggtgaaggcctgccagggccagtatgagaccatcgagcggctgcggagcctgagccccaagatcatgcaggaggccttcctggtgcaggaggtggtggagctgcctgtgacagagcggcagatcgagcgggagcacctgatccagctgcggcgctggcaggagaccagaggagagctgcagtgccgcagccccccccggctgcacggggccaaggccatcctggatgctgagcccggccccaggcctgccctgcagcccagccccagcatccggctgcccctggatgcccccctgcccggcagcaaggccaagcccaagccacccaagcaggcccagaaggagcagaggaagcagatgaagggccggggccagctggagaagcccccagcccccaaccaggccatggtggtggccgctgctggagatgcctgccccccccagcacgtgccccccaaggacagcgcccccaaggacagcgccccccaggacctggccccccaggtgtctgcccaccacaggagccaggagagcctgaccagccaggagagcgaggacacctacctgtag

SEQ ID NO: 172723 - DNA, 1548 bp, Artificial Sequence
  Description of Artificial Sequence: Synthetic coding sequence
atggccaagagcaatggagaaaatggcccccgggccccagctgctggggagagcctgagcggcacccgggagagcctggcccagggcccagatgctgccaccacagatgagctgagcagcctgggcagtgacagcgaggccaacggctttgctgagaggagaattgacaagtttggcttcatcgtgggcagccagggcgctgagggcgccccctgccccctgctgcaccggctggaggaggtgcccctggaggtgctgcggcagcgggagagcaagtggctggacatgctgaacaactgggacaagtggatggccaagaagcacaagaagatccggctgcgctgccagaagggcatcccccccagcctgcggggccgggcctggcagtacctgagcggcggcaaggtgaagctgcagcagaaccctgggaagtttgatgagctggacatgagccctggggaccccaagtggctggatgtgattgagcgggacctgcaccggcagttccccttccacgagatgtttgtgtccagaggaggccacggccagcaggacctcttccgggtgctgaaggcctacaccctgtacagacctgaggagggctactgccaggcccaggcccccatcgctgctgtgctgctgatgcacatgcctgctgagcaggccttctggtgcctggtgcagatctgtgagaagtacctgcccggctactacagcgagaagctggaggccatccagctggatggagagatcctcttcagcctgctgcagaaggtgtcccctgtggcccacaagcacctgagccggcagaagattgaccccctgctgtacatgacagagtggttcatgtgtgccttcagcaggaccctgccctggagctctgtgctgcgggtgtgggacatgttcttctgtgagggcgtgaagatcatcttccgggtgggcctggtgctgctgaagcacgccctgggcagccctgagaaggtgaaggcctgccagggccagtatgagaccatcgagcggctgcggagcctgagccccaagatcatgcaggaggccttcctggtgcaggaggtggtggagctgcctgtgacagagcggcagatcgagcgggagcacctgatccagctgcggcgctggcaggagaccagaggagagctgcagtgccgcagccccccccggctgcatggagccaaggccatcctggatgctgagcccggccccaggcctgccctgcagcccagccccagcatccggctgcccctggatgcccccctgcccggcagcaaggccaagcccaagccacccaagcaggcccagaaggagcagaggaagcagatgaagggccggggccagctggagaagcccccagcccccaaccaggccatggtggtggccgctgctggagatgcctgccccccccagcacgtgccccccaaggacagcgcccccaaggacagcgccccccaggacctggccccccaggtgtctgcccaccacaggagccaggagagcctgaccagccaggagagcgaggacacctacctgtag

SEQ ID NO: 172724 - DNA, 2427 bp, Artificial Sequence
  Description of Artificial Sequence: Synthetic coding sequence
atggagactggaacagcccccctggtggcccccccaagaagacatggagccccagctgcccccagccccccaccccggggcagccgggccggccctgtggtggtggtggcccctggcccccctgtgaccacagccaccagcgcccctgtgaccctggtggcccctggagaggcccggcctgcctgggtgcccggcagcgctgagaccagcgccccagccccagccccagccccagccccagccccagctgtgacaggcagcacagtggtggtgctgaccctggaggccagccctgaggcccccaagccccagctgcccagcggccctgagagccctgagcctgctgctgtggccggcgtggagaccagccgggccctggccgccggggctgacagccccaagacagaggaggcccggcccagccctgcccctggccctggcacccccaccggcacccccaccaggacccccagcaggacagcccctggggccctgacagccaagccacccctggcccccaagccaggcaccaccgtggccagcggcgtgacagcccggagcgccagcggccaggtgactggaggccacggggctgctgctgccaccagcgccagcgctggccaggcccctgaggaccccagcggccctggcaccggccccagcggcacctgtgaggcccctgtggccgtggtgacagtgaccccagcccctgagcctgctgagaacagccaggacctgggcagcaccagcagcctgggccctggcatcagcggcccccggggccaggccccagacaccctgagctacctggacagcgtgtccctgatgagcggcaccctggagagcctggctgatgatgtgtcctccatgggcagtgacagcgagatcaatggcctggccctgaggaagacagacaagtatggcttcctgggcggcagccagtacagcggcagcctggagagcagcatccctgtggatgtggcccggcagcgggagctgaagtggctggacatgttcagcaactgggacaagtggctgagccgccgcttccagaaggtgaagctgcgctgcaggaagggcatccccagcagcctgcgggccaaggcctggcagtacctgagcaacagcaaggagctgctggagcagaaccctgggaagtttgaggagctggagcgggcccctggggaccccaagtggctggatgtgattgagaaggacctgcaccggcagttccccttccacgagatgtttgctgcccggggcggccacggccagcaggacctgtaccgcatcctgaaggcctacaccatctacagaccagatgagggctactgccaggcccaggcccctgtggccgctgtgctgctgatgcacatgcctgctgagcaggccttctggtgcctggtgcagatctgtgacaagtacctgcccggctactacagcgctggcctggaggccatccagctggatggagagatcttctttgccctgctgcggcgggccagccccctggcccaccgccacctgcggcggcagagaattgatcctgtgctgtacatgacagagtggttcatgtgcatctttgcccggaccctgccctgggcctctgtgctgcgggtgtgggacatgttcttctgtgagggcgtgaagatcatcttccgggtggccctggtgctgctgcggcacaccctgggctctgtggagaagctgcggagctgccagggcatgtatgagaccatggagcagctgaggaacctgccccagcagtgcatgcaggaggacttcctggtgcatgaggtgaccaacctgcctgtgacagaggccctgattgaaagagaaaatgctgcccagctgaagaagtggagggagaccagaggagagctgcagtaccggcccagccggcggctgcacggcagccgggccatccacgaggagcggcggcggcagcagccccccctgggccccagcagcagcctgctgagcctgcccggcctgaagagccggggcagcagagctgctggaggagcccccagccccccacctcctgtgcggcgggccagcgctggccctgcccctggccctgtggtgacagctgagggcctgcaccccagcctgcccagccccactggaaacagcacccccctgggcagcagcaaggagaccaggaagcaggagaaggagcggcagaagcaggagaaggagcggcagaagcaggagaaggagcgggagaaggagcggcagaagcaggagaaggagcgggagaagcaggagaaggagcgggagaagcaggagaaggagcggcagaagcaggagaagaaggcccagggcaggaagctgagcctgcggaggaaggcagatggccccccaggcccccatgatggaggagaccggcccagcgctgaggcccggcaggatgcctacttctag

SEQ ID NO: 172725 - DNA, 1341 bp, Artificial Sequence
  Description of Artificial Sequence: Synthetic coding sequence
atggcccaggccctgggggaggacctggtgcagcccccagagctgcaggatgacagcagcagcctgggcagtgacagcgagctgagcggccctggcccctaccggcaggccgacagatatggcttcatcggcggcagcagcgctgagcccggccctggccaccccccagctgacctgatccggcagcgggagatgaagtgggtggagatgaccagccactgggagaagaccatgagccgccgctacaagaaggtgaagatgcagtgcaggaagggcatccccagcgccctgcgggcccgctgctggcccctgctgtgtggggcccacgtgtgccagaagaacagccctggcacctaccaggagctggccgaggcccctggggacccccagtggatggagaccatcggccgggacctgcaccggcagttccccctgcacgagatgtttgtgagcccccagggccacggccagcagggcctgctgcaggtgctgaaggcctacaccctgtacagacctgagcagggctactgccaggcccagggccctgtggccgctgtgctgctgatgcacctgcccccagaggaggccttctggtgcctggtgcagatctgtgaggtgtacctgcccggctactacggcccccacatggaggccgtgcggctggatgctgaggtgttcatggccctgctgcggcggctgctgccccacgtgcacaagcacctgcagcaggtgggcgtgggccccctgctgtacctgcctgagtggttcctgtgcctgtttgcccggagcctgcccttccccaccgtgctgcgggtgtgggatgccttcctgtctgagggcgcccgggtgctcttccgggtgggcctgaccctggtgcggctggccctgggcacagctgagcagagaggagcctgccccggcctgctggagaccctgggcgccctgcgggccatccccccagcccagctgcaggaggaggccttcatgagccaggtgcacagcgtggtgctgtctgagcgggacctgcagcgggagatcaaggcccagctggcccagctgcctgacagcgcccctggccccccaccccggccccaggtgcggctggccggggcccaggccatctttgaggcccagcagctggccggcgtgcggcggggggccaagccagaggtgccccgcatcgtggtgcagcccccagaggagccccggccccccaggaggaagccccagacccggggcaagaccttccacggcctgctgacccgggcccggggcccccccatcgagggccccccccggccccagaggggcagcaccagcttcctggacacccgcttctag

SEQ ID NO: 172726 - DNA, 1341 bp, Artificial Sequence; identical to SEQ ID NO: 172725
  Description of Artificial Sequence: Synthetic coding sequence

SEQ ID NO: 172727 - DNA, 2049 bp, Artificial Sequence
  Description of Artificial Sequence: Synthetic coding sequence
atgtgccccggcctgtacccctacagcagcctgctggagtatggccgctccatgatcatctatgagcaggagggcgtgtacatccacagcagctgtgggaagaccaatgaccaggacggcctcatcagcggcatcctgcgggtgctggagaaggatgctgaggtgattgtggactggaggcccctggatgatgccctggacagcagcagcatcctgtatgccaggaaggacagcagctctgtggtggagtggacccaggcccccaaggagcggggccaccggggcagcgagcacctgaacagctatgaggccgagtgggacatggtgaacacagtgtccttcaagaggaagccccacaccaatggagatgcccccagccacagaaatggcaagagcaagtggagcttcctgttcagcctgacagacctgaagagcatcaagcagaacaaggagggcatgggctggagctacctggtgttctgcctgaaggatgatgtggtgctgcctgccctgcacttccaccagggcgacagcaagctgctgattgagagcctggagaagtatgtggtgctgtgtgagagcccccaggacaagaggaccctgctggtgaactgccagaacaagagcctgagccagagctttgagaacctgctggatgagcccgcctacggcctcatccagaagatcaagaaggacccctacacagccaccatgattggcttcagcaaggtgaccaactacatctttgacagcctgcggggcagtgaccccagcacccaccagaggcctccttctgagatggctgacttcctgagtgatgccatccctggcctgaagatcaaccagcaggaggagcccggctttgaggtgatcaccagaattgacctgggggagaggcctgtggtgcagaggcgggagcctgtgtccctggaggagtggaccaagaacattgattctgagggccgcatcctgaatgtggacaacatgaagcagatgatcttccggggcggcctgagccacgccctgaggaagcaggcctggaagttcctgctgggctacttcccctgggacagcaccaaggaggagaggacccagctgcagaagcagaagacagatgagtacttcaggatgaagctgcagtggaagagcatcagccaggagcaggagaagaggaacagccggctgcgggactaccgcagcctcatcgagaaggatgtgaacagaacagacaggaccaacaagttctatgagggccaggacaaccctggcctcatcctgctgcatgacatcctgatgacctactgcatgtatgactttgacctgggctacgtgcagggcatgtctgacctgctgagccccctgctgtatgtgatggagaatgaggtggatgccttctggtgctttgccagctacatggaccagatgcaccagaactttgaggagcagatgcagggcatgaagacccagctgatccagctgagcaccctgctgcggctgctggacagcggcttctgcagctacctggagagccaggacagcggctacctgtacttctgcttccgctggctgctgatccgcttcaagcgggagttctccttcctggacatcctgcggctgtgggaggtgatgtggacagagctgccctgcaccaacttccacctgctgctgtgctgtgccatcctggagagcgagaagcagcagatcatggagaagcactacggcttcaatgagatcctgaagcacatcaatgagctgtccatgaagattgatgtggaggacatcctgtgcaaggccgaggccatcagcctgcagatggtgaagtgcaaggagctgccccaggccgtgtgtgagatcctgggcctgcagggcagcgaggtgaccaccccagacagtgatgtgggagaagatgaaaatgtggtgatgaccccctgccccaccagcgccttccagagcaatgccctgcccaccctgagcgccagcggggccagaaatgacagccccacccagatccctgtgtccagtgatgtgtgccgcctgaccccagcctag

SEQ ID NO: 172728 - DNA, 1338 bp, Artificial Sequence
  Description of Artificial Sequence: Synthetic coding sequence
atgattggcttcagcaaggtgaccaactacatctttgacagcctgcggggcagtgaccccagcacccaccagaggcctcccagcgagatggctgacttcctgagtgatgccatccctggcctgaagatcaaccagcaggaggagcccggctttgaagtcatcaccagaattgacctgggggagaggcctgtggtgcagaggcgggagcctgtgtccctggaggagtggaccaagaacatcgacagcgagggccgcatcctgaatgtggacaacatgaagcagatgatcttccggggcggcctgagccacgccctgaggaagcaggcctggaagttcctgctgggctacttcccctgggacagcaccaaggaggagaggacccagctgcagaagcagaagacagatgagtacttcaggatgaagctgcagtggaagagcatcagccaggagcaggagaagaggaacagccggctgcgggactaccgcagcctgattgagaaggatgtgaacagaacagacaggaccaacaagttctatgagggccaggacaaccctggcctcatcctgctgcatgacatcctgatgacctactgcatgtatgactttgacctgggctacgtgcagggcatgtctgacctgctgagccccctgctgtatgtgatggagaatgaggtggatgccttctggtgctttgccagctacatggaccagatgcaccagaactttgaggagcagatgcagggcatgaagacccagctgatccagctgagcaccctgctgcggctgctggacagcggcttctgcagctacctggagagccaggacagcggctacctgtacttctgcttccgctggctgctgatccgcttcaagcgggagttctccttcctggacatcctgcggctgtgggaggtgatgtggacagagctgccctgcaccaacttccacctgctgctgtgctgtgccatcctggagagcgagaagcagcagatcatggagaagcactacggcttcaatgagatcctgaagcacatcaatgagctgtccatgaagattgatgtggaggacatcctgtgcaaggccgaggccatcagcctgcagatggtgaagtgcaaggagctgccccaggccgtgtgtgagatcctgggcctgcagggcagcgaggtgaccaccccagacagtgatgtgggggaggatgaaaatgtggtgatgaccccctgccccaccagcgccttccagagcaatgccctgcccaccctgagcgccagcggggccagaaatgacagccccacccagatccctgtgtccagtgatgtgtgccgcctgaccccagcctag

SEQ ID NO: 172729 - DNA, 2025 bp, Artificial Sequence
  Description of Artificial Sequence: Synthetic coding sequence
atggctgctgctggggtggtgtctgggaagatcatctatgagcaggagggcgtgtacatccacagcagctgtgggaagaccaatgaccaggacggcctcatcagcggcatcctgcgggtgctggagaaggatgctgaggtgattgtggactggaggcccctggatgatgccctggacagcagcagcatcctgtatgccaggaaggacagcagctctgtggtggagtggacccaggcccccaaggagcggggccaccggggcagcgagcacctgaacagctatgaggccgagtgggacatggtgaacacagtgtccttcaagaggaagccccacaccaatggagatgcccccagccacagaaatggcaagagcaagtggagcttcctgttcagcctgacagacctgaagagcatcaagcagaacaaggagggcatgggctggagctacctggtgttctgcctgaaggatgatgtggtgctgcctgccctgcacttccaccagggcgacagcaagctgctgattgagagcctggagaagtatgtggtgctgtgtgagagcccccaggacaagaggaccctgctggtgaactgccagaacaagagcctgagccagagctttgagaacctgctggatgagcccgcctacggcctcatccagaagatcaagaaggacccctacacagccaccatgattggcttcagcaaggtgaccaactacatctttgacagcctgcggggcagtgaccccagcacccaccagaggcctccttctgagatggctgacttcctgagtgatgccatccctggcctgaagatcaaccagcaggaggagcccggctttgaggtgatcaccagaattgacctgggggagaggcctgtggtgcagaggcgggagcctgtgtccctggaggagtggaccaagaacattgattctgagggccgcatcctgaatgtggacaacatgaagcagatgatcttccggggcggcctgagccacgccctgaggaagcaggcctggaagttcctgctgggctacttcccctgggacagcaccaaggaggagaggacccagctgcagaagcagaagacagatgagtacttcaggatgaagctgcagtggaagagcatcagccaggagcaggagaagaggaacagccggctgcgggactaccgcagcctcatcgagaaggatgtgaacagaacagacaggaccaacaagttctatgagggccaggacaaccctggcctcatcctgctgcatgacatcctgatgacctactgcatgtatgactttgacctgggctacgtgcagggcatgtctgacctgctgagccccctgctgtatgtgatggagaatgaggtggatgccttctggtgctttgccagctacatggaccagatgcaccagaactttgaggagcagatgcagggcatgaagacccagctgatccagctgagcaccctgctgcggctgctggacagcggcttctgcagctacctggagagccaggacagcggctacctgtacttctgcttccgctggctgctgatccgcttcaagcgggagttctccttcctggacatcctgcggctgtgggaggtgatgtggacagagctgccctgcaccaacttccacctgctgctgtgctgtgccatcctggagagcgagaagcagcagatcatggagaagcactacggcttcaatgagatcctgaagcacatcaatgagctgtccatgaagattgatgtggaggacatcctgtgcaaggccgaggccatcagcctgcagatggtgaagtgcaaggagctgccccaggccgtgtgtgagatcctgggcctgcagggcagcgaggtgaccaccccagacagtgatgtgggagaagatgaaaatgtggtgatgaccccctgccccaccagcgccttccagagcaatgccctgcccaccctgagcgccagcggggccagaaatgacagccccacccagatccctgtgtccagtgatgtgtgccgcctgaccccagcctag

SEQ ID NO: 172730 - DNA, 2076 bp, Artificial Sequence
  Description of Artificial Sequence: Synthetic coding sequence
atggctgctgctggggtggtgtctgggaagatcatctatgagcaggagggcgtgtacatccacagcagctgtgggaagaccaatgaccaggacggcctcatcagcggcatcctgcgggtgctggagaaggatgctgaggtgattgtggactggaggcccctggatgatgccctggacagcagcagcatcctgtatgccaggaaggacagcagctctgtggtggagtggacccaggcccccaaggagcggggccaccggggcagcgagcacctgaacagctatgaggccgagtgggacatggtgaacacagtgtccttcaagaggaagccccacaccaatggagatgcccccagccacagaaatggcaagagcaagtggagcttcctgttcagcctgacagacctgaagagcatcaagcagaacaaggagggcatgggctggagctacctggtgttctgcctgaaggatgatgtggtgctgcctgccctgcacttccaccagggcgacagcaagctgctgattgagagcctggagaagtatgtggtgctgtgtgagagcccccaggacaagaggaccctgctggtgaactgccagaacaagagcctgagccagagctttgagaacctgctggatgagcccgcctacggcctcatccaggccggcctgctggacaggaggaagctgctgtgggccatccaccactggaagaagatcaagaaggacccctacacagccaccatgattggcttcagcaaggtgaccaactacatctttgacagcctgcggggcagtgaccccagcacccaccagaggcctcccagcgagatggctgacttcctgagtgatgccatccctggcctgaagatcaaccagcaggaggagcccggctttgaagtcatcaccagaattgacctgggggagaggcctgtggtgcagaggcgggagcctgtgtccctggaggagtggaccaagaacatcgacagcgagggccgcatcctgaatgtggacaacatgaagcagatgatcttccggggcggcctgagccacgccctgaggaagcaggcctggaagttcctgctgggctacttcccctgggacagcaccaaggaggagaggacccagctgcagaagcagaagacagatgagtacttcaggatgaagctgcagtggaagagcatcagccaggagcaggagaagaggaacagccggctgcgggactaccgcagcctgattgagaaggatgtgaacagaacagacaggaccaacaagttctatgagggccaggacaaccctggcctcatcctgctgcatgacatcctgatgacctactgcatgtatgactttgacctgggctacgtgcagggcatgtctgacctgctgagccccctgctgtatgtgatggagaatgaggtggatgccttctggtgctttgccagctacatggaccagatgcaccagaactttgaggagcagatgcagggcatgaagacccagctgatccagctgagcaccctgctgcggctgctggacagcggcttctgcagctacctggagagccaggacagcggctacctgtacttctgcttccgctggctgctgatccgcttcaagcgggagttctccttcctggacatcctgcggctgtgggaggtgatgtggacagagctgccctgcaccaacttccacctgctgctgtgctgtgccatcctggagagcgagaagcagcagatcatggagaagcactacggcttcaatgagatcctgaagcacatcaatgagctgtccatgaagattgatgtggaggacatcctgtgcaaggccgaggccatcagcctgcagatggtgaagtgcaaggagctgccccaggccgtgtgtgagatcctgggcctgcagggcagcgaggtgaccaccccagacagtgatgtgggggaggatgaaaatgtggtgatgaccccctgccccaccagcgccttccagagcaatgccctgcccaccctgagcgccagcggggccagaaatgacagccccacccagatccctgtgtccagtgatgtgtgccgcctgaccccagcctag

SEQ ID NO: 172731 - DNA, 2133 bp, Artificial Sequence
  Description of Artificial Sequence: Synthetic coding sequence
atgcacaacatccggggcaacaagcaggcccagggcactggacatgagcccccaggagaggacagcccccagagcggggagccccagcgggaggagcagcccctggccagtgatgccagcaccccaggccgggagcctgaggacagccccaagccagcccccaagcccagcctgaccatcagctttgcccagaaggccaagaggcagaacaacaccttccccttcttcagcgagggcatcaccaggaacagaacagcccaggagaaggtggccgccctggagcagcaggtgctgatgctgaccaaggagctgaagagccagaaggagctggtgaagatcctgcacaaggccctggaggccgcccagcaggagaagagggccagcagcgcctacctggccgctgctgaggacaaggaccggctggagctggtgcgccacaaggtgcggcagattgctgagctgggccggcgggtggaggccctggagcaggagcgggagagcctggcccacacagccagcctgcgggagcagcaggtgcaggagctgcagcagcacgtgcagctgctgatggacaagaaccacgccaagcagcaggtgatctgcaagctgtctgagaaggtgacccaggacttcacccaccccccagaccagagccccctgcggccagatgctgccaacagagacttcctgagccagcagggcaagattgagcacctgaaggatgacatggaggcctaccgcacccagaactgcttcctgaacagcgagatccaccaggtgaccaagatctggaggaaggtggccgagaaggagaaggccctgctgaccaagtgtgcctacctgcaggccaggaactgccaggtggagagcaagtacctggccggcctgcggcggctgcaggaggccctgggagatgaggcctctgaatgttctgagctgctgcggcagctggtgcaggaggccctgcagtgggaggccggggaggccagcagtgacagcattgagctgagccccatcagcaaatatgatgaatatggcttcctgactgtgcctgactatgaggtggaggacctgaagctgctggccaagatccaggccctggagagccgcagccaccacctgctgggcctggaggccgtggaccggcccctgcgggagcgctgggccgccctgggggacctggtgcccagcgctgagctgaagcagctgctgcgggccggcgtgccccgggagcaccggccccgggtgtggcgctggctggtgcacctgcgggtgcagcacctgcacaccccaggctgctaccaggagctgctgagccggggccaggcccgggagcaccctgctgcccggcagatcgagctggacctgaacagaaccttccccaacaacaagcacttcacctgccccaccagcagcttcccagacaagctgcggcgggtgctgctggccttctcctggcagaaccccaccatcggctactgccagggcctgaaccggctggccgccatcgccctgctggtgctggaggaggaggagagcgccttctggtgcctggtggccatcgtggagaccatcatgcctgctgactactactgcaacaccctgacagccagccaggtggaccagagggtgctgcaggacctgctgtctgagaagctgccccggctgatggcccacctgggccagcaccacgtggacctgagcctggtgaccttcaactggttcctggtggtgtttgctgacagcctcatcagcaacatcctgctgcgggtgtgggatgccttcctgtatgagggcaccaaggtggtgttccgctatgccctggccatcttcaagtacaatgagaaggagatcctgcggctgcagaatggcctggagatctaccagtacctgcgcttcttcaccaagaccatcagcaacagcaggaagctgatgaacatcgccttcaatgacatgaaccccttcaggatgaagcagctgcggcagctgaggatggtgcaccgggagcggctggaggccgagctgcgggagctggagcagctgaaggccgagtacctggagcggcgggccagcagaagaagagctgtgtctgagggctgtgcctctgaagatgaggtggagggggaggcctag

SEQ ID NO: 172732 - DNA, 1407 bp, Artificial Sequence
  Description of Artificial Sequence: Synthetic coding sequence
atggaggcctaccgcacccagaactgcttcctgaacagcgagatccaccaggtgaccaagatctggaggaaggtggccgagaaggagaaggccctgctgaccaagtgtgcctacctgcaggccaggaactgccaggtggagagcaagtacctggccggcctgcggcggctgcaggaggccctgggagatgaggcctctgaatgttctgagctgctgcggcagctggtgcaggaggccctgcagtgggaggccggggaggccagcagtgacagcattgagctgagccccatcagcaaatatgatgaatatggcttcctgactgtgcctgactatgaggtggaggacctgaagctgctggccaagatccaggccctggagagccgcagccaccacctgctgggcctggaggccgtggaccggcccctgcgggagcgctgggccgccctgggggacctggtgcccagcgctgagctgaagcagctgctgcgggccggcgtgccccgggagcaccggccccgggtgtggcgctggctggtgcacctgcgggtgcagcacctgcacaccccaggctgctaccaggagctgctgagccggggccaggcccgggagcaccctgctgcccggcagatcgagctggacctgaacagaaccttccccaacaacaagcacttcacctgccccaccagcagcttcccagacaagctgcggcgggtgctgctggccttctcctggcagaaccccaccatcggctactgccagggcctgaaccggctggccgccatcgccctgctggtgctggaggaggaggagagcgccttctggtgcctggtggccatcgtggagaccatcatgcctgctgactactactgcaacaccctgacagccagccaggtggaccagagggtgctgcaggacctgctgtctgagaagctgccccggctgatggcccacctgggccagcaccacgtggacctgagcctggtgaccttcaactggttcctggtggtgtttgctgacagcctcatcagcaacatcctgctgcgggtgtgggatgccttcctgtatgagggcaccaaggtggtgttccgctatgccctggccatcttcaagtacaatgagaaggagatcctgcggctgcagaatggcctggagatctaccagtacctgcgcttcttcaccaagaccatcagcaacagcaggaagctgatgaacatcgccttcaatgacatgaaccccttcaggatgaagcagctgcggcagctgaggatggtgcaccgggagcggctggaggccgagctgcgggagctggagcagctgaaggccgagtacctggagcggcgggccagcagaagaagagctgtgtctgagggctgtgcctctgaagatgaggtggagggggaggcctag

SEQ ID NO: 172733 - DNA, 2583 bp, Artificial Sequence
  Description of Artificial Sequence: Synthetic coding sequence
atggagggcgctggggagaatgcccctgagagcagcagcagcgcccctggcagcgaggagagcgcccgggacccccaggtgcccccacctgaggaggagagcggggactgtgcccggagcctggaggccgtgcccaagaagctgtgtggctacctgagcaagtttggaggcaagggccccatccggggctggaagagccgctggttcttctatgatgagaggaagtgccagctgtactacagcaggacagcccaggatgccaaccccctggacagcattgacctgagcagcgctgtgtttgactgcaaggcagatgctgaggagggcatctttgagatcaagacccccagcagggtcatcaccctgaaggccgccaccaagcaggccatgctgtactggctgcagcagctgcagatgaagcgctgggagttccacaacagccccccagcccccccagccaccccagatgctgccctggccggaaatggacctgtgctgcacctggagctgggccaggaggaggccgagctggaggagttcctgtgccctgtgaagaccccacctggcctggtgggcgtggccgccgccctgcagcccttccctgccctgcagaacatcagcctgaagcacctgggcacagagatccagaacaccatgcacaacatccggggcaacaagcaggcccagggcactggacatgagcccccaggagaggacagcccccagagcggggagccccagcgggaggagcagcccctggccagtgatgccagcaccccaggccgggagcctgaggacagccccaagccagcccccaagcccagcctgaccatcagctttgcccagaaggccaagaggcagaacaacaccttccccttcttcagcgagggcatcaccaggaacagaacagcccaggagaaggtggccgccctggagcagcaggtgctgatgctgaccaaggagctgaagagccagaaggagctggtgaagatcctgcacaaggccctggaggccgcccagcaggagaagagggccagcagcgcctacctggccgctgctgaggacaaggaccggctggagctggtgcgccacaaggtgcggcagattgctgagctgggccggcgggtggaggccctggagcaggagcgggagagcctggcccacacagccagcctgcgggagcagcaggtgcaggagctgcagcagcacgtgcagctgctgatggacaagaaccacgccaagcagcaggtgatctgcaagctgtctgagaaggtgacccaggacttcacccaccccccagaccagagccccctgcggccagatgctgccaacagagacttcctgagccagcagggcaagattgagcacctgaaggatgacatggaggcctaccgcacccagaactgcttcctgaacagcgagatccaccaggtgaccaagatctggaggaaggtggccgagaaggagaaggccctgctgaccaagtgtgcctacctgcaggccaggaactgccaggtggagagcaagtacctggccggcctgcggcggctgcaggaggccctgggagatgaggcctctgaatgttctgagctgctgcggcagctggtgcaggaggccctgcagtgggaggccggggaggccagcagtgacagcattgagctgagccccatcagcaaatatgatgaatatggcttcctgactgtgcctgactatgaggtggaggacctgaagctgctggccaagatccaggccctggagagccgcagccaccacctgctgggcctggaggccgtggaccggcccctgcgggagcgctgggccgccctgggggacctggtgcccagcgctgagctgaagcagctgctgcgggccggcgtgccccgggagcaccggccccgggtgtggcgctggctggtgcacctgcgggtgcagcacctgcacaccccaggctgctaccaggagctgctgagccggggccaggcccgggagcaccctgctgcccggcagatcgagctggacctgaacagaaccttccccaacaacaagcacttcacctgccccaccagcagcttcccagacaagctgcggcgggtgctgctggccttctcctggcagaaccccaccatcggctactgccagggcctgaaccggctggccgccatcgccctgctggtgctggaggaggaggagagcgccttctggtgcctggtggccatcgtggagaccatcatgcctgctgactactactgcaacaccctgacagccagccaggtggaccagagggtgctgcaggacctgctgtctgagaagctgccccggctgatggcccacctgggccagcaccacgtggacctgagcctggtgaccttcaactggttcctggtggtgtttgctgacagcctcatcagcaacatcctgctgcgggtgtgggatgccttcctgtatgagggcaccaaggtggtgttccgctatgccctggccatcttcaagtacaatgagaaggagatcctgcggctgcagaatggcctggagatctaccagtacctgcgcttcttcaccaagaccatcagcaacagcaggtag

SEQ ID NO: 172734 - DNA, 2754 bp, Artificial Sequence
  Description of Artificial Sequence: Synthetic coding sequence
atggagggcgctggggagaatgcccctgagagcagcagcagcgcccctggcagcgaggagagcgcccgggacccccaggtgcccccacctgaggaggagagcggggactgtgcccggagcctggaggccgtgcccaagaagctgtgtggctacctgagcaagtttggaggcaagggccccatccggggctggaagagccgctggttcttctatgatgagaggaagtgccagctgtactacagcaggacagcccaggatgccaaccccctggacagcattgacctgagcagcgctgtgtttgactgcaaggcagatgctgaggagggcatctttgagatcaagacccccagcagggtcatcaccctgaaggccgccaccaagcaggccatgctgtactggctgcagcagctgcagatgaagcgctgggagttccacaacagccccccagcccccccagccaccccagatgctgccctggccggaaatggacctgtgctgcacctggagctgggccaggaggaggccgagctggaggagttcctgtgccctgtgaagaccccacctggcctggtgggcgtggccgccgccctgcagcccttccctgccctgcagaacatcagcctgaagcacctgggcacagagatccagaacaccatgcacaacatccggggcaacaagcaggcccagggcactggacatgagcccccaggagaggacagcccccagagcggggagccccagcgggaggagcagcccctggccagtgatgccagcaccccaggccgggagcctgaggacagccccaagccagcccccaagcccagcctgaccatcagctttgcccagaaggccaagaggcagaacaacaccttccccttcttcagcgagggcatcaccaggaacagaacagcccaggagaaggtggccgccctggagcagcaggtgctgatgctgaccaaggagctgaagagccagaaggagctggtgaagatcctgcacaaggccctggaggccgcccagcaggagaagagggccagcagcgcctacctggccgctgctgaggacaaggaccggctggagctggtgcgccacaaggtgcggcagattgctgagctgggccggcgggtggaggccctggagcaggagcgggagagcctggcccacacagccagcctgcgggagcagcaggtgcaggagctgcagcagcacgtgcagctgctgatggacaagaaccacgccaagcagcaggtgatctgcaagctgtctgagaaggtgacccaggacttcacccaccccccagaccagagccccctgcggccagatgctgccaacagagacttcctgagccagcagggcaagattgagcacctgaaggatgacatggaggcctaccgcacccagaactgcttcctgaacagcgagatccaccaggtgaccaagatctggaggaaggtggccgagaaggagaaggccctgctgaccaagtgtgcctacctgcaggccaggaactgccaggtggagagcaagtacctggccggcctgcggcggctgcaggaggccctgggagatgaggcctctgaatgttctgagctgctgcggcagctggtgcaggaggccctgcagtgggaggccggggaggccagcagtgacagcattgagctgagccccatcagcaaatatgatgaatatggcttcctgactgtgcctgactatgaggtggaggacctgaagctgctggccaagatccaggccctggagagccgcagccaccacctgctgggcctggaggccgtggaccggcccctgcgggagcgctgggccgccctgggggacctggtgcccagcgctgagctgaagcagctgctgcgggccggcgtgccccgggagcaccggccccgggtgtggcgctggctggtgcacctgcgggtgcagcacctgcacaccccaggctgctaccaggagctgctgagccggggccaggcccgggagcaccctgctgcccggcagatcgagctggacctgaacagaaccttccccaacaacaagcacttcacctgccccaccagcagcttcccagacaagctgcggcgggtgctgctggccttctcctggcagaaccccaccatcggctactgccagggcctgaaccggctggccgccatcgccctgctggtgctggaggaggaggagagcgccttctggtgcctggtggccatcgtggagaccatcatgcctgctgactactactgcaacaccctgacagccagccaggtggaccagagggtgctgcaggacctgctgtctgagaagctgccccggctgatggcccacctgggccagcaccacgtggacctgagcctggtgaccttcaactggttcctggtggtgtttgctgacagcctcatcagcaacatcctgctgcgggtgtgggatgccttcctgtatgagggcaccaagtacaatgagaaggagatcctgcggctgcagaatggcctggagatctaccagtacctgcgcttcttcaccaagaccatcagcaacagcaggaagctgatgaacatcgccttcaatgacatgaaccccttcaggatgaagcagctgcggcagctgaggatggtgcaccgggagcggctggaggccgagctgcgggagctggagcagctgaaggccgagtacctggagcggcgggccagcagaagaagagctgtgtctgagggctgtgcctctgaagatgaggtggagggggaggcctag

SEQ ID NO: 172735 - DNA, 1287 bp, Artificial Sequence
  Description of Artificial Sequence: Synthetic coding sequence
atgcccagcggctgctacgtgcccaggtctgagccccggctgctgcctgcccctcctcctgctggggcccgggtgggcgccctgcggagcgcccagggagatggccccaccagcggccactgggatggcggcgctgagaaggctgacttcaatgccaagaggaagaagaaggtggccgagatccaccaggccctgaacagcgaccccacagatgtggccgccctgcggaggatggccatcagcgagggcggcctgctgacagatgagatccggaggaaggtgtggcccaagctgctgaatgtgaatgccaatgaccccccacccatcagcggcaagaacctgcggcagatgagcaaggactaccagcaggtgctgctggatgtgagaagaagcctgcggcgcttccccccaggcatgcctgaggagcagcgggagggcctgcaggaggagctgattgacatcatcctgctgatcctggagaggaacccccagctgcactactaccagggctaccatgacatcgtggtgaccttcctgctggtggtgggggagcggctggccaccagcctggtggagaagctgagcacccaccacctgcgggacttcatggaccccaccatggacaacaccaagcacatcctgaactacctgatgcccatcatcgaccaggtgaaccctgagctgcatgacttcatgcagagcgctgaggtgggcaccatctttgccctgtcctggctgatcacctggtttggccacgtgctgagtgacttcagacatgtggtgcggctgtatgacttcttcctggcctgccaccccctgatgcccatctactttgctgctgtgattgtgctgtaccgggagcaggaggtgctggactgtgactgtgacatggcctctgtgcaccacctgctgagccagatcccccaggacctgccctatgagaccctcatcagccgggccggggacctgtttgtgcagttcccccccagcgagctggcccgggaggccgccgcccagcagcaggccgagaggacagctgccagcaccttcaaggactttgagctggccagcgcccagcagaggccagacatggtgctgcggcagcgcttccggggcctgctgcggcctgaggacaggaccaaggatgtgctgaccaagcccaggaccaacagatttgtgaagctggccgtgatgggcctgactgtggccctgggcgctgctgccctggccgtggtgaagagcgccctggagtgggcccccaagttccagctgcagctgttcccctag

SEQ ID NO: 172736 - DNA, 1212 bp, Artificial Sequence
  Description of Artificial Sequence: Synthetic coding sequence
atggccctgcggagcgcccagggagatggccccaccagcggccactgggatggaggagctgagaaggctgacttcaatgccaagaggaagaagaaggtggccgagatccaccaggccctgaacagcgaccccacagatgtggccgccctgcggaggatggccatcagcgagggcggcctgctgacagatgagatccggaggaaggtgtggcccaagctgctgaatgtgaatgccaatgaccccccacccatcagcggcaagaacctgcggcagatgagcaaggactaccagcaggtgctgctggatgtgcggcgcagcctgcggcgcttccccccaggcatgcctgaggagcagcgggagggcctgcaggaggagctgattgacatcatcctgctgatcctggagaggaacccccagctgcactactaccagggctaccatgacatcgtggtgaccttcctgctggtggtgggggagcggctggccaccagcctggtggagaagctgagcacccaccacctgcgggacttcatggaccccaccatggacaacaccaagcacatcctgaactacctgatgcccatcatcgaccaggtgaaccctgagctgcatgacttcatgcagagcgctgaggtgggcaccatctttgccctgtcctggctgatcacctggtttggacatgtgctgagtgacttccgccacgtggtgcggctgtatgacttcttcctggcctgccaccccctgatgcccatctactttgctgctgtgattgtgctgtaccgggagcaggaggtgctggactgtgactgtgacatggcctctgtgcaccacctgctgagccagatcccccaggacctgccctatgagaccctcatcagcagagctggggacctgtttgtgcagtttcctccttctgagctggcccgggaggccgccgcccagcagcaggccgagaggacagctgccagcaccttcaaggactttgagctggccagcgcccagcagaggccagacatggtgctgcggcagcgcttccggggcctgctgcggcctgaggacaggaccaaggatgtgctgaccaagcccaggaccaacagatttgtgaagctggccgtgatgggcctgactgtggccctgggcgccgccgccctggccgtggtgaagagcgccctggagtgggcccccaagttccagctgcagctgttcccctag

SEQ ID NO: 172737 - DNA, 1212 bp, Artificial Sequence; identical to SEQ ID NO: 172736
  Description of Artificial Sequence: Synthetic coding sequence

SEQ ID NO: 172738 - DNA, 1662 bp, Artificial Sequence; identical to SEQ ID NO: 172720
  Description of Artificial Sequence: Synthetic coding sequence

SEQ ID NO: 172739 - DNA, 1680 bp, Artificial Sequence
  Description of Artificial Sequence: Synthetic coding sequence
atggacagccctggctacaactgctttgtggacaaggacaagatggatgctgccatccaggacctgggccccaaggagctgagctgcacagagctgcaggagctgaagcagctggcccggcagggctactgggcccagagccacgccctgcggggcaaggtgtaccagaggctcatccgggacatcccctgcaggacagtgaccccagatgcctctgtgtacagcgacatcgtgggcaagatcgtgggcaagcacagcagcagctgcctgcccctgcctgagtttgtggacaacacccaggtgcccagctactgcctgaatgcccggggggagggcgctgtgaggaagatcctgctgtgcctggccaaccagttcccagacatctccttctgcccagccctgcctgctgtggtggccctgctgctgcactacagcattgatgaagctgagtgctttgagaaggcctgccgcatcctggcctgcaatgaccccggccggcggctgattgaccagagcttcctggcctttgagagcagctgcatgacctttggagacctggtgaacaagtactgccaggccgcccacaagctgatggtggccgtgtctgaagatgtgctgcaggtgtatgctgactggcagcgctggctgtttggagagctgcccctgtgctactttgcccgggtgtttgatgtgttcctggtggagggctacaaggtgctgtacagagtggccctggccatcctgaagttcttccacaaggtgcgggccggccagcccctggagagtgacagcgtgaagcaggacatccgcacctttgtgcgggacatcgccaagacagtgtccccagagaagctgctggagaaggcctttgccatccgcctcttcagcaggaaggagatccagctgctgcagatggccaatgagaaggccctgaagcagaagggcatcaccgtgaagcagaagtctgtgtccctgagcaagaggcagtttgtgcacctggccgtgcatgctgagaacttccgctctgagatcgtgtctgtgcgggagatgagggacatctggagctgggtgcctgagagatttgccctgtgccagcccctgctgctcttcagcagcctgcagcacggctacagcctggcccgcttctacttccagtgtgagggccacgagcccaccctgctgctgatcaagaccacccagaaggaggtgtgtggggcctacctgagcacagactggagcgagaggaacaagtttggaggcaagctgggcttctttggaactggagaatgttttgtgttccggctgcagcctgaggtgcagagatatgagtgggtggtgatcaagcaccctgagctgaccaagcccccacccctgatggctgctgagcccacagcccccctgagccacagcgccagcagtgaccctgctgaccggctgagccccttcctggccgcccggcacttcaacctgcccagcaagacagagagcatgttcatggccggcggcagtgactgcctgattgtgggcggcggcggcggccaggccctgtacattgatggagacctgaacagaggccgcaccagccactgtgacaccttcaacaaccagcccctgtgcagcgagaacttcctgattgctgctgtggaggcctggggcttccaggaccctgacacccagtag

SEQ ID NO: 172740 - DNA, 2067 bp, Artificial Sequence
  Description of Artificial Sequence: Synthetic coding sequence
atggccacagccagcggggccagtgacctgagcggcagcggggcccctcctcctggggtgggcgcccaggccgctgctgctgctgaggaggaggagcgggaggtggtgcgggtgcgggtgaagaagtgtgagagcttcctgcccccagagttccgcagctttgctgtggacccccagatcaccagcctggatgtgctgcagcacatcctgatccgggcctttgacctgagcggcaagaagaactttggcatctcctacctgggccgggaccggctgggccaggaggtgtacctgagcctgctgagtgactgggacctgagcacagcctttgccacagccagcaagccctacctgcagctgcgggtggacatccggcccagcgaggacagccccctgctggaggactgggacatcatcagccccaaggatgtgattggaagtgatgtgctgctggccgagaagaggagcagcctgaccacagctgccctgcccttcacccagagcatcctgacccaggtgggccgcaccctgagcaaggtgcagcaggtgctgtcctggagctatggagaagatgtgaagcccttcaagccacccctgagtgatgctgagttccacacctacctgaaccacgagggccagctgagcaggcctgaggagctgcggctgcgcatctaccacggcggcgtggagcccagcctgaggaaggtggtgtggagatacctgctgaatgtgtacccagatggcctgaccggccgggagaggatggactacatgaagaggaagagccgggagtatgagcagctgaagtctgagtgggcccagagggccaaccctgaggacctggagttcatccgcagcacagtgctgaaggatgtgctgaggacagaccgggcccacccctactatgccggcccagaagatggcccccacctgcgggccctgcatgacctgctgaccacctatgctgtgacccacccccaggtgtcctactgccagggcatgtctgacctggccagccccatcctggccgtgatggaccacgagggccacgcctttgtgtgcttctgtggcatcatgaagaggctggccgccaacttccacccagatggccgggccatggccaccaagtttgcccacctgaagctgctgctgcggcatgctgaccctgacttctaccagtacctgcaggaggccggggctgatgacctcttcttctgctaccgctggctgctgctggagctgaagcgggagtttgcctttgatgatgccctgaggatgctggaggtgacctggagcagcctgcccccagaccccccagagcacgaggtggagctggtgggcccccccagccaggtggctgatgctggctttggaggccaccggggctggcctgtgcggcagaggcacatgctgcggcctgctgggggcggcggcagcacctttgaagatgctgtggaccacctggccacagccagccagggccctgggggcggcggccgcctgctgcggcaggccagcctggatggcctgcagcagctgcgggacaacatgggcagccggcgggaccccctggtgcagctgccccaccctgctgccctgatcagcagcaagagcctgtctgagcccctgctgaacagcccagaccccctgctgagcagcttcagccacccagacagccccagcagcagcagcccccccagcacccaggaggccagccccaccggggacatggctgtgggcagccccctgatgcaggaggtgggcagccccaaggaccccgggaagagcctgccccctgtgccccccatgggcctgcccccaccccaggagtttggccggggcaaccccttcatgctgttcctgtgcctggccatcctgctggagcaccgggaccacatcatgagaaatggcctggactacaatgagctggccatgcactttgaccggctggtgaggaagcaccacctgggccgggtgctgcggcgggcccgggccctgtttgctgactacctgcagagcgaggtgtgggacagcgaggagggcgctgaggccacagctgccagctag

SEQ ID NO: 172741 - DNA, 693 bp, Artificial Sequence
  Description of Artificial Sequence: Synthetic coding sequence
atggccacagccagcggggccagtgacctgagcggcagcggggcccctcctcctggggtgggcgcccaggccgctgctgctgctgaggaggaggagcgggaggtggtgcgggtgcgggtgaagcatggagatggagcccctgggggcctgccccacgtgttcagcccccagaagtgtgagagcttcctgcccccagagttccgcagctttgctgtggacccccagatcaccagcctggatgtgctgcagcacatcctgatccgggcctttgacctgagcggcaagaagaactttggcatctcctacctgggccgggaccggctgggccaggaggtgtacctgagcctgctgagtgactgggacctgagcacagcctttgccacagccagcaagccctacctgcagctgcgggtggacatccggcccagcgaggacagccccctgctggaggactgggacatcatcagccccaaggatgtgattggaagtgatgtgctgctggccgagaagaggagcagcctgaccacagctgccctgcccttcacccagagcatcctgacccaggtgggccgcaccctgagcaaggtgcagcaggtgctgtcctggagctatggagaagatgtgaagcccttcaagccacccctgagtgatgctgagttccacacctacctgaaccacgagggccagctgtag

SEQ ID NO: 172742 - DNA, 303 bp, Artificial Sequence
  Description of Artificial Sequence: Synthetic coding sequence
atggccacagccagcggggccagtgacctgagcggcagcggggcccctcctcctggggtgggcgcccaggccgctgctgctgctgaggaggaggagcgggaggtggtgcgggtgcgggtgaagaagtgtgagagcttcctgcccccagagttccgcagctttgctgtggacccccagatcaccagcctggatgtgctgcagcacatcctgatccgggcctttgacctgagcggccccatcgcccggcggctgggccacaaccagccccagcgctgccactggctgcggcgggtggccggctag

SEQ ID NO: 172743 - DNA, 1305 bp, Artificial Sequence
  Description of Artificial Sequence: Synthetic coding sequence
atggactacatgaagaggaagagccgggagtatgagcagctgaagtctgagtgggcccagagggccaaccctgaggacctggagttcatccgcagcacagtgctgaaggatgtgctgaggacagaccgggcccacccctactatgccggcccagaagatggcccccacctgcgggccctgcatgacctgctgaccacctatgctgtgacccacccccaggtgtcctactgccagggcatgtctgacctggccagccccatcctggccgtgatggaccacgagggccacgcctttgtgtgcttctgtggcatcatgaagaggctggccgccaacttccacccagatggccgggccatggccaccaagtttgcccacctgaagctgctgctgcggcatgctgaccctgacttctaccagtacctgcaggaggccggggctgatgacctcttcttctgctaccgctggctgctgctggagctgaagcgggagtttgcctttgatgatgccctgaggatgctggaggtgacctggagcagcctgcccccagaccccccagagcacgaggtggagctggtgggcccccccagccaggtggctgatgctggctttggaggccaccggggctggcctgtgcggcagaggcacatgctgcggcctgctgggggcggcggcagcacctttgaagatgctgtggaccacctggccacagccagccagggccctgggggcggcggccgcctgctgcggcaggccagcctggatggcctgcagcagctgcgggacaacatgggcagccggcgggaccccctggtgcagctgccccaccctgctgccctgatcagcagcaagagcctgtctgagcccctgctgaacagcccagaccccctgctgagcagcttcagccacccagacagccccagcagcagcagcccccccagcacccaggaggccagccccaccggggacatggctgtgggcagccccctgatgcaggaggtgggcagccccaaggaccccgggaagagcctgccccctgtgccccccatgggcctgcccccaccccaggagtttggccggggcaaccccttcatgctgttcctgtgcctggccatcctgctggagcaccgggaccacatcatgagaaatggcctggactacaatgagctggccatgcactttgaccggctggtgaggaagcaccacctgggccgggtgctgcggcgggcccgggccctgtttgctgactacctgcagagcgaggtgtgggacagcgaggagggcgctgaggccacagctgccagctag

SEQ ID NO: 172744 - DNA, 876 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccagagcgccagcagaagaagacctggggtggcccggggccacgtgtttgccaccggcagcctcatccctggccctggcatgaggaccctgtgcagcagcatcctgggccccctgtag

SEQ ID NO: 172745 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagccctgtgcccccaccagcggcccctgcctgtgtggcctgcacctggagagcagccagttccccccaggcttctag

SEQ ID NO: 172746 - DNA, 900 bp, Artificial Sequence
  Description of Artificial Sequence: Synthetic coding sequence
atgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagccctgtgcccccaccagcggcccctgcctgtgtggcctgcacctggagagcagccagttccccccaggcttctag

SEQ ID NO: 172747 - DNA, 1584 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccagatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagccctgtgcccccaccagcggcccctgcctgtgtggcctgcacctggagagcagccagttccccccaggcttctag

SEQ ID NO: 172748 - DNA, 1650 bp, Artificial Sequence; identical to SEQ ID NO: 172745
  Description of Artificial Sequence: Synthetic coding sequence

SEQ ID NO: 172749 - DNA, 1584 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacttccctgaggaggatgccttctgggccctggtgcagctgctggccagcgagcggcacagcctgcagggcttccacagccccaacggcggcaccgtgcagggcctgcaggaccagcaggagcacgtggtggccaccagccagagcaagaccatgggccaccagatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtatgcccccaccagcggcccctgcctgtgtggcctgcacctggagagcagccagttccccccaggcttctag

SEQ ID NO: 172750 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacttccctgaggaggatgccttctgggccctggtgcagctgctggccagcgagcggcacagcctgcagggcttccacagccccaacggcggcaccgtgcagggcctgcaggaccagcaggagcacgtggtggccaccagccagagcaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtatgcccccaccagcggcccctgcctgtgtggcctgcacctggagagcagccagttccccccaggcttctag

SEQ ID NO: 172751 - DNA, 1650 bp, Artificial Sequence; identical to SEQ ID NO: 172750
  Description of Artificial Sequence: Synthetic coding sequence

SEQ ID NO: 172752 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagagcaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcctggttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172753 - DNA, 1584 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagagcaagaccatgggccaccagatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcctggttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172754 - DNA, 1650 bp, Artificial Sequence; identical to SEQ ID NO: 172752
  Description of Artificial Sequence: Synthetic coding sequence

SEQ ID NO: 172755 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacacagaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagccctgtgcccccaccagcggcccctgcctgtgtggcctgcacctggagagcagccagttccccccaggcttctag

SEQ ID NO: 172756 - DNA, 876 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacacagaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccagagcgccagcagaagaagacctggggtggcccggggccacgtgtttgccaccggcagcctcatccctggccctggcatgaggaccctgtgcagcagcatcctgggccccctgtag

SEQ ID NO: 172757 - DNA, 900 bp, Artificial Sequence; identical to SEQ ID NO: 172746
  Description of Artificial Sequence: Synthetic coding sequence

SEQ ID NO: 172758 - DNA, 1410 bp, Artificial Sequence
  Description of Artificial Sequence: Synthetic coding sequence
atgctgggggactgggagaagtacaagagcagcaggaagctgattgaccgggcctacaagggcatgcccatgaacatccggggccccatgtggagcgtgctgctgaacacagaggagatgaagctgaagaaccctggccgctaccagatcatgaaggagaagggcaagaggagcagcgagcacatccagagaattgacagagatgtgtctggcaccctgaggaagcacatcttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagccctgtgcccccaccagcggcccctgcctgtgtggcctgcacctggagagcagccagttccccccaggcttctag

SEQ ID NO: 172759 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172760 - DNA, 1650 bp, Artificial Sequence; identical to SEQ ID NO: 172759
  Description of Artificial Sequence: Synthetic coding sequence

SEQ ID NO: 172761 - DNA, 1584 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccagatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172762 - DNA, 1584 bp, Artificial Sequence; identical to SEQ ID NO: 172761
  Description of Artificial Sequence: Synthetic coding sequence

SEQ ID NO: 172763 - DNA, 1410 bp, Artificial Sequence
  Description of Artificial Sequence: Synthetic coding sequence
atgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172764 - DNA, 1410 bp, Artificial Sequence
  Description of Artificial Sequence: Synthetic coding sequence
atgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcctggttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172765 - DNA, 1650 bp, Artificial Sequence
  Description of Artificial Sequence: Synthetic coding sequence
atggatgtggtggaggtggccggctcctggtgggcccaggagcgggaggacatcatcatgaagtatgagaagggccaccaggccggcctgcctgaggacaagggccccaagcccttccgcagctacaacaacaacgtggaccacctgggcatcgtgcatgaaacagagctgccccccctgacagcccgggaggccaagcagatcagaagagagatcagcaggaagagcaagtgggtggacatgctgggggactgggagaagtacaagagcagcaggaagctgattgaccgggcctacaagggcatgcccatgaacatccggggccccatgtggagcgtgctgctgaacatcgaggagatgaagctgaagaaccctggccgctaccagatcatgaaggagaagggcaagaggagcagcgagcacatccagagaattgaccgggacatcagcggcaccctgaggaagcacatgttcttccgggacagatatggcaccaagcagcgggagctgctgcacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagccagcccaagaccatgggccaccaggacaagaaggacctgtgtggccagtgcagccccctgggctgcctgatccgcatcctgattgatggcatcagcctgggcctgaccctgcggctgtgggatgtgtacctggtggagggggagcaggccctgatgcccatcaccagaattgccttcaaggtgcagcagaagaggctgaccaagaccagccgctgtggcccctgggcccgcttctgcaacagatttgtggacacctgggccagagatgaggacacagtgctgaagcacctgcgggcctccatgaagaagctgaccaggaagcagggcgacctgcccccaccagccaagccagagcagggcagcagcgccagcaggcctgtgcctgccagccggggcggcaagaccctgtgcaagggggaccggcaggcccctcctggccccccagcccgcttcccccggcccatctggagcgccagccccccccgggcccccaggagcagcaccccctgccctggaggagctgtgcgggaggacacctaccctgtgggcacccagggcgtgcccagccctgccctggcccagggcggcccccagggctcctggaggttcctgcagtggaacagcatgccccggctgcccacagacctggatgtggagggcccctggttccgccactatgacttccggcagagctgctgggtgcgggccatcagccaggaggaccagctggccccctgctggcaggccgagcaccctgctgagcgggtgcgcagcgcctttgctgcccccagcacagacagcgaccagggcacccccttccgggccagagatgagcagcagtgtgcccccaccagcggcccctgcctgtgtggcctgcacctggagagcagccagttccccccaggcttctag

SEQ ID NO: 172766 - DNA, 1410 bp, Artificial Sequence; identical to SEQ ID NO: 172764
  Description of Artificial Sequence: Synthetic coding sequence

SEQ ID NO: 172767 - DNA, 3708 bp, Artificial Sequence
  Description of Artificial Sequence: Synthetic coding sequence
atggagccccccagctgcatccaggatgagcccttcccccaccccctggagcctgagcccggggtgtctgcccagcccggccctgggaagcccagcgacaagcgcttccggctgtggtacgtgggcggcagctgcctggaccacaggaccaccctgcccatgctgccctggctgatggccgagatcagaagaagaagccagaagccagaggccggcggctgtggggccccagctgcccgggaggtgatcctggtgctgagcgcccccttcctgcgctgtgtgcctgcccctggagctggggccagcggcggcaccagccccagcgccacccagcccaacccagctgtgttcatctttgagcacaaggcccagcacatcagccgcttcatccacaacagccatgacctgacctactttgcctacctgatcaaggcccagccagatgatcctgagagccagatggcctgccacgtgttccgggccacagaccccagccaggtgcctgatgtgatcagcagcatccggcagctgagcaaggccgccatgaaggaggatgccaagcccagcaaggacaatgaagatgccttctacaacagccagaagtttgaggtgctgtactgcggcaaggtgacagtgacccacaagaaggcccccagcagcctgattgatgactgcatggagaagttcagcctgcacgagcagcagaggctgaagatccagggcgagcagaggggccctgaccccggggaggacctggccgacctggaggtggtggtgcccggcagccctggggactgcctgcctgaggaggctgatggaacagacacccacctgggcctgcctgctggggccagccagcctgccctgaccagcagccgggtgtgcttccctgagcgcatcctggaggacagcggctttgatgagcagcaggagttccgcagccgctgcagctctgtgactggagtgcagaggagagtgcatgagggcagccagaagagccagcccaggagaagacatgccagcgcccccagccacgtgcagcccagcgacagcgagaagaacagaaccatgctgttccaggtgggccgctttgagatcaacctgatcagcccagacaccaagtctgtggtgctggagaagaacttcaaggacatcagcagctgcagccagggcatcaagcacgtggaccacttcggcttcatctgccgggagagccctgagcccggcctgagccagtacatctgctacgtgttccagtgtgccagcgagagcctggtggatgaggtgatgctgaccctgaagcaggccttcagcacagctgctgccctgcagagcgccaagacccagatcaagctgtgtgaggcctgccccatgcacagcctgcacaagctgtgtgagcgcatcgagggcctgtacccaccccgggccaagctggtgatccagaggcacctgagcagcctgacagacaatgagcaggccgacatctttgagcgggtgcagaagatgaagcctgtgtctgaccaggaggagaatgagctggtgatcctgcacctgcggcagctgtgtgaggccaagcagaagacccacgtgcacatcggggagggccccagcaccatcagcaacagcaccatcccagaaaatgccaccagcagcggccgcttcaagctggacatcctgaagaacaaggccaagaggagcctgaccagcagcctggagaacatcttcagcagaggagccaacaggatgaggggccgcctgggctctgtggacagctttgagaggagcaacagcctggccagcgagaaggactacagccctggggacagccccccaggcaccccaccagccagcccccccagcagcgcctggcagaccttcccagaagaagattctgacagcccccagttcagaagaagagcccacaccttcagccacccccccagcagcaccaagaggaagctgaacctgcaggacggccgggcccagggcgtgcgcagccccctgctgcggcagagcagcagcgagcagtgcagtgatggagagggcaggaagaggaccagcagcacctgcagcaatgaaagcctgtctgtgggcggcacctctgtgaccccccggcgcatctcctggaggcagaggatcttcctgcgggtggccagccccatgaacaagagccccagcgccatgcagcagcaggacggcctggacagaaatgagctgctgcccctgagccccctgagccccaccatggaggaggagcccctggtggtgttcctgtctggagaagatgatcctgagaagattgaggagaggaagaagagcaaggagctgcggagcctgtggaggaaggccatccaccagcagatcctgctgctgaggatggagaaggagaaccagaagctggaggccagcagagatgagctgcagagcaggaaggtgaagctggactatgaggaggtgggcgcctgccagaaggaggtgctgatcacctgggacaagaagctgctgaactgccgggccaagatccgctgtgacatggaggacatccacaccctgctgaaggagggcgtgcccaagagccggcggggggagatctggcagttcctggccctgcagtaccgcctgcggcaccggctgcccaacaagcagcagcccccagacatctcctacaaggagctgctgaagcagctgacagcccagcagcacgccatcctggtggacctgggccgcaccttccccacccacccctacttctctgtgcagctgggccctggccagctgagcctcttcaacctgctgaaggcctacagcctgctggacaaggaggtgggctactgccagggcatcagctttgtggccggcgtgctgctgctgcacatgtctgaggagcaggcctttgagatgctgaagttcctgatgtatgacctgggcttcaggaagcagtacagaccagacatgatgagcctgcagatccagatgtaccagctgagccggctgctgcatgactaccaccgggacctgtacaaccacctggaggagaatgagatcagccccagcctgtatgctgccccctggttcctgaccctgtttgccagccagttcagcctgggctttgtggcccgggtgtttgacatcatcttcctgcagggcacagaggtgatcttcaaggtggccctgagcctgctgagcagccaggagaccctcatcatggagtgtgagagctttgaaaatattgtggagttcctgaagaacaccctgcctgacatgaacaccagcgagatggagaagatcatcacccaggtgtttgagatggacatcagcaagcagctgcacgcctatgaggtggagtaccacgtgctgcaggatgagctgcaggagagcagctacagctgtgaagattctgagaccctggagaagctggagcgggccaacagccagctgaagaggcagaacatggacctgctggagaagctgcaggtggcccacaccaagatccaggccctggagagcaacctggagaacctgctgacccgggagaccaagatgaagagcctcatccgcaccctggagcaggagaagatggcctaccagaagacagtggagcagctgaggaagctgctgcctgcagatgccctggtgaactgtgacctgctgctgcgggacctgaactgcaaccccaacaacaaggccaagattggcaacaagccctag

SEQ ID NO: 172768 - DNA, 3897 bp, Artificial Sequence
  Description of Artificial Sequence: Synthetic coding sequence
atggagccccccagctgcatccaggatgagcccttcccccaccccctggagcctgagcccggggtgtctgcccagcccggccctgggaagcccagcgacaagcgcttccggctgtggtacgtgggcggcagctgcctggaccacaggaccaccctgcccatgctgccctggctgatggccgagatcagaagaagaagccagaagccagaggccggcggctgtggggccccagctgcccgggaggtgatcctggtgctgagcgcccccttcctgcgctgtgtgcctgcccctggagctggggccagcggcggcaccagccccagcgccacccagcccaacccagctgtgttcatctttgagcacaaggcccagcacatcagccgcttcatccacaacagccatgacctgacctactttgcctacctgatcaaggcccagccagatgatcctgagagccagatggcctgccacgtgttccgggccacagaccccagccaggtgcctgatgtgatcagcagcatccggcagctgagcaaggccgccatgaaggaggatgccaagcccagcaaggacaatgaagatgccttctacaacagccagaagtttgaggtgctgtactgcggcaaggtgacagtgacccacaagaaggcccccagcagcctgattgatgactgcatggagaagttcagcctgcacgagcagcagaggctgaagatccagggcgagcagaggggccctgaccccggggaggacctggccgacctggaggtggtggtgcccggcagccctggggactgcctgcctgaggaggctgatggaacagacacccacctgggcctgcctgctggggccagccagcctgccctgaccagcagccgggtgtgcttccctgagcgcatcctggaggacagcggctttgatgagcagcaggagttccgcagccgctgcagctctgtgactggagtgcagaggagagtgcatgagggcagccagaagagccagcccaggagaagacatgccagcgcccccagccacgtgcagcccagcgacagcgagaagaacagaaccatgctgttccaggtgggccgctttgagatcaacctgatcagcccagacaccaagtctgtggtgctggagaagaacttcaaggacatcagcagctgcagccagggcatcaagcacgtggaccacttcggcttcatctgccgggagagccctgagcccggcctgagccagtacatctgctacgtgttccagtgtgccagcgagagcctggtggatgaggtgatgctgaccctgaagcaggccttcagcacagctgctgccctgcagagcgccaagacccagatcaagctgtgtgaggcctgccccatgcacagcctgcacaagctgtgtgagcgcatcgagggcctgtacccaccccgggccaagctggtgatccagaggcacctgagcagcctgacagacaatgagcaggccgacatctttgagcgggtgcagaagatgaagcctgtgtctgaccaggaggagaatgagctggtgatcctgcacctgcggcagctgtgtgaggccaagcagaagacccacgtgcacatcggggagggccccagcaccatcagcaacagcaccatcccagaaaatgccaccagcagcggccgcttcaagctggacatcctgaagaacaaggccaagaggagcctgaccagcagcctggagaacatcttcagcagaggagccaacaggatgaggggccgcctgggctctgtggacagctttgagaggagcaacagcctggccagcgagaaggactacagccctggggacagccccccaggcaccccaccagccagcccccccagcagcgcctggcagaccttcccagaagaagattctgacagcccccagttcagaagaagagcccacaccttcagccacccccccagcagcaccaagaggaagctgaacctgcaggacggccgggcccagggcgtgcgcagccccctgctgcggcagagcagcagcgagcagtgcagcaacctgagctctgtgcggaggatgtacaaggagagcaacagcagcagcagcctgcccagcctgcacaccagcttcagcgcccccagcttcaccgcccccagcttcctgaagagcttctaccagaacagcggccgcctgagcccccagtatgaaaatgagatccggcaggacacagccagcgagagcagtgatggagagggcaggaagaggaccagcagcacctgcagcaatgaaagcctgtctgtgggcggcacctctgtgaccccccggcgcatctcctggaggcagaggatcttcctgcgggtggccagccccatgaacaagagccccagcgccatgcagcagcaggacggcctggacagaaatgagctgctgcccctgagccccctgagccccaccatggaggaggagcccctggtggtgttcctgagcggggaggatgatcctgagaagattgaggagaggaagaagagcaaggagctgcggagcctgtggaggaaggccatccaccagcagatcctgctgctgaggatggagaaggagaaccagaagctggaggccagcagagatgagctgcagagcaggaaggtgaagctggactatgaggaggtgggcgcctgccagaaggaggtgctgatcacctgggacaagaagctgctgaactgccgggccaagatccgctgtgacatggaggacatccacaccctgctgaaggagggcgtgcccaagagcagaagaggagagatctggcagttcctggccctgcagtaccgcctgcggcaccggctgcccaacaagcagcagcccccagacatctcctacaaggagctgctgaagcagctgacagcccagcagcacgccatcctggtggacctgggccgcaccttccccacccacccctacttctctgtgcagctgggccctggccagctgagcctcttcaacctgctgaaggcctacagcctgctggacaaggaggtgggctactgccagggcatcagctttgtggccggcgtgctgctgctgcacatgtctgaggagcaggcctttgagatgctgaagttcctgatgtatgacctgggcttcaggaagcagtacagaccagacatgatgagcctgcagatccagatgtaccagctgagccggctgctgcatgactaccaccgggacctgtacaaccacctggaggagaatgagatcagccccagcctgtatgctgccccctggttcctgaccctgtttgccagccagttcagcctgggctttgtggcccgggtgtttgacatcatcttcctgcagggcacagaggtgatcttcaaggtggccctgagcctgctgagcagccaggagaccctcatcatggagtgtgagagctttgagaacatcgtggagttcctgaagaacaccctgcctgacatgaacaccagcgagatggagaagatcatcacccaggtgtttgagatggacatcagcaagcagctgcacgcctatgaggtggagtaccacgtgctgcaggatgagctgcaggagagcagctacagctgtgaggacagcgagaccctggagaagctggagcgggccaacagccagctgaagaggcagaacatggacctgctggagaagctgcaggtggcccacaccaagatccaggccctggagagcaacctggagaacctgctgacccgggagaccaagatgaagagcctcatccgcaccctggagcaggagaagatggcctaccagaagacagtggagcagctgaggaagctgctgcctgcagatgccctggtgaactgtgacctgctgctgcgggacctgaactgcaaccccaacaacaaggccaagattggcaacaagccctag

SEQ ID NO: 172769 - DNA, 849 bp, Artificial Sequence
  Description of Artificial Sequence: Synthetic coding sequence
gacaatgagcaggccgacatctttgagcgggtgcagaagatgaagcctgtgtctgaccaggaggagaatgagctggtgatcctgcacctgcggcagctgtgtgaggccaagcagaagacccacgtgcacatcggggagggccccagcaccatcagcaacagcaccatcccagaaaatgccaccagcagcggccgcttcaagctggacatcctgaagaacaaggccaagaggagcctgaccagcagcctggagaacatcttcagcagaggagccaacaggatgaggggccgcctgggctctgtggacagctttgagaggagcaacagcctggccagcgagaaggactacagccctggggacagccccccaggcaccccaccagccagcccccccagcagcgcctggcagaccttcccagaagaagattctgacagcccccagttcagaagaagagcccacaccttcagccacccccccagcagcaccaagaggaagctgaacctgcaggacggccgggcccagggcgtgcgcagccccctgctgcggcagagcagcagcgagcagtgcagtgatggagagggcaggaagaggaccagcagcacctgcagcaatgaaagcctgtctgtgggcggcacctctgtgaccccccggcgcatctcctggaggcagaggatcttcctgcgggtggccagccccatgaacaagagccccagcgccatgcagcagcaggacggcctggacagaaatgagctgctgcccctgagccccctgagccccaccatggaggaggagcccctggtggtgttcctgtctggagaagatgatcctgagaagattgaggagaggtag

SEQ ID NO: 172770 - DNA, 1389 bp, Artificial Sequence
  Description of Artificial Sequence: Synthetic coding sequence
atgaacaagagccccagcgccatgcagcagcaggacggcctggacagaaatgagctgctgcccctgagccccctgagccccaccatggaggaggagcccctggtggtgttcctgtctggagaagatgatcctgagaagattgaggagaggaagaagagcaaggagctgcggagcctgtggaggaaggccatccaccagcagatcctgctgctgaggatggagaaggagaaccagaagctggagggcgtgcccaagagcagaagaggagagatctggcagttcctggccctgcagtaccgcctgcggcaccggctgcccaacaagcagcagcccccagacatctcctacaaggagctgctgaagcagctgacagcccagcagcacgccatcctggtggacctgggccgcaccttccccacccacccctacttctctgtgcagctgggccctggccagctgagcctcttcaacctgctgaaggcctacagcctgctggacaaggaggtgggctactgccagggcatcagctttgtggccggcgtgctgctgctgcacatgtctgaggagcaggcctttgagatgctgaagttcctgatgtatgacctgggcttcaggaagcagtacagaccagacatgatgagcctgcagatccagatgtaccagctgagccggctgctgcatgactaccaccgggacctgtacaaccacctggaggagaatgagatcagccccagcctgtatgctgccccctggttcctgaccctgtttgccagccagttcagcctgggctttgtggcccgggtgtttgacatcatcttcctgcagggcacagaggtgatcttcaaggtggccctgagcctgctgagcagccaggagaccctcatcatggagtgtgagagctttgagaacatcgtggagttcctgaagaacaccctgcctgacatgaacaccagcgagatggagaagatcatcacccaggtgtttgagatggacatcagcaagcagctgcacgcctatgaggtggagtaccacgtgctgcaggatgagctgcaggagagcagctacagctgtgaggacagcgagaccctggagaagctggagcgggccaacagccagctgaagaggcagaacatggacctgctggagaagctgcaggtggcccacaccaagatccaggccctggagagcaacctggagaacctgctgacccgggagaccaagatgaagagcctcatccgcaccctggagcaggagaagatggcctaccagaagacagtggagcagctgaggaagctgctgcctgcagatgccctggtgaactgtgacctgctgctgcgggacctgaactgcaaccccaacaacaaggccaagattggcaacaagccctag

SEQ ID NO: 172771 - DNA, 3873 bp, Artificial Sequence
  Description of Artificial Sequence: Synthetic coding sequence
atggagccccccagctgcatccaggatgagcccttcccccaccccctggagcctgagcccggggtgtctgcccagcccggccctgggaagcccagcgacaagcgcttccggctgtggtacgtgggcggcagctgcctggaccacaggaccaccctgcccatgctgccctggctgatggccgagatcagaagaagaagccagaagccagaggccggcggctgtggggccccagctgcccgggaggtgatcctggtgctgagcgcccccttcctgcgctgtgtgcctgcccctggagctggggccagcggcggcaccagccccagcgccacccagcccaacccagctgtgttcatctttgagcacaaggcccagcacatcagccgcttcatccacaacagccatgacctgacctactttgcctacctgatcaaggcccagccagatgatcctgagagccagatggcctgccacgtgttccgggccacagaccccagccaggtgcctgatgtgatcagcagcatccggcagctgagcaaggccgccatgaaggaggatgccaagcccagcaaggacaatgaagatgccttctacaacagccagaagtttgaggtgctgtactgcggcaaggtgacagtgacccacaagaaggcccccagcagcctgattgatgactgcatggagaagttcagcctgcacgagcagcagaggctgaagatccagggcgagcagaggggccctgaccccggggaggacctggccgacctggaggtggtggtgcccggcagccctggggactgcctgcctgaggaggctgatggaacagacacccacctgggcctgcctgctggggccagccagcctgccctgaccagcagccgggtgtgcttccctgagcgcatcctggaggacagcggctttgatgagcagcaggagttccgcagccgctgcagctctgtgactggagtgcagaggagagtgcatgagggcagccagaagagccagcccaggagaagacatgccagcgcccccagccacgtgcagcccagcgacagcgagaagaacagaaccatgctgttccaggtgggccgctttgagatcaacctgatcagcccagacaccaagtctgtggtgctggagaagaacttcaaggacatcagcagctgcagccagggcatcaagcacgtggaccacttcggcttcatctgccgggagagccctgagcccggcctgagccagtacatctgctacgtgttccagtgtgccagcgagagcctggtggatgaggtgatgctgaccctgaagcaggccttcagcacagctgctgccctgcagagcgccaagacccagatcaagctgtgtgaggcctgccccatgcacagcctgcacaagctgtgtgagcgcatcgagggcctgtacccaccccgggccaagctggtgatccagaggcacctgagcagcctgacagacaatgagcaggccgacatctttgagcgggtgcagaagatgaagcctgtgtctgaccaggaggagaatgagctggtgatcctgcacctgcggcagctgtgtgaggccaagcagaagacccacgtgcacatcggggagggccccagcaccatcagcaacagcaccatcccagaaaatgccaccagcagcggccgcttcaagctggacatcctgaagaacaaggccaagaggagcctgaccagcagcctggagaacatcttcagcagaggagccaacaggatgaggggccgcctgggctctgtggacagctttgagaggagcaacagcctggccagcgagaaggactacagccctggggacagccccccaggcaccccaccagccagcccccccagcagcgcctggcagaccttcccagaagaagattctgacagcccccagttcagaagaagagcccacaccttcagccacccccccagcagcaccaagaggaagctgaacctgcaggacggccgggcccagggcgtgcgcagccccctgctgcggcagagcagcagcgagcagtgcagcaacctgagctctgtgcggaggatgtacaaggagagcaacagcagcagcagcctgcccagcctgcacaccagcttcagcgcccccagcttcaccgcccccagcttcctgaagagcttctaccagaacagcggccgcctgagcccccagtatgaaaatgagatcagtgatggagagggcaggaagaggaccagcagcacctgcagcaatgaaagcctgtctgtgggcggcacctctgtgaccccccggcgcatctcctggaggcagaggatcttcctgcgggtggccagccccatgaacaagagccccagcgccatgcagcagcaggacggcctggacagaaatgagctgctgcccctgagccccctgagccccaccatggaggaggagcccctggtggtgttcctgagcggggaggatgatcctgagaagattgaggagaggaagaagagcaaggagctgcggagcctgtggaggaaggccatccaccagcagatcctgctgctgaggatggagaaggagaaccagaagctggaggccagcagagatgagctgcagagcaggaaggtgaagctggactatgaggaggtgggcgcctgccagaaggaggtgctgatcacctgggacaagaagctgctgaactgccgggccaagatccgctgtgacatggaggacatccacaccctgctgaaggagggcgtgcccaagagcagaagaggagagatctggcagttcctggccctgcagtaccgcctgcggcaccggctgcccaacaagcagcagcccccagacatctcctacaaggagctgctgaagcagctgacagcccagcagcacgccatcctggtggacctgggccgcaccttccccacccacccctacttctctgtgcagctgggccctggccagctgagcctcttcaacctgctgaaggcctacagcctgctggacaaggaggtgggctactgccagggcatcagctttgtggccggcgtgctgctgctgcacatgtctgaggagcaggcctttgagatgctgaagttcctgatgtatgacctgggcttcaggaagcagtacagaccagacatgatgagcctgcagatccagatgtaccagctgagccggctgctgcatgactaccaccgggacctgtacaaccacctggaggagaatgagatcagccccagcctgtatgctgccccctggttcctgaccctgtttgccagccagttcagcctgggctttgtggcccgggtgtttgacatcatcttcctgcagggcacagaggtgatcttcaaggtggccctgagcctgctgagcagccaggagaccctcatcatggagtgtgagagctttgagaacatcgtggagttcctgaagaacaccctgcctgacatgaacaccagcgagatggagaagatcatcacccaggtgtttgagatggacatcagcaagcagctgcacgcctatgaggtggagtaccacgtgctgcaggatgagctgcaggagagcagctacagctgtgaggacagcgagaccctggagaagctggagcgggccaacagccagctgaagaggcagaacatggacctgctggagaagctgcaggtggcccacaccaagatccaggccctggagagcaacctggagaacctgctgacccgggagaccaagatgaagagcctcatccgcaccctggagcaggagaagatggcctaccagaagacagtggagcagctgaggaagctgctgcctgcagatgccctggtgaactgtgacctgctgctgcgggacctgaactgcaaccccaacaacaaggccaagattggcaacaagccctag

SEQ ID NO: 172772 - DNA, 1197 bp, Artificial Sequence
  Description of Artificial Sequence: Synthetic coding sequence
atgcacttcagcacagtgacccgggacatggaggccttcaccgccagcagcctgagcagcctgggcgccgccggcggcttccctggggccgccagccctggagctgacccctacggcccccgggagcccccacctcctccacccaggtatgacccctgtgccgccgccgcccctggggcccctggccccccacctccaccccacgcctacccctttgccccagctgctggggccgccaccagcgctgctgctgagcctgagggccctggggccagctgtgccgccgccgccaaggcccctgtgaagaagaatgccaaggtggccggcgtgtctgtgcagctggagatgaaggccctgtgggatgagttcaaccagctgggcacagagatgattgtgaccaaggccggccgcaggatgttccccaccttccaggtgaagctgtttggcatggaccccatggctgactacatgctgctgatggactttgtgcctgtggatgacaagcgctaccgctatgccttccacagcagctcctggctggtggccggcaaggctgaccctgccaccccaggccgggtgcactaccacccagacagccctgccaagggggcccagtggatgaagcagatcgtgtcctttgacaagctgaagctgaccaacaacctgctggatgacaatggccacatcatcctgaacagcatgcaccgctaccagccccgcttccacgtggtgtatgtggaccccaggaaggacagcgagaagtatgcagaggagaacttcaagacctttgtgtttgaggagacccgcttcaccgctgtgacagcctaccagaaccaccgcatcacccagctgaagatcgccagcaacccctttgccaagggcttccgggactgtgaccctgaggactggcccaggaaccacaggcctggggccctgcccctgatgtctgcctttgcccggagcaggaaccctgtggccagccccacccagcccagcggcacagagaagggcggccacgtgctgaaggacaaggaggtgaaggccgagaccagcaggaacaccccagagcgggaggtggagctgctgagagatgctgggggctgtgtgaacctgggcctgccctgcccagctgagtgccagcccttcaacacccagggcctggtggccggccgcacagctggggaccggctgtgctag

SEQ ID NO: 172773 - DNA, 1488 bp, Artificial Sequence
  Description of Artificial Sequence: Synthetic coding sequence
atgcacttcagcacagtgacccgggacatggaggccttcaccgccagcagcctgagcagcctgggcgccgccggcggcttccctggggccgccagccctggagctgacccctacggcccccgggagcccccacctcctccacccaggtatgacccctgtgccgccgccgcccctggggcccctggccccccacctccaccccacgcctacccctttgccccagctgctggggccgccaccagcgctgctgctgagcctgagggccctggggccagctgtgccgccgccgccaaggcccctgtgaagaagaatgccaaggtggccggcgtgtctgtgcagctggagatgaaggccctgtgggatgagttcaaccagctgggcacagagatgattgtgaccaaggccggccgcaggatgttccccaccttccaggtgaagctgtttggcatggaccccatggctgactacatgctgctgatggactttgtgcctgtggatgacaagcgctaccgctatgccttccacagcagctcctggctggtggccggcaaggctgaccctgccaccccaggccgggtgcactaccacccagacagccctgccaagggggcccagtggatgaagcagatcgtgtcctttgacaagctgaagctgaccaacaacctgctggatgacaatggccacatcatcctgaacagcatgcaccgctaccagccccgcttccacgtggtgtatgtggaccccaggaaggacagcgagaagtatgcagaggagaacttcaagacctttgtgtttgaggagacccgcttcaccgctgtgacagcctaccagaaccaccgcatcacccagctgaagatcgccagcaacccctttgccaagggcttccgggactgtgaccctgaggactggcccaggaaccacaggcctggggccctgcccctgatgtctgcctttgcccggagcaggaaccctgtggccagccccacccagcccagcggcacagagaaggatgctgctgaggcccggcgggagttccagagagatgctgggggccctgctgtgctgggggaccctgcccaccccccccagctgctggcccgggtgctgagccccagcctgcccggggccggcggggccggcggcctggtgcccctgcccggggcccctgggggccggcccagcccccccaaccctgagctgcggctggaggcccctggggccagcgagcccctgcaccaccacccctacaagtacccagctgctgcctatgaccactacctgggcgccaagagcaggcctgccccctaccccctgcccggcctgcggggccacggctaccacccccacgcccacccccaccaccaccaccaccctgtgtccccagctgctgctgctgctgctgctgctgctgctgctgctgctgctgccaacatgtacagcagcgctggggccgcccctcctggcagctatgactactgccccaggtag

SEQ ID NO: 172774 - DNA, 1119 bp, Artificial Sequence
  Description of Artificial Sequence: Synthetic coding sequence
atgcacttcagcacagtgacccgggacatggaggccttcaccgccagcagcctgagcagcctgggcgccgccggcggcttccctggggccgccagccctggagctgacccctacggcccccgggagcccccacctcctccacccaggtatgacccctgtgccgccgccgcccctggggcccctggccccccacctccaccccacgcctacccctttgccccagctgctggggccgccaccagcgctgctgctgagcctgagggccctggggccagctgtgccgccgccgccaaggcccctgtgaagaagaatgccaaggtggccggcgtgtctgtgcagctggagatgaaggccctgtgggatgagttcaaccagctgggcacagagatgattgtgaccaaggccggccgcaggatgttccccaccttccaggtgaagctgtttggcatggaccccatggctgactacatgctgctgatggactttgtgcctgtggatgacaagcgctaccgctatgccttccacagcagctcctggctggtggccggcaaggctgaccctgccaccccaggccgggtgcactaccacccagacagccctgccaagggggcccagtggatgaagcagatcgtgtcctttgacaagctgaagctgaccaacaacctgctggatgacaatggccacatcatcctgaacagcatgcaccgctaccagccccgcttccacgtggtgtatgtggaccccaggaaggacagcgagaagtatgcagaggagaacttcaagacctttgtgtttgaggagacccgcttcaccgctgtgacagcctaccagaaccaccgcatcacccagctgaagatcgccagcaacccctttgccaagggcttccgggactgtgaccctgaggactggcccaggaaccacaggcctggggccctgcccctgatgtctgcctttgcccggagcaggaaccctgtggccagccccacccagcccagcggcacagagaagggcctggtgacagagggcagcggcctgcagcccggcctgctggatgtgctgctgaagccacccagcaagaagtctgagagcctgcggcccccccactgcaaggacacctag

SEQ ID NO: 172775 - DNA, 1158 bp, Artificial Sequence
  Description of Artificial Sequence: Synthetic coding sequence
atggccgccttcctgtctgctggcctgggcatcctggcccccagcgagacctaccccctgcccaccaccagcagcggctgggagccccggctgggcagccccttccccagcggcccctgcaccagcagcactggagcccaggccgtggccgagcccaccggccagggccccaagaacccccgggtgtcccgggtgacagtgcagctggagatgaagcccctgtgggaggagttcaaccagctgggcacagagatgattgtgaccaaggccggccgcaggatgttcccccccttccaggtgaagatcctgggcatggacagcctggccgactatgccctgctgatggacttcatccccctggatgacaagcgctaccgctatgccttccacagcagcgcctggctggtggccggcaaggctgaccctgccaccccaggccgggtgcacttccacccagacagccctgccaagggggcccagtggatgaggcagatcgtgtcctttgacaagctgaagctgaccaacaacctgctggatgacaatggccacatcatcctgaacagcatgcaccgctaccagccccgcttccacgtggtgtttgtggaccccaggaaggacagcgagagatatgcccaggagaacttcaagagcttcatcttcacagagacccagttcaccgctgtgacagcctaccagaaccaccgcatcacccagctgaagatcgccagcaacccctttgccaagggcttccgggagagtgacctggacagctggcctgtggccccccggcccctgctgtctgtgcctgcccggagccacagcagcctgagcccctgtgtgctgaagggggccacagaccgggagaaggaccccaacaaggccagcgccagcaccagcaagaccccagcctggctgcaccaccagctgctgcccccacctgaggtgctgctggccccagccacctacagacctgtgacctaccagagcctgtacagcggggcccccagccacctgggcatccccaggaccaggcctgccccctaccccctgcccaacatccgggctgaccgggaccagggcggcctgcccctgcctgctggcctgggcctgctgagccccaccgtggtgtgcctgggccctggccaggacagccagtag

SEQ ID NO: 172776 - DNA, 2454 bp, Artificial Sequence
  Description of Artificial Sequence: Synthetic coding sequence
atgatggatggccccaggagtgatgtgggccgctggggcggcaaccccctgcagccccccaccacccccagccctgagcctgagcctgagccagatggccgcagccggcggggcggcggccgctccttctgggcccgctgctgcggctgctgcagctgcagaaatgctgctgatgatgactggggccctgagcccagcgacagccggggccggggcagcagcagcggcacccggcggcccggcagccggggcagtgacagccggcggcctgtgtcccggggcagcggcgtgaatgctgctggagatggcaccatccgggagggcatgctggtggtgaatggagtggacctgctgagcagcagaagtgaccagaacagaagagagcaccacacagatgaatatgaatatgatgagctgattgtgcggcggggccagcccttccacatgctgctgctgctgagcaggacctatgagagcagtgaccgcatcaccctggagctgctgattggcaacaaccctgaggtgggcaagggcacccacgtgatcatccctgtgggcaaaggaggcagcggcggctggaaggcccaggtggtgaaggccagcggccagaacctgaacctgcgggtgcacaccagccccaatgccatcatcggcaagttccagttcaccgtgaggacccagagtgatgctggggagttccagctgccctttgaccccagaaatgagatctacatcctcttcaacccctggtgcccagaagatattgtgtatgtggaccacgaggactggaggcaggagtatgtgctgaatgaaagtggccgcatctactatggaacagaggcccagattggagagaggacctggaactacggccagtttgaccatggagtgctggatgcctgcctgtacatcctggacagaagaggcatgccctacggcggccgcggggaccctgtgaatgtgtccagggtcatcagcgccatggtgaacagcctggatgacaatggagtgctgattggcaactggagcggggactacagccggggcaccaaccccagcgcctgggtgggctctgtggagatcctgctgagctacctgaggacaggctacagcgtgccctacggccagtgctgggtgtttgctggggtgaccaccaccgtgctgcgctgcctgggcctggccaccaggacagtgaccaacttcaacagcgcccatgacacagacaccagcctgaccatggacatctactttgatgagaacatgaagcccctggagcacctgaaccatgattctgtgtggaacttccacgtgtggaatgactgctggatgaagaggccagacctgcccagcggctttgatggctggcaggtggtggatgccaccccccaggagaccagcagcggcatcttctgctgcggcccctgcagcgtggagagcatcaagaatggcctggtgtacatgaagtatgacacccccttcatctttgctgaggtgaacagcgacaaggtgtactggcagaggcaggatgatggcagcttcaagatcgtgtatgtggaggagaaggccatcggcaccctgattgtgaccaaggccatcagcagcaacatgagggaggacatcacctacctgtacaagcaccctgagggcagtgatgctgagaggaaggctgtggagacagctgctgcccacggcagcaagcccaacgtgtatgccaacagaggcagcgcagaagatgtggccatgcaggtggaggcccaggatgctgtgatgggccaggacctgatggtgtctgtgatgctgatcaaccacagcagcagcagaagaacagtgaagctgcacctgtacctgtctgtgaccttctacacaggagtgtctggcaccatcttcaaggagaccaagaaggaggtggagctggcccctggggccagtgacagagtgaccatgcctgtggcctacaaggagtaccggccccacctggtggaccagggcgccatgctgctgaatgtgtctggccacgtgaaggagagcggccaggtgctggccaagcagcacaccttccggctgcggaccccagacctgagcctgaccctgctgggcgctgctgtggtgggccaggagtgtgaggtgcagatcgtgttcaagaaccccctgcctgtgaccctgaccaacgtggtgttccggctggagggcagcggcctgcagaggcccaagatcctgaatgtgggggacatcggcggcaatgaaacagtgaccctgcggcagagctttgtgcctgtgcggcccggcccccggcagctgattgccagcctggacagcccccagctgagccaggtgcatggagtcatccaggtggatgtggccccagcccctggagatggcggcttcttcagtgatgctggaggagacagccacctgggggagaccatccccatggccagcagaggaggagcctag

SEQ ID NO: 172777 - DNA, 1200 bp, Artificial Sequence
  Description of Artificial Sequence: Synthetic coding sequence
atgcacaagtaccagccccgggtgcacgtgatcaggaaggacttcagcagtgacctgagccccaccaagcctgtgcctgtgggagatggagtgaagaccttcaacttccctgagaccgtcttcaccaccgtgacagcctaccagaaccagcagatcacccggctgaagattgacaggaacccctttgccaagggcttccgggacagcggcaggaacagaacaggcctggaggccatcatggagacctacgccttctggaggcctcctgtgaggaccctgacctttgaggacttcaccaccatgcagaagcagcaggccagcaagaagaccagccagggctacacagtgaaccagcacagcagcgagacagatgccatcgagctgtatgaaagaagagtgtggctgatggagcggcggggcagcacaggcaccagccccaccaccagcagcacaggcacccccagccccagcgccagcagccacctgctgagccccagctgcagcccccccaccttccacctggcccccaacaccttcaacgtgggctgccgggagagccagctgtgcaacctgaacctgagtgactacccaccctgtgcccggagcaacatggccgccctgcagagctacccaggcctgagtgacagcggctacaaccggctgcagagcggcaccaccagcgccacccagcccagcgagaccttcatgccccagaggacccccagcctcatcagcggcatccccaccccacccagcctgcccggcaacagcaagatggaggcctacggcggccagctgggcagcttccccaccagccagttccagtatgtgatgcaggccggaaatgctgccagcagcagcagcagcccccacatgtttggaggcagccacatgcagcagagcagctacaatgccttcagcctgcacaacccctacaacctgtatggctacaacttccccaccagcccccggctggccgccagccctgagaagctgagcgccagccagagcaccctgctgtgcagcagccccagcaatggagcctttggagagcggcagtacctgcccagcggcatggagcacagcatgcacatgatcagccccagccccaacaaccagcaggccaccaacacctgtgatggccggcagtacggggctgtgcccggcagcagcagccagatgtctgtgcacatggtgtag

SEQ ID NO: 172778 - DNA, 1809 bp, Artificial Sequence
  Description of Artificial Sequence: Synthetic coding sequence
atgtctgagaggagaagatctgctgtggccctgagcagccgggcccacgccttctctgtggaggccctgattggcagcaacaagaagaggaagctgcgggactgggaggagaagggcctggacctgtccatggaggccctgagccctgctggccccctgggggacacagaagatgctgctgcccacggcctggagccccacccagacagcgagcagagcacaggcagtgacagcgaggtgctgacagagaggaccagctgcagcttcagcacccacacagacctggccagcggggccgccggccctgtgcctgctgccatgagctccatggaggagatccaggtggagctgcagtgtgccgacctgtggaagcgcttccatgacattggaacagagatgatcatcaccaaggccggccgcaggatgtttcctgccatgagggtgaagatcaccggcctggacccccaccagcagtactacatcgccatggacatcgtgcctgtggacaacaagcgctaccgctacgtgtaccacagcagcaagtggatggtggccggaaatgctgacagccctgtgcccccccgggtgtacatccacccagacagcctggccagcggggacacctggatgaggcaggtggtgtcctttgacaagctgaagctgaccaacaatgagctggatgaccagggccacatcatcctgcacagcatgcacaagtaccagccccgggtgcacgtgatcaggaaggacttcagcagtgacctgagccccaccaagcctgtgcctgtgggagatggagtgaagaccttcaacttccctgagaccgtcttcaccaccgtgacagcctaccagaaccagcagatcacccggctgaagattgacaggaacccctttgccaagggcttccgggacagcggcaggaacagaacaggcctggaggccatcatggagacctacgccttctggaggcctcctgtgaggaccctgacctttgaggacttcaccaccatgcagaagcagcagggcggcagcacaggcaccagccccaccaccagcagcacaggcacccccagccccagcgccagcagccacctgctgagccccagctgcagcccccccaccttccacctggcccccaacaccttcaacgtgggctgccgggagagccagctgtgcaacctgaacctgagtgactacccaccctgtgcccggagcaacatggccgccctgcagagctacccaggcctgagtgacagcggctacaaccggctgcagagcggcaccaccagcgccacccagcccagcgagaccttcatgccccagaggacccccagcctcatcagcggcatccccaccccacccagcctgcccggcaacagcaagatggaggcctatggaggccagctgggcagcttccccaccagccagttccagtatgtgatgcaggccggaaatgctgccagcagcagcagcagcccccacatgtttggaggcagccacatgcagcagagcagctacaatgccttcagcctgcacaacccctacaacctgtatggctacaacttccccaccagcccccggctggccgccagccctgagaagctgagcgccagccagagcaccctgctgtgcagcagccccagcaatggagccttcggggagcggcagtacctgcccagcggcatggagcacagcatgcacatgatcagccccagccccaacaaccagcaggccaccaacacctgtgatggccggcagtatggagctgtgcccggcagcagcagccagatgtctgtgcacatggtgtag

SEQ ID NO: 172779 - DNA, 762 bp, Artificial Sequence
  Description of Artificial Sequence: Synthetic coding sequence
cgggtgaggacaggcctggaggccatcatggagacctacgccttctggaggcctcctgtgaggaccctgacctttgaggacttcaccaccatgcagaagcagcaggccagcaagaagaccagccagggctacacagtgaaccagcacagcagcgagacagatgccatcgagctgtatgaaagaagagtgtggctgatggagcggcggggcagcacaggcaccagccccaccaccagcagcacaggcacccccagccccagcgccagcagccacctgctgagccccagctgcagcccccccaccttccacctggcccccaacaccttcaacgtgggctgccgggagagccagctgtgcaacctgaacctgagtgactacccaccctgtgcccggagcaacatggccgccctgcagagctacccaggcctgagtgacagcggctacaaccggctgcagagcggcaccaccagcgccacccagcccagcgagaccttcatgccccagaggacccccagcctcatcagcggcatccccaccccacccagcctgcccacagcccgctggaagcccaccgtggcctcctggggccccttccccctgcccagcttctccatgagctgccggcaggccatgctgcccccagccccccaccaccacacctgcagcggggccgccacctgcagccgggcccccaccatgcccagccccttcaccaccctgaccacctgcatggacaccatcagccccctgcccctgggctag

SEQ ID NO: 172780 - DNA, 993 bp, Artificial Sequence
  Description of Artificial Sequence: Synthetic coding sequence
ggcaggaacagaacaggcctggaggccatcatggagacctacgccttctggaggcctcctgtgaggaccctgacctttgaggacttcaccaccatgcagaagcagcaggccagcaagaagaccagccagggctacacagtgaaccagcacagcagcgagacagatgccatcgagctgtatgaaagaagagtgtggctgatggagcggcggggcagcacaggcaccagccccaccaccagcagcacaggcacccccagccccagcgccagcagccacctgctgagccccagctgcagcccccccaccttccacctggcccccaacaccttcaacgtgggctgccgggagagccagctgtgcaacctgaacctgagtgactacccaccctgtgcccggagcaacatggccgccctgcagagctacccaggcctgagtgacagcggctacaaccggctgcagagcggcaccaccagcgccacccagcccagcgagaccttcatgccccagaggacccccagcctcatcagcggcatccccaccccacccagcctgcccggcaacagcaagatggaggcctatggaggccagctgggcagcttccccaccagccagttccagtatgtgatgcaggccggaaatgctgccagcagcagcagcagcccccacatgtttggaggcagccacatgcagcagagcagctacaatgccttcagcctgcacaacccctacaacctgtatggctacaacttccccaccagcccccggctggccgccagccctgagaagctgagcgccagccagagcaccctgctgtgcagcagccccagcaatggagccttcggggagcggcagtacctgcccagcggcatggagcacagcatgcacatgatcagccccagccccaacaaccagcaggccaccaacacctgtgatggccggcagtatggagctgtgcccggcagcagcagccagatgtctgtgcacatggtgtag

SEQ ID NO: 172781 - DNA, 1347 bp, Artificial Sequence
  Description of Artificial Sequence: Synthetic coding sequence
atggccatgtctgagctgggcaccaggaagcccagtgatggcaccgtgagccacctgctgaatgtggtggagagcgagctgcaggccggccgggagaagggggaccccacagagaagcagctgcagatcatcctggaggatgcccccctgtggcagcgcttcaaggaggtgaccaatgagatgattgtgaccaagaatggccgcaggatgtttcctgtgctgaagatctctgtgacaggcctggaccccaatgccatgtacagcctgctgctggactttgtgcccacagacagccaccgctggaagtatgtgaatggagagtgggtgcctgctgggaagccagaggtgagcagccacagctgtgtgtacatccacccagacagccccaactttggagcccactggatgaaggcccccatctccttcagcaaggtgaagctgaccaacaagctgaatggaggcggccagatcatgctgaacagcctgcacaagtatgagccccaggtgcacatcgtgcgggtgggcagcgcccacaggatggtgaccaactgcagcttccctgagacccagttcatcgctgtgacagcctaccagaatgaggagatcacagccctgaagatcaagtacaacccctttgccaaggccttcctggatgccaaggagaggaaccacctgagagatgtgcctgaggccatcagcgagagccagcacgtgacctacagccacctgggcggctggatcttcagcaacccagatggagtgtgcacagctggcaacagcaactaccagtatgctgcccccctgcccctgcctgccccccacacccaccacggctgtgagcactacagcggcctgcggggccaccggcaggccccctaccccagcgcctacatgcacaggaaccacagccccagcgtgaacctgattgagagcagcagcaacaacctgcaggtgttcagcggccctgacagctggaccagcctgagcagcacccctcatgccagcatcctgtctgtgccccacaccaacggccccatcaaccctggccccagcccctacccctgcctgtggaccatcagcaatggagctgggggccccagcggccctggccctgaggtgcacgccagcacccctggggccttcctgctgggcaacccagctgtgaccagccccccatctgtgctgagcacccaggcccccaccagcgctggggtggaggtgctgggggagcccagcctgaccagcattgctgtgtccacctggacagctgtggccagccacccctttgctggctggggcggccctggagctgggggccaccacagccccagcagcctggatggatag

SEQ ID NO: 172782 - DNA, 978 bp, Artificial Sequence
  Description of Artificial Sequence: Synthetic coding sequence
atgattgtgaccaagaatggccgcaggatgtttcctgtgctgaagatctctgtgacaggcctggaccccaatgccatgtacagcctgctgctggactttgtgcccacagacagccaccgctggaagtatgtgaatggagagtgggtgcctgctgggaagccagaggtgagcagccacagctgtgtgtacatccacccagacagccccaactttggagcccactggatgaaggcccccatctccttcagcaaggtgaagctgaccaacaagctgaatggaggcggccagatcatgctgaacagcctgcacaagtatgagccccaggtgcacatcgtgcgggtgggcagcgcccacaggatggtgaccaactgcagcttccctgagacccagttcatcgctgtgacagcctaccagaatgaggagatcacagccctgaagatcaagtacaacccctttgccaaggccttcctggatgccaaggagaggaaccacctgagagatgtgcctgaggccatcagcgagagccagcacgtgacctacagccacctgaacctgattgagagcagcagcaacaacctgcaggtgttttctggccctgacagctggaccagcctgagcagcaccccccacgccagcatcctgtctgtgccccacaccaacggccccatcaaccctggccccagcccctacccctgcctgtggaccatcagcaatggagctgggggccccagcggccctggccctgaggtgcacgccagcacccctggggccttcctgctgggcaacccagctgtgaccagcccccccagcgtgctgagcacccaggcccccaccagcgctggggtggaggtgctgggggagcccagcctgaccagcattgctgtgtccacctggacagctgtggccagccacccctttgctggctggggcggccctggggccggcggccaccacagccccagcagcctggatggatag

SEQ ID NO: 172783 - DNA, 957 bp, Artificial Sequence
  Description of Artificial Sequence: Synthetic coding sequence
tgaagaatgtttcctgtgctgaagatctctgtgacaggcctggaccccaatgccatgtacagcctgctgctggactttgtgcccacagacagccaccgctggaagtatgtgaatggagagtgggtgcctgctgggaagccagaggtgagcagccacagctgtgtgtacatccacccagacagccccaactttggagcccactggatgaaggcccccatctccttcagcaaggtgaagctgaccaacaagctgaatggaggcggccagatcatgctgaacagcctgcacaagtatgagccccaggtgcacatcgtgcgggtgggcagcgcccacaggatggtgaccaactgcagcttccctgagacccagttcatcgctgtgacagcctaccagaatgaggagatcacagccctgaagatcaagtacaacccctttgccaaggccttcctggatgccaaggagaggaaccacctgagagatgtgcctgaggccatcagcgagagccagcacgtgacctacagccacctgaacctgattgagagcagcagcaacaacctgcaggtgttcagcggccctgacagctggaccagcctgagcagcacccctcatgccagcatcctgtctgtgccccacaccaacggccccatcaaccctggccccagcccctacccctgcctgtggaccatcagcaatggagctgggggccccagcggccctggccctgaggtgcacgccagcacccctggggccttcctgctgggcaacccagctgtgaccagccccccatctgtgctgagcacccaggcccccaccagcgctggggtggaggtgctgggggagcccagcctgaccagcattgctgtgtccacctggacagctgtggccagccacccctttgctggctggggcggccctggagctgggggccaccacagccccagcagcctggatggatag

SEQ ID NO: 172784 - DNA, 846 bp, Artificial Sequence
  Description of Artificial Sequence: Synthetic coding sequence
tgaaaggagcgggagctgaactggttctaccgccggcagagggtgctgtttgcccacgtgtaccccaccttcaccaacaccagctgcctgtgcaagtgcaagatcacagccctgaagatcaagtacaacccctttgccaaggccttcctggatgccaaggagaggaaccacctgagagatgtgcctgaggccatcagcgagagccagcacgtgacctacagccacctgggcggctggatcttcagcaacccagatggagtgtgcacagctggcaacagcaactaccagtatgctgcccccctgcccctgcctgccccccacacccaccacggctgtgagcactacagcggcctgcggggccaccggcaggccccctaccccagcgcctacatgcacaggaaccacagccccagcgtgaacctgattgagagcagcagcaacaacctgcaggtgttttctggccctgacagctggaccagcctgagcagcaccccccacgccagcatcctgtctgtgccccacaccaacggccccatcaaccctggccccagcccctacccctgcctgtggaccatcagcaatggagctgggggccccagcggccctggccctgaggtgcacgccagcacccctggggccttcctgctgggcaacccagctgtgaccagcccccccagcgtgctgagcacccaggcccccaccagcgctggggtggaggtgctgggggagcccagcctgaccagcattgctgtgtccacctggacagctgtggccagccacccctttgctggctggggcggccctggggccggcggccaccacagccccagcagcctggatggatag

SEQ ID NO: 172785 - DNA, 1344 bp, Artificial Sequence
  Description of Artificial Sequence: Synthetic coding sequence
atggagttcaccgccagccccaagccccagctgagcagccgggccaatgccttcagcattgctgccctgatgagcagcggcggcagcaaggagaaggaggccacagagaacaccatcaagcccctggagcagtttgtggagaagagcagctgtgcccagcccctgggggagctgaccagcctggatgcccacggggagtttggaggcggcagcggcagcagccccagcagcagcagcctgtgcacagagcccctcatccccaccacccccatcatccccagcgaggagatggccaagatcgcctgcagcctggagaccaaggagctgtgggacaagttccacgagctgggcacagagatgatcatcaccaagtctggaagaaggatgttccccaccatccgggtgtccttcagcggcgtggaccctgaggccaagtacatcgtgctgatggacatcgtgcctgtggacaacaagcgctaccgctatgcctaccacaggagctcctggctggtggccggcaaggctgacccccccctgcctgcccggctgtatgtgcacccagacagccccttcaccggggagcagctgctgaagcagatggtgtcctttgagaaggtgaagctgaccaacaatgagctggaccagcacggccacatcatcctgaacagcatgcacaagtaccagccccgggtgcacatcatcaagaagaaggaccacacagccagcctgctgaacctgaagtctgaggagttccgcaccttcatcttccctgagaccgtcttcaccgctgtgacagcctaccagaaccagctgatcaccaagctgaagattgacagcaacccctttgccaagggcttccgggacagcagccggctgacagacatcgagcgggagagcgtggagagcctcatccagaagcacagctatgcccggagccccatccgcacctatggaggagaagaagatgtgctgggagatgagagccagaccacccccaacagaggcagcgccttcaccaccagtgacaacctgagcctgagctcctgggtgagcagcagcagcagcttccctggcttccagcacccccagagcctgacagccctgggcaccagcacagccagcatcgccacccccatcccccaccccatccagggcagcctgcccccctacagccggctgggcatgcccctgacccccagcgccatcgccagctccatgcagggcagcggccccaccttccccagcttccacatgccccgctaccaccactacttccagcagggcccctatgctgccatccagggcctgcggcacagcagcgctgtgatgaccccatttgtgtag

SEQ ID NO: 172786 - DNA, 1608 bp, Artificial Sequence
  Description of Artificial Sequence: Synthetic coding sequence
atgggcatcgtggagcccggctgtggggacatgctgactggaacagagcccatgcctggcagtgatgagggccgggcccctggagctgacccccagcaccgctacttctacccagagcccggggcccaggatgctgatgagcggcggggcggcggcagcctgggcagcccctacccaggaggagccctggtgcctgccccacccagccgcttcctgggcgcctatgcctacccaccccggccccaggccgccggcttccctggagctggggagagcttccccccaccagcagatgctgagggctaccagcccggggagggctatgctgccccagaccccagggctggcctgtacccaggccccagagaagattatgccctgcctgctggcctggaggtgtctgggaagctgcgggtggccctgaacaaccacctgctgtggagcaagttcaaccagcaccagacagagatgatcatcaccaagcagggccgcaggatgttccccttcctgtccttcaccgtggccggcctggagcccaccagccactacaggatgtttgtggatgtggtgctggtggaccagcaccactggagataccagagcggcaagtgggtgcagtgtgggaaggccgagggctccatgcctggcaaccggctgtatgtgcacccagacagccccaacacaggagcccactggatgaggcaggaggtgtcctttgggaagctgaagctgaccaacaacaagggggccagcaacaacgtgacccagatgattgtgctgcagagcctgcacaagtaccagccccggctgcacatcgtggaggtgaatgatggagagcctgaggccgcctgcaatgccagcaacacccacatcttcaccttccaggagacccagttcatcgctgtgacagcctaccagaatgctgagatcacccagctgaagattgacaacaacccctttgccaagggcttccgggagaactttgagagcatgtacacctctgtggacaccagcatccccagccccccaggccccaactgccagttcctgggcggggaccactacagccccctgctgcccaaccagtaccctgtgcccagccgcttctacccagacctgcccggccaggccaaggatgtggtgccccaggcctactggctgggcgccccccgggaccacagctatgaagctgagttccgggctgtgtccatgaagccagccttcctgcccagcgcccctggccccaccatgagctactaccggggccaggaggtgctggcccctggggccggctggcctgtggccccccagtacccacccaagatgggccctgcctcctggttccggcccatgaggaccctgcccatggagcccggccctgggggcagcgagggccggggccctgaggaccagggcccccccctggtgtggacagagatcgcccccatccggcctgagagcagtgacagcggcctgggggagggggacagcaagagaagaagagtgagcccctaccccagcagcggggacagcagcagccctgctggggcccccagcccctttgacaaggaggccgagggccagttctacaactacttccccaactag

SEQ ID NO: 172787 - DNA, 1203 bp, Artificial Sequence
  Description of Artificial Sequence: Synthetic coding sequence
atgttccccagcgtgcgggtgaaggtgaagggcctggaccccgggaagcagtaccacgtggccattgatgtggtgcctgtggacagcaagcgctaccgctacgtgtaccacagcagccagtggatggtggccggcaacacagaccacctgtgcatcatcccccgcttctacgtgcacccagacagcccctgcagcggggagacctggatgaggcagatcatcagctttgacaggatgaagctgaccaacaatgagatggatgacaagggccacatcatcctgcagagcatgcacaagtacaagccccgggtgcacgtgattgagcagggcagctctgtggacctgagccagatccagagcctgcccacagaaggagtgaagaccttctccttcaaggagacagagttcaccaccgtgacagcctaccagaaccagcagatcaccaagctgaagattgaaagaaacccctttgccaagggcttccgggacaccggcaggaacagaggagtgctggatggcctgctggagacctacccctggaggcccagcttcaccctggacttcaagacctttggagctgacacccagagcggcagcagcggcagcagccctgtgaccagcagcggcggggcccccagccccctgaacagcctgctgagccccctgtgcttcagccccatgttccacctgcccaccagcagcctgggcatgccctgcccagaggcctacctgcccaacgtgaacctgcccctgtgctacaagatctgccccaccaacttctggcagcagcagcccctggtgctgcctgcccctgagcggctggccagcagcaacagcagccagagcctggcccccctgatgatggaggtgcccatgctgagcagcctgggcgtgaccaacagcaagagcggcagcagcgaggacagcagtgaccagtacctgcaggcccccaacagcaccaaccagatgctgtatggcctgcagagccctggcaacatcttcctgcccaacagcatcaccccagaggccctgagctgcagcttccaccccagctatgacttctaccgctacaacttctccatgcccagccgcctcatcagcggcagcaaccacctgaaggtgaatgatgacagccaggtgtcctttggagagggcaagtgcaaccacgtgcactggtacccagccatcaaccactacctgtag

SEQ ID NO: 172788 - DNA, 1563 bp, Artificial Sequence
  Description of Artificial Sequence: Synthetic coding sequence
atggccctgagcagccgggcccgggccttctctgtggaggccctggtgggccggcccagcaagaggaagctgcaggaccccatccaggccgagcagcctgagctgcgggagaagaagggcggggaggaggaggaggagaggaggagcagcgctgctgggaagtctgagcccctggagaagcagcccaagacagagcccagcaccagcgccagcagcggctgcggcagtgacagcggctacggcaacagcagcgagagcctggaggagaaggacatccagatggagctgcagggcagcgagctgtggaagcgcttccatgacatcggcacagagatgatcatcaccaaggccggccgcaggatgttccccagcgtgcgggtgaaggtgaagggcctggaccccgggaagcagtaccacgtggccattgatgtggtgcctgtggacagcaagcgctaccgctacgtgtaccacagcagccagtggatggtggccggcaacacagaccacctgtgcatcatcccccgcttctacgtgcacccagacagcccctgcagcggggagacctggatgaggcagatcatcagctttgacaggatgaagctgaccaacaatgagatggatgacaagggccacatcatcctgcagagcatgcacaagtacaagccccgggtgcacgtgattgagcagggcagctctgtggacctgagccagatccagagcctgcccacagaaggagtgaagaccttctccttcaaggagacagagttcaccaccgtgacagcctaccagaaccagcagatcaccaagctgaagattgaaagaaacccctttgccaagggcttccgggacaccggcaggaacagaggagtgctggatggcctgctggagacctacccctggaggcccagcttcaccctggacttcaagacctttggagctgacacccagagcggcagcagcggcagcagccctgtgaccagcagcggcggggcccccagccccctgaacagcctgctgagccccctgtgcttcagccccatgttccacctgcccaccagcagcctgggcatgccctgcccagaggcctacctgcccaacgtgaacctgcccctgtgctacaagatctgccccaccaacttctggcagcagcagcccctggtgctgcctgcccctgagcggctggccagcagcaacagcagccagagcctggcccccctgatgatggaggtgcccatgctgagcagcctgggcgtgaccaacagcaagagcggcagcagcgaggacagcagtgaccagtacctgcaggcccccaacagcaccaaccagatgctgtatggcctgcagagccctggcaacatcttcctgcccaacagcatcaccccagaggccctgagctgcagcttccaccccagctatgacttctaccgctacaacttctccatgcccagccgcctcatcagcggcagcaaccacctgaaggtgaatgatgacagccaggtgtcctttggagagggcaagtgcaaccacgtgcactggtacccagccatcaaccactacctgtag

SEQ ID NO: 172789 - DNA, 1563 bp, Artificial Sequence; identical to SEQ ID NO: 172788
  Description of Artificial Sequence: Synthetic coding sequence

SEQ ID NO: 172790 - DNA, 1203 bp, Artificial Sequence; identical to SEQ ID NO: 172787
  Description of Artificial Sequence: Synthetic coding sequence

SEQ ID NO: 172791 - DNA, 2232 bp, Artificial Sequence
  Description of Artificial Sequence: Synthetic coding sequence
atgagcctgtccatgagggaccccgtcatccctggcacctccatggcctaccaccccttcctgccccaccgggccccagactttgccatgtctgctgtgctgggccaccagccccccttcttccctgccctgaccctgcccccaaatggagctgctgccctgagcctgcccggggccctggccaagcccatcatggaccagctggtgggcgctgctgagaccggcatccccttcagcagcctgggcccccaggcccacctgcggcccctgaagaccatggagcctgaggaggaggtggaggatgaccccaaggtgcacctggaggccaaggagctgtgggaccagttccacaagaggggcacagagatggtgatcaccaagagcggccgcaggatgttcccccccttcaaggtgcgctgcagcggcctggacaagaaggccaagtacatcctgctgatggacatcatcgccgcagatgactgccgctacaagttccacaacagccgctggatggtggccggcaaggctgaccctgagatgcccaagaggatgtacatccacccagacagccctgccactggagagcagtggatgagcaaggtggtgaccttccacaagctgaagctgaccaacaacatcagtgacaagcacggcttcaccctggccttccccagcgaccacgccacctggcagggcaactacagctttggcacccagaccatcctgaacagcatgcacaagtaccagccccgcttccacatcgtgcgggccaatgacatcctgaagctgccctacagcaccttccgcacctacctgtttcctgagacagagttcatcgctgtgacagcctaccagaatgacaagatcacccagctgaagattgacaacaacccctttgccaagggcttccgggacacaggaaatggccggcgggagaagaggaagcagctgaccctgcagagcatgagggtgtttgatgagcggcacaagaaggaaaatggcaccagtgatgagagcagcagcgagcaggccgccttcaactgctttgcccaggccagcagccctgctgccagcacagtgggcaccagcaacctgaaggacctgtgccccagcgagggggagagtgatgctgaggccgagagcaaggaggagcacggccctgaggcctgtgatgctgccaagatcagcaccaccaccagcgaggagccctgccgggacaagggcagccctgctgtgaaggcccacctgtttgctgctgagcggccccgggacagcggccgcctggacaaggccagcccagacagccgccacagccctgccaccatcagcagcagcacccggggcctgggcgctgaggagcggcgcagccctgtgcgggagggcacagccccagccaaggtggaggaggcccgggccctgcccgggaaggaggcctttgcccccctgactgtgcagacagatgctgctgctgcccacctggcccagggccccctgcccggcctgggctttgcccctggcctggccggccagcagttcttcaacggccaccccctcttcctgcaccccagccagtttgccatgggcggggccttcagctccatggctgctgctggcatgggccccctgctggccaccgtgtctggggccagcactggagtgtctggcctggacagcacagccatggccagcgctgctgctgcccagggcctgagcggggccagcgctgccaccctgcccttccacctgcagcagcacgtgctggccagccagggcctggccatgagccccttcggcagcctcttcccctacccctacacctacatggctgctgctgctgctgccagcagcgctgctgccagcagctctgtgcaccgccaccccttcctgaacctgaacaccatgaggccccggctgcgctacagcccctacagcatccctgtgcctgtgcctgatggcagcagcctgctgaccacagccctgcccagcatggctgctgctgctggccccctggatggcaaggtggccgccctggccgccagccctgcctctgtggccgtggacagcggcagcgagctgaacagccgcagcagcaccctgagcagcagctccatgagcctgagccccaagctgtgtgccgagaaggaggccgccaccagcgagctgcagagcatccagaggctggtgtctggcctggaggccaagccagacaggagccgcagcgccagcccctag

SEQ ID NO: 172792 - DNA, 2172 bp, Artificial Sequence
  Description of Artificial Sequence: Synthetic coding sequence
atgagcctgtccatgagggaccccgtcatccctggcacctccatggcctaccaccccttcctgccccaccgggccccagactttgccatgtctgctgtgctgggccaccagccccccttcttccctgccctgaccctgcccccaaatggagctgctgccctgagcctgcccggggccctggccaagcccatcatggaccagctggtgggcgctgctgagaccggcatccccttcagcagcctgggcccccaggcccacctgcggcccctgaagaccatggagcctgaggaggaggtggaggatgaccccaaggtgcacctggaggccaaggagctgtgggaccagttccacaagaggggcacagagatggtgatcaccaagagcggccgcaggatgttcccccccttcaaggtgcgctgcagcggcctggacaagaaggccaagtacatcctgctgatggacatcatcgccgcagatgactgccgctacaagttccacaacagccgctggatggtggccggcaaggctgaccctgagatgcccaagaggatgtacatccacccagacagccctgccactggagagcagtggatgagcaaggtggtgaccttccacaagctgaagctgaccaacaacatcagtgacaagcacggcttcaccatcctgaacagcatgcacaagtaccagccccgcttccacatcgtgcgggccaatgacatcctgaagctgccctacagcaccttccgcacctacctgtttcctgagacagagttcatcgctgtgacagcctaccagaatgacaagatcacccagctgaagattgacaacaacccctttgccaagggcttccgggacacaggaaatggccggcgggagaagaggaagcagctgaccctgcagagcatgagggtgtttgatgagcggcacaagaaggaaaatggcaccagtgatgagagcagcagcgagcaggccgccttcaactgctttgcccaggccagcagccctgctgccagcacagtgggcaccagcaacctgaaggacctgtgccccagcgagggggagagtgatgctgaggccgagagcaaggaggagcacggccctgaggcctgtgatgctgccaagatcagcaccaccaccagcgaggagccctgccgggacaagggcagccctgctgtgaaggcccacctgtttgctgctgagcggccccgggacagcggccgcctggacaaggccagcccagacagccgccacagccctgccaccatcagcagcagcacccggggcctgggcgctgaggagcggcgcagccctgtgcgggagggcacagccccagccaaggtggaggaggcccgggccctgcccgggaaggaggcctttgcccccctgactgtgcagacagatgctgctgctgcccacctggcccagggccccctgcccggcctgggctttgcccctggcctggccggccagcagttcttcaacggccaccccctcttcctgcaccccagccagtttgccatgggcggggccttcagctccatggctgctgctggcatgggccccctgctggccaccgtgtctggggccagcactggagtgtctggcctggacagcacagccatggccagcgctgctgctgcccagggcctgagcggggccagcgctgccaccctgcccttccacctgcagcagcacgtgctggccagccagggcctggccatgagccccttcggcagcctcttcccctacccctacacctacatggctgctgctgctgctgccagcagcgctgctgccagcagctctgtgcaccgccaccccttcctgaacctgaacaccatgaggccccggctgcgctacagcccctacagcatccctgtgcctgtgcctgatggcagcagcctgctgaccacagccctgcccagcatggctgctgctgctggccccctggatggcaaggtggccgccctggccgccagccctgcctctgtggccgtggacagcggcagcgagctgaacagccgcagcagcaccctgagcagcagctccatgagcctgagccccaagctgtgtgccgagaaggaggccgccaccagcgagctgcagagcatccagaggctggtgtctggcctggaggccaagccagacaggagccgcagcgccagcccctag

SEQ ID NO: 172793 - DNA, 1803 bp, Artificial Sequence
  Description of Artificial Sequence: Synthetic coding sequence
atgagcctgtccatgagggaccccgtcatccctggcacctccatggcctaccaccccttcctgccccaccgggccccagactttgccatgtctgctgtgctgggccaccagccccccttcttccctgccctgaccctgcccccaaatggagctgctgccctgagcctgcccggggccctggccaagcccatcatggaccagctggtgggcgctgctgagaccggcatccccttcagcagcctgggcccccaggcccacctgcggcccctgaagaccatggagcctgaggaggaggtggaggatgaccccaaggtgcacctggaggccaaggagctgtgggaccagttccacaagaggggcacagagatggtgatcaccaagagcggccgcaggatgttcccccccttcaaggtgcgctgcagcggcctggacaagaaggccaagtacatcctgctgatggacatcatcgccgcagatgactgccgctacaagttccacaacagccgctggatggtggccggcaaggctgaccctgagatgcccaagaggatgtacatccacccagacagccctgccactggagagcagtggatgagcaaggtggtgaccttccacaagctgaagctgaccaacaacatcagtgacaagcacggcttcaccctggccttccccagcgaccacgccacctggcagggcaactacagctttggcacccagaccatcctgaacagcatgcacaagtaccagccccgcttccacatcgtgcgggccaatgacatcctgaagctgccctacagcaccttccgcacctacctgtttcctgagacagagttcatcgctgtgacagcctaccagaatgacaagatcacccagctgaagattgacaacaacccctttgccaagggcttccgggacacaggaaatggccggcgggagaagaggaagcagctgaccctgcagagcatgagggtgtttgatgagcggcacaagaaggaaaatggcaccagtgatgagagcagcagcgagcaggccgccttcaactgctttgcccaggccagcagccctgctgccagcacagtgggcaccagcaacctgaaggacctgtgccccagcgagggggagagtgatgctgaggccgagagcaaggaggagcacggccctgaggcctgtgatgctgccaagatcagcaccaccaccagcgaggagccctgccgggacaagggcagccctgctgtgaaggcccacctgtttgctgctgagcggccccgggacagcggccgcctggacaaggccagcccagacagccgccacagccctgccaccatcagcagcagcacccggggcctgggcgctgaggagcggcgcagccctgtgcgggagggcacagccccagccaaggtggaggaggcccgggccctgcccgggaaggaggcctttgcccccctgactgtgcagacagatgctgctgctgctgctgccagcagctctgtgcaccgccaccccttcctgaacctgaacaccatgaggccccggctgcgctacagcccctacagcatccctgtgcctgtgcctgatggcagcagcctgctgaccacagccctggccgccagccctgcctctgtggccgtggacagcggcagcgagctgaacagccgcagcagcaccctgagcagcagctccatgagcctgagccccaagctgtgtgccgagaaggaggccgccaccagcgagctgcagagcatccagaggctggtgtctggcctggaggccaagccagacaggagccgcagcgccagcccctag

SEQ ID NO: 172794 - DNA, 1638 bp, Artificial Sequence
  Description of Artificial Sequence: Synthetic coding sequence
atgctgcaggacaagggcctgtctgagagcgaggaggccttccgggcccctggccctgccctgggggaggccagcgctgccaatgcccctgagcccgccctggccgcccctggcctgagcggggccgccctgggcagccccccaggccctggagcagatgtggtggccgctgctgctgctgagcagaccatcgagaacatcaaggtgggcctgcacgagaaggagctgtggaagaagttccatgaagctggaacagagatgatcatcaccaaggccggccgcaggatgttccccagctacaaggtgaaggtgacaggcatgaaccccaagaccaagtacatcctgctgattgatattgtgcctgcagatgaccaccgctacaagttctgtgacaacaagtggatggtggccggcaaggccgagcccgccatgcctggccgcctgtatgtgcacccagacagccctgccactggagcccactggatgaggcagctggtgtccttccagaagctgaagctgaccaacaaccacctggaccccttcggccacatcatcctgaacagcatgcacaagtaccagccccggctgcacatcgtgaaggcagatgaaaataatgccttcggcagcaagaacacagccttctgcacccacgtgtttcctgagaccagcttcatctctgtgaccagctaccagaaccacaagatcacccagctgaagattgagaacaacccctttgccaagggcttccggggcagtgatgacagcgacctgcgggtggcccggctgcagagcaaggagtaccctgtgatcagcaagagcatcatgaggcagaggctcatcagcccccagctgagcgccaccccagatgtgggccccctgctgggcacccaccaggccctgcagcactaccagcatgaaaatggagcccacagccagctggccgagccccaggacctgcccctgagcaccttccccacccagagggacagcagcctcttctaccactgcctgaagagaagagatggcaccaggcacctggacctgccctgcaagaggagctacctggaggcccccagctctgtgggggaggaccactacttccgcagccccccaccctatgaccagcagatgctgagccccagctactgcagcgaggtgaccccccgggaggcctgcatgtacagcggcagcggccctgagattgctggggtgtctggagtggatgacctgcccccaccacccctgagctgcaacatgtggacctctgtgagcccctacaccagctacagcgtgcagaccatggagaccgtgccctaccagcccttccccacccacttcaccgccaccaccatgatgccccggctgcccaccctgagcgcccagagcagccagcccccaggaaatgcccacttctctgtgtacaaccagctgagccagagccaggtgcgggagcggggccccagcgccagcttcccccgggagcggggcctgccccagggctgtgagaggaagccacccagcccccacctgaatgctgccaatgagttcctgtacagccagaccttcagcctgagccgggagagcagcctgcagtaccacagcggcatgggcaccgtggagaactggacagatggatag

SEQ ID NO: 172795 - DNA, 1641 bp, Artificial Sequence
  Description of Artificial Sequence: Synthetic coding sequence
atgctgcaggacaagggcctgtctgagagcgaggaggccttccgggcccctggccctgccctgggggaggccagcgctgccaatgcccctgagcccgccctggccgcccctggcctgagcggggccgccctgggcagccccccaggccctggagcagatgtggtggccgctgctgctgctgagcagaccatcgagaacatcaaggtgggcctgcacgagaaggagctgtggaagaagttccatgaagctggaacagagatgatcatcaccaaggccggccgcaggatgttccccagctacaaggtgaaggtgacaggcatgaaccccaagaccaagtacatcctgctgattgatattgtgcctgcagatgaccaccgctacaagttctgtgacaacaagtggatggtggccggcaaggccgagcccgccatgcctggccgcctgtatgtgcacccagacagccctgccactggagcccactggatgaggcagctggtgtccttccagaagctgaagctgaccaacaaccacctggaccccttcggccacatcatcctgaacagcatgcacaagtaccagccccggctgcacatcgtgaaggcagatgaaaataatgccttcggcagcaagaacacagccttctgcacccacgtgtttcctgagaccagcttcatctctgtgaccagctaccagaaccacaagatcacccagctgaagattgagaacaacccctttgccaagggcttccggggcagtgatgacagcgacctgcgggtggcccggctgcagagcaaggagtaccctgtgatcagcaagagcatcatgaggcagaggctcatcagcccccagctgagcgccaccccagatgtgggccccctgctgggcacccaccaggccctgcagcactaccagcatgaaaatggagcccacagccagctggccgagccccaggacctgcccctgagcaccttccccacccagagggacagcagcctcttctaccactgcctgaagagaagagcagatggcaccaggcacctggacctgccctgcaagaggagctacctggaggcccccagctctgtgggggaggaccactacttccgcagccccccaccctatgaccagcagatgctgagccccagctactgcagcgaggtgaccccccgggaggcctgcatgtacagcggcagcggccctgagattgctggggtgtctggagtggatgacctgcccccaccacccctgagctgcaacatgtggacctctgtgagcccctacaccagctacagcgtgcagaccatggagaccgtgccctaccagcccttccccacccacttcaccgccaccaccatgatgccccggctgcccaccctgagcgcccagagcagccagcccccaggaaatgcccacttctctgtgtacaaccagctgagccagagccaggtgcgggagcggggccccagcgccagcttcccccgggagcggggcctgccccagggctgtgagaggaagccacccagcccccacctgaatgctgccaatgagttcctgtacagccagaccttcagcctgagccgggagagcagcctgcagtaccacagcggcatgggcaccgtggagaactggacagatggatag

SEQ ID NO: 172796 - DNA, 1557 bp, Artificial Sequence
  Description of Artificial Sequence: Synthetic coding sequence
atggctgatgctgatgagggcttcggcctggcccacacccccctggagccagatgccaaggacctgccctgtgacagcaagccagagagcgccctgggcgcccccagcaagagccccagcagcccccaggccgccttcacccagcagggcatggagggcatcaaggtgttcctgcacgagcgggagctgtggctgaagttccacgaggtgggcacagagatgatcatcaccaaggccggccgcaggatgttccccagctacaaggtgaaggtgacaggcctgaaccccaagaccaagtacatcctgctgatggacatcgtgcctgcagatgaccaccgctacaagtttgctgacaacaagtggagcgtgacaggcaaggccgagcccgccatgcctggccgcctgtatgtgcacccagacagccctgccaccggggcccactggatgaggcagctggtgtccttccagaagctgaagctgaccaacaaccacctggaccccttcggccacatcatcctgaacagcatgcacaagtaccagccccggctgcacatcgtgaaggcagatgagaacaacggcttcggcagcaagaacacagccttctgcacccacgtgtttcctgagacagccttcatcgctgtgaccagctaccagaaccacaagatcacccagctgaagattgagaacaacccctttgccaagggcttccggggcagtgatgacatggagctgcacaggatgagcaggatgcagagcaaggagtaccctgtggtgcccaggagcacagtgcggcagaaggtggccagcaaccacagccccttcagcagcgagagccgggccctgagcaccagcagcaacctgggcagccagtaccagtgtgaaaatggagtgtctggccccagccaggacctgctgcccccacccaacccctaccccctgccccaggagcacagccagatctaccactgcaccaagaggaaggaggaggagtgcagcaccacagaccacccctacaagaagccctacatggagaccagccccagcgaggaggacagcttctaccgcagcagctacccccagcagcagggcctgggcgccagctacagaacagagagcgcccagaggcaggcctgcatgtatgccagcagcgcccctccttctgagcctgtgcccagcctggaggacatcagctgcaacacctggcccagcatgcccagctacagcagctgcaccgtgaccaccgtgcagcccatggaccggctgccctaccagcacttcagcgcccacttcaccagcggccccctggtgccccggctggccggcatggccaaccacggcagcccccagctgggggagggcatgttccagcaccagacctctgtggcccaccagcctgtggtgcggcagtgtggcccccagacaggcctgcagagccctggcaccctgcagcccccagagttcctgtacagccatggagtgcccaggaccctgagcccccaccagtaccacagcgtgcacggcgtgggcatggtgcctgagtggagcgacaacagctag

SEQ ID NO: 172797 - DNA, 1407 bp, Artificial Sequence
  Description of Artificial Sequence: Synthetic coding sequence
atggagggcatcaaggtgttcctgcacgagcgggagctgtggctgaagttccacgaggtgggcacagagatgatcatcaccaaggccggccgcaggatgttccccagctacaaggtgaaggtgacaggcctgaaccccaagaccaagtacatcctgctgatggacatcgtgcctgcagatgaccaccgctacaagtttgctgacaacaagtggagcgtgacaggcaaggccgagcccgccatgcctggccgcctgtatgtgcacccagacagccctgccaccggggcccactggatgaggcagctggtgtccttccagaagctgaagctgaccaacaaccacctggaccccttcggccacatcatcctgaacagcatgcacaagtaccagccccggctgcacatcgtgaaggcagatgagaacaacggcttcggcagcaagaacacagccttctgcacccacgtgtttcctgagacagccttcatcgctgtgaccagctaccagaaccacaagatcacccagctgaagattgagaacaacccctttgccaagggcttccggggcagtgatgacatggagctgcacaggatgagcaggatgcagagcaaggagtaccctgtggtgcccaggagcacagtgcggcagaaggtggccagcaaccacagccccttcagcagcgagagccgggccctgagcaccagcagcaacctgggcagccagtaccagtgtgaaaatggagtgtctggccccagccaggacctgctgcccccacccaacccctaccccctgccccaggagcacagccagatctaccactgcaccaagaggaaggaggaggagtgcagcaccacagaccacccctacaagaagccctacatggagaccagccccagcgaggaggacagcttctaccgcagcagctacccccagcagcagggcctgggcgccagctacagaacagagagcgcccagaggcaggcctgcatgtatgccagcagcgcccctccttctgagcctgtgcccagcctggaggacatcagctgcaacacctggcccagcatgcccagctacagcagctgcaccgtgaccaccgtgcagcccatggaccggctgccctaccagcacttcagcgcccacttcaccagcggccccctggtgccccggctggccggcatggccaaccacggcagcccccagctgggggagggcatgttccagcaccagacctctgtggcccaccagcctgtggtgcggcagtgtggcccccagacaggcctgcagagccctggcaccctgcagcccccagagttcctgtacagccatggagtgcccaggaccctgagcccccaccagtaccacagcgtgcacggcgtgggcatggtgcctgagtggagcgacaacagctag

SEQ ID NO: 172798 - DNA, 1557 bp, Artificial Sequence; identical to SEQ ID NO: 172796
  Description of Artificial Sequence: Synthetic coding sequence

SEQ ID NO: 172799 - DNA, 1269 bp, Artificial Sequence
  Description of Artificial Sequence: Synthetic coding sequence
atggacatcgtgcctgcagatgaccaccgctacaagtttgctgacaacaagtggagcgtgacaggcaaggccgagcccgccatgcctggccgcctgtatgtgcacccagacagccctgccactggagcccactggatgaggcagctggtgtccttccagaagctgaagctgaccaacaaccacctggaccccttcggccacatcatcctgaacagcatgcacaagtaccagccccggctgcacatcgtgaaggcagatgaaaataatggatttggcagcaagaacacagccttctgcacccacgtgtttcctgagacagccttcatcgctgtgaccagctaccagaaccacaagatcacccagctgaagattgagaacaacccctttgccaagggcttccggggcagtgatgacatggagctgcacaggatgagcaggatgcagagcaaggagtaccctgtggtgcccaggagcacagtgcggcagaaggtggccagcaaccacagccccttcagcagcgagagccgggccctgagcaccagcagcaacctgggcagccagtaccagtgtgaaaatggagtgtctggccccagccaggacctgctgcccccacccaacccctaccccctgccccaggagcacagccagatctaccactgcaccaagaggaaggaggaggagtgcagcaccacagaccacccctacaagaagccctacatggagaccagccccagtgaagaagattccttctaccgcagcagctacccccagcagcagggcctgggcgccagctacagaacagaaagtgcccagaggcaggcctgcatgtatgccagcagcgccccacccagcgagcctgtgcccagcctggaggacatcagctgcaacacctggcccagcatgcccagctacagcagctgcaccgtgaccaccgtgcagcccatggaccggctgccctaccagcacttcagcgcccacttcaccagcggccccctggtgccccggctggccggcatggccaaccacggcagcccccagctgggggagggcatgttccagcaccagacctctgtggcccaccagcctgtggtgcggcagtgtggcccccagacaggcctgctgcacaacagacacttcctggagaaggagcgggagcggggggagcgggagcggcggcgggagaccgtggccaagaggacccccaggacccgcttcttcatcagccccaacgtgcacatctgcacccagggccgctggatgctgatctag

SEQ ID NO: 172800 - DNA, 1050 bp, Artificial Sequence
  Description of Artificial Sequence: Synthetic coding sequence
atggctgatgctgatgagggcttcggcctggcccacacccccctggagccagatgccaaggacctgccctgtgacagcaagccagagagcgccctgggcgcccccagcaagagccccagcagcccccaggccgccttcacccagcagggcatggagggcatcaaggtgttcctgcacgagcgggagctgtggctgaagttccacgaggtgggcacagagatgatcatcaccaaggccggccgcaggatgttccccagctacaaggtgaaggtgacaggcctgaaccccaagaccaagtacatcctgctgatggacatcgtgcctgcagatgaccaccgctacaagtttgctgacaacaagtggagcgtgacaggcaaggccgagcccgccatgcctggccgcctgtatgtgcacccagacagccctgccaccggggcccactggatgaggcagctggtgtccttccagaagctgaagctgaccaacaaccacctggaccccttcggccacatcatcctgaacagcatgcacaagtaccagccccggctgcacatcgtgaaggcagatgagaacaacggcttcggcagcaagaacacagccttctgcacccacgtgtttcctgagacagccttcatcgctgtgaccagctaccagaaccacaagatcacccagctgaagattgagaacaacccctttgccaagggcttccggggcagtgatgacatggagctgcacaggatgagcaggatgcagagcaaggagtaccctgtggtgcccaggagcacagtgcggcagaaggtggccagcaaccacagccccttcagcagcgagagccgggccctgagcaccagcagcaacctgggcagccagtaccagtgtgaaaatggagtgtctggccccagccaggacctgctgcccccacccaacccctaccccctgccccaggagcacagccagatctaccactgcaccaagaggaaaggagaatgtgaccacccctggagcatctgcttcctgagctacctgttcctgagcctgggctggggctag

SEQ ID NO: 172801 - DNA, 1311 bp, Artificial Sequence
  Description of Artificial Sequence: Synthetic coding sequence
atgtaccacccccgggagctgtaccccagcctgggcgccggctaccgcctgggccctgcccagcccggggctgacagcagcttccccccagccctggccgagggctaccgctacccagagctggacacccccaagctggactgcttcctgagcggcatggaggccgcccccaggaccctggccgcccacccccccctgcccctgctgcccccagccatgggcacagagcccgcccccagcgcccctgaggccctgcacagcctgcccggggtgtccctgagcctggagaaccgggagctgtggaaggagttcagctctgtgggcacagagatgatcatcaccaaggccggccgcaggatgtttcctgcctgccgggtgtctgtgacaggcctggaccctgaggcccgctacctgttcctgctggatgtgattcctgtggatggagcccgctaccgctggcagggccgccgctgggagcccagcggcaaggccgagccccggctgcctgacagagtgtacatccacccagacagccctgccactggagcccactggatgaggcagcctgtgtccttccaccgggtgaagctgaccaacagcaccctggacccccacggccacctgatcctgcacagcatgcacaagtaccagccccgcatccacctggtgcgggccgcccagctgtgcagccagcactggggcggcatggccagcttccgcttccctgagaccaccttcatctctgtgacagcctaccagaacccccagatcacccagctgaagattgctgccaacccctttgccaagggcttcagagaaaatggaagaaactgcaagcgggagagagatgcccgggtgaagaggaagctgcggggccctgagcctgctgccacagaggcctacggcagcggggacaccccaggcggcccctgtgacagcaccctgggcggggacatccgggagagtgaccctgagcaggccccagcccctggagaggccacagctgccccagcccccctgtgtggcggccccagcgctgaggcctacctgctgcaccctgctgccttccatggagcccccagccacctgcccaccaggagccccagcttccctgaggccccagacagcggccgcagcgccccctacagcgctgccttcctggagctgccccacggcagcggcggcagcggctacccagctgcccccccagctgtgccctttgccccccacttcctgcagggcggccccttccccctgccctacacagcccctgggggctacctggatgtgggcagcaagcccatgtactag

SEQ ID NO: 172802 - DNA, 1311 bp, Artificial Sequence; identical to SEQ ID NO: 172801
  Description of Artificial Sequence: Synthetic coding sequence

SEQ ID NO: 172803 - DNA, 888 bp, Artificial Sequence
  Description of Artificial Sequence: Synthetic coding sequence
atgtaccacccccgggagctgtaccccagcctgggcgccggctaccgcctgggccctgcccagcccggggctgacagcagcttccccccagccctggccgagggctaccgctacccagagctggacacccccaagctggactgcttcctgagcggcatggaggccgcccccaggaccctggccgcccacccccccctgcccctgctgcccccagccatgggcacagagcccgcccccagcgcccctgaggccctgcacagcctgcccggggtgtccctgagcctggagaaccgggagctgtggaaggagttcagctctgtgggcacagagatgatcatcaccaaggccggccgcaggatgtttcctgcctgccgggtgtctgtgacaggcctggaccctgaggcccgctacctgttcctgctggatgtgattcctgtggatggagcccgctaccgctggcagggccgccgctgggagcccagcggcaaggccgagccccggctgcctgacagagtgtacatccacccagacagccctgccactggagcccactggatgaggcagcctgtgtccttccaccgggtgaagctgaccaacagcaccctggacccccacggccacctgatcctgcacagcatgcacaagtaccagccccgcatccacctggtgcgggccgcccagctgtgcagccagcactggggcggcatggccagcttccgcttccctgagaccaccttcatctctgtgacagcctaccagaacccccagatcacccagctgaagattgctgccaacccctttgccaagggcttcagagaaaatggaagaaactgcaagcgctgggagctgttcatccacctgttcatgcacagcaccaacgtgtactag

SEQ ID NO: 172804 - DNA, 1974 bp, Artificial Sequence
  Description of Artificial Sequence: Synthetic coding sequence
atggagatggagaccacagagcctgagccagactgtgtggtgcagccccccagccccccagatgacttcagctgccagatgaggctgtctgagaagatcacccccctgaagacctgcttcaagaagaaggaccagaagaggctgggcaccggcaccctgcggagcctgcggcccatcctgaacaccctgctggagagcggcagcctggatggagtcttccgcagcaggaaccagagcacagatgagaacagcctgcacgagcccatgatgaagaaggccatggagatcaacagcagctgccccccagctgagaacaacatgtctgtgctgatcccagacaggaccaacgtgggggaccagatccctgaggcccaccccagcacagaggcccctgagcgggtggtgcccatccaggaccacagcttccccagcgagaccctgagcggcaccgtggccgacagcaccccagcccacttccagacagacctgctgcaccctgtgtccagtgatgtgcccaccagcccagactgcctggacaaggtgattgattatgtgcccggcatcttccaggagaacagcttcaccatccagtacatcctggacaccagtgacaagctgagcacagagctgttccaggacaagtctgaggaggccagcctggacctggtgtttgagctggtgaaccagctgcagtaccacacccaccaggagaatggcatcgagatctgcatggacttcctgcagggcacctgcatctacggccgggactgcctgaagcaccacacagtgctgccctaccactggcagatcaagaggaccaccacccagaagtggcagagcgtcttcaatgacagccaggagcacctggagcgcttctactgcaacccagaaaatgacaggatgaggatgaagtatggaggccaggagttctgggccgacctgaatgccatgaatgtgtatgagaccacagaatttgaccagctgcggcggctgagcaccccacccagcagcaatgtgaacagcatctaccacacagtgtggaagttcttctgccgggaccacttcggctggagggagtacccagagagcgtcatccgcctcatcgaggaggccaacagccggggcctgaaggaggtgcgcttcatgatgtggaacaaccactacatcctgcacaacagcttcttccggcgggagatcaagagaagacccctcttccgcagctgcttcatcctgctgccctacctgcagaccctgggcggcgtgcccacccaggcccccccacccctggaggccaccagcagcagccagatcatctgcccagatggagtgaccagcgccaacttctacccagagacctgggtgtacatgcaccccagccaggacttcatccaggtgcctgtgtctgctgaggacaagagctaccgcatcatctacaacctcttccacaagacagtgcctgagttcaagtaccgcatcctgcagatcctgcgggtgcagaaccagttcctgtgggagaagtacaagaggaagaaggagtacatgaacaggaagatgtttggccgggaccgcatcatcaatgaaagacacctgttccacggcaccagccaggatgtggtggatggcatctgcaagcacaactttgacccccgggtgtgtgggaagcacgccaccatgtttggccagggcagctactttgccaagaaggccagctacagccacaacttcagcaagaagagcagcaaaggagtgcacttcatgttcctggccaaggtgctgaccggccgctacaccatgggcagccacggcatgaggcggcccccacctgtgaaccctggctctgtgaccagtgacctgtatgacagctgtgtggacaacttctttgagccccagatcttcgtcatcttcaatgatgaccagagctacccctacttcgtcatccagtatgaggaggtgagcaacacagtgtccatctag

SEQ ID NO: 172805 - DNA, 1974 bp, Artificial Sequence; identical to SEQ ID NO: 172804
  Description of Artificial Sequence: Synthetic coding sequence

SEQ ID NO: 172806 - DNA, 1521 bp, Artificial Sequence
  Description of Artificial Sequence: Synthetic coding sequence
atggagatggagaccacagagcctgagccagactgtgtggtgcagccccccagccccccagatgacttcagctgccagatgaggctgtctgagaagatcacccccctgaagacctgcttcaagaagaaggaccagaagaggctgggcaccggcaccctgcggagcctgcggcccatcctgaacaccctgctggagagcggcagcctggatggagtcttccgcagcaggaaccagagcacagatgagaacagcctgcacgagcccatgatgaagaaggccatggagatcaacagcagctgccccccagctgagaacaacatgtctgtgctgatcccagacaggaccaacgtgggggaccagatccctgaggcccaccccagcacagaggcccctgagcgggtggtgcccatccaggaccacagcttccccagcgagaccctgagcggcaccgtggccgacagcaccccagcccacttccagacagacctgctgcaccctgtgtccagtgatgtgcccaccagcccagactgcctggacaaggtgattgattatgtgcccggcatcttccaggagaacagcttcaccatccagtacatcctggacaccagtgacaagctgagcacagagctgttccaggacaagtctgaggaggccagcctggacctggtgtttgagctggtgaaccagctgcagtaccacacccaccaggagaatggcatcgagatctgcatggacttcctgcagggcacctgcatctacggccgggactgcctgaagcaccacacagtgctgccctaccactggcagatcaagaggaccaccacccagaagtggcagagcgtcttcaatgacagccaggagcacctggagcgcttctactgcaacccagaaaatgacaggatgaggatgaagtatggaggccaggagttctgggccgacctgaatgccatgaatgtgtatgagaccacagaatttgaccagctgcggcggctgagcaccccacccagcagcaatgtgaacagcatctaccacacagtgtggaagttcttctgccgggaccacttcggctggagggagtacccagagagcgtcatccgcctcatcgaggaggccaacagccggggcctgaaggaggtgcgcttcatgatgtggaacaaccactacatcctgcacaacagcttcttccggcgggagatcaagagaagacccctcttccgcagctgcttcatcctgctgccctacctgcagaccctgggcggcgtgcccacccaggcccccccacccctggaggccaccagcagcagccagatcatctgcccagatggagtgaccagcgccaacttctacccagagacctgggtgtacatgcaccccagccaggacttcatccaggtgcctgtgtctgctgaggacaagagctaccgcatcatctacaacctcttccacaagacagtgcctgagttcaagtaccgcatcctgcagatcctgcgggtgcagaaccagttcctgtgggagaagtag

SEQ ID NO: 172807 - DNA, 1965 bp, Artificial Sequence
  Description of Artificial Sequence: Synthetic coding sequence
atggagatggagaccacagagcctgagccagactgtgtggtgcagccccccagccccccagatgacttcagctgccagatgaggctgtctgagaagatcacccccctgaagacctgcttcaagaagaaggaccagaagaggctgggcaccggcaccctgcggagcctgcggcccatcctgaacaccctgctggagagcggcagcctggatggagtcttccgcagcaggaaccagagcacagatgagaacagcctgcacgagcccatgatgaagaaggccatggagatcaacagcagctgccccccagctgagaacaacatgtctgtgctgatcccagacaggaccaacgtgggggaccagatccctgaggcccaccccagcacagaggcccctgagcgggtggtgcccatccaggaccacagcttccccagcgagaccctgagcggcaccgtggccgacagcaccccagcccacttccagacagacctgctgcaccctgtgtccagtgatgtgcccaccagcccagactgcctggacaaggtgattgattatgtgcccggcatcttccaggagaacagcttcaccatccagtacatcctggacaccagtgacaagctgagcacagagctgttccaggacaagtctgaggaggccagcctggacctggtgtttgagctggtgaaccagctgcagtaccacacccaccaggagaatggcatcgagatctgcatggacttcctgcagggcacctgcatctacggccgggactgcctgaagcaccacacagtgctgccctaccactggcagatcaagaggaccaccacccagaagtggcagagcgtcttcaatgacagccaggagcacctggagcgcttctactgcaacccagaaaatgacaggatgaggatgaagtatggaggccaggagttctgggccgacctgaatgccatgaatgtgtatgagaccacagaatttgaccagctgcggcggctgagcaccccacccagcagcaatgtgaacagcatctaccacacagtgtggaagttcttctgccgggaccacttcggctggagggagtacccagagagcgtcatccgcctcatcgaggaggccaacagccggggcctgaaggaggtgcgcttcatgatgtggaacaaccactacatcctgcacaacagcttcttccggcgggagatcaagagaagacccctcttccgcagctgcttcatcctgctgccctacctgcagaccctgggcggcgtgcccacccaggcccccccacccctggaggccaccagcagcagccagatcatctgcccagatggagtgaccagcgccaacttctacccagagacctgggtgtacatgcaccccagccaggacttcatccaggtgcctgtgtctgctgaggacaagagctaccgcatcatctacaacctcttccacaagacagtgcctgagttcaagtaccgcatcctgcagatcctgcgggtgcagaaccagttcctgtgggagaagtacaagaggaagaaggagtacatgaacaggaagatgtttggccgggaccgcatcatcaatgaaagacacctgttccacggcaccagccaggatgtggtggatggcatctgcaagcacaactttgacccccgggtgtgtgggaagcacgccaccatgtttggccagggcagctactttgccaagaaggccagctacagccacaacttcagcaagaagagcagcaaaggagtgcacttcatgttcctggccaaggtgctgaccggccgctacaccatgggcagccacggcatgaggcggcccccacctgtgaaccctggctctgtgaccagtgacctgtatgacagctgtgtggacaacttctttgagccccagatcttcgtcatcttcaatgatgaccagagctacccctacttcgtcatccagtatgaggaggtgagcaacacctag

SEQ ID NO: 172808 - DNA, 1974 bp, Artificial Sequence; identical to SEQ ID NO: 172804
  Description of Artificial Sequence: Synthetic coding sequence

SEQ ID NO: 172809 - DNA, 1974 bp, Artificial Sequence; identical to SEQ ID NO: 172804
  Description of Artificial Sequence: Synthetic coding sequence

SEQ ID NO: 172810 - DNA, 1662 bp, Artificial Sequence
  Description of Artificial Sequence: Synthetic coding sequence
atgggcgccctggagatgcaggatgaggaggacagaattgaggccctgaagcaggtggccgacaagctgccccggcccaacctgctgctgctgaagcacctggtgtatgtgctgcacctgatcagcaagaacagcgaggtgaacaggatggacagcagcaacctggccatctgcatcggccccaacatgctgaccctggagaatgaccagagcctgagctttgaggcccagaaggacctgaacaacaaggtgaagaccctggtggagttcctgattgacaactgctttgagatctttggagagaacatccctgtgcacagcagcatcaccagtgatgacagcctggagcacacagacagcagtgatgtgtccaccctgcagaatgacagcgcctatgacagcaatgaccctgatgtggagagcaacagcagcagcggcatcagcagccccagccggcagccccaggtgcccatggccacagctgctggcctggacagcgctggcccccaggatgcccgggaggtgtccccagagcccatcgtgtccacagtggcccggctgaagagcagcctggcccagcctgaccggcgctacagcgagcccagcatgcccagcagccaggagtgcctggagagccgggtgaccaaccagaccctgaccaagtctgagggggacttccctgtgccccgggtgggcagccggctggagagcgaggaggccgaggaccccttccctgaggaggtgtttcctgctgtgcagggcaagaccaagaggcctgtggacctgaagatcaagaacctggcccctggctctgtgctgccccgggccctggtgctgaaggccttcagcagcagcagcctggatgccagcagtgacagcagccctgtggccagccccagcagccccaagaggaacttcttcagccgccaccagagcttcaccaccaagacagagaagggcaagcccagccgggagatcaagaagcacagcatgtccttcacctttgccccccacaagaaggtgctgaccaagaacctgtctgctggcagcggcaagagccaggacttcacccgggaccacgtgccccggggcgtgaggaaggagagccagctggccggcagaattgtgcaggagaatggctgtgagacccacaaccagacagcccggggcttctgcctgcggccccacgccctgtctgtggatgatgtgttccagggcgctgactgggagcggcccggcagccccccatcctatgaggaggccatgcagggccctgctgcccggctggtggccagcgagagccagacagtgggctccatgacagtgggctccatgagggccaggatgctggaggcccactgcctgctgccccccctgcccccagcccaccacgtggaggacagccgccaccggggcagcaaggagcccctgcccggccacggcctgagccccctgcctgagcgctggaagcagagcaggacagtgcacgccagcggggacagcctgggccacgtgtctggccctggccggcctgagctgctgcccctgaggacagtgtctgagagcgtgcagaggaacaagagggactgcctggtgcggcgctgcagccagcctgtgtttgaggccgaccagttccagtatgccaaggagagctacatctag

SEQ ID NO: 172811 - DNA, 801 bp, Artificial Sequence
  Description of Artificial Sequence: Synthetic coding sequence
atgaagctgcggagcagccacaatgccagcaagaccctgaatgccaacaacatggagaccctgattgagtgccagagcgagggggacatcaaggagcaccccctgctggccagctgtgagagcgaggacagcatctgccagctgattgaggtgaagaagaggaagaaggtgctgtcctggcccttcctgatgaggcggctgagccctgccagtgacttcagcggggccctggagacagacctgaaggccagcctgtttgaccagcccctgagcatcatctgtggggacagcgacaccctgccccggcccatccaggacatcctgaccatcctgtgcctgaagggccccagcacagagggcatcttcagaagagctgccaatgagaaggccaggaaggagctgaaggaggagctgaacagcggagatgctgtggacctggagcggctgcctgtgcacctgctggccgtggtgttcaaggacttcctgcggagcatccccaggaagctgctgagcagtgacctgtttgaggagtggatgggcgccctggagatgcaggatgaggaggacagaattgaggccctgaagcaggtggccgacaagctgccccggcccaacctgctgctgctgaagcacctggtgtatgtgctgcacctgatcagcaagaacagcgaggtgaacaggatggacagcagcaacctggccatctgcatcggccccaacatgctgaccctggagaatgaccagagcctgagctttgaggcccagaaggacctgaacaacaaggtgtgcagcgcctactag

SEQ ID NO: 172812 - DNA, 2196 bp, Artificial Sequence
  Description of Artificial Sequence: Synthetic coding sequence
atgaagctgcggagcagccacaatgccagcaagaccctgaatgccaacaacatggagaccctgattgagtgccagagcgagggggacatcaaggagcaccccctgctggccagctgtgagagcgaggacagcatctgccagctgattgaggtgaagaagaggaagaaggtgctgtcctggcccttcctgatgaggcggctgagccctgccagtgacttcagcggggccctggagacagacctgaaggccagcctgtttgaccagcccctgagcatcatctgtggggacagcgacaccctgccccggcccatccaggacatcctgaccatcctgtgcctgaagggccccagcacagagggcatcttcagaagagctgccaatgagaaggccaggaaggagctgaaggaggagctgaacagcggagatgctgtggacctggagcggctgcctgtgcacctgctggccgtggtgttcaaggacttcctgcggagcatccccaggaagctgctgagcagtgacctgtttgaggagtggatgggcgccctggagatgcaggatgaggaggacagaattgaggccctgaagcaggtggccgacaagctgccccggcccaacctgctgctgctgaagcacctggtgtatgtgctgcacctgatcagcaagaacagcgaggtgaacaggatggacagcagcaacctggccatctgcatcggccccaacatgctgaccctggagaatgaccagagcctgagctttgaggcccagaaggacctgaacaacaaggtgaagaccctggtggagttcctgattgacaactgctttgagatctttggagagaacatccctgtgcacagcagcatcaccagtgatgacagcctggagcacacagacagcagtgatgtgtccaccctgcagaatgacagcgcctatgacagcaatgaccctgatgtggagagcaacagcagcagcggcatcagcagccccagccggcagccccaggtgcccatggccacagctgctggcctggacagcgctggcccccaggatgcccgggaggtgtccccagagcccatcgtgtccacagtggcccggctgaagagcagcctggcccagcctgaccggcgctacagcgagcccagcatgcccagcagccaggagtgcctggagagccgggtgaccaaccagaccctgaccaagtctgagggggacttccctgtgccccgggtgggcagccggctggagagcgaggaggccgaggaccccttccctgaggaggtgtttcctgctgtgcagggcaagaccaagaggcctgtggacctgaagatcaagaacctggcccctggctctgtgctgccccgggccctggtgctgaaggccttcagcagcagcagcctggatgccagcagtgacagcagccctgtggccagccccagcagccccaagaggaacttcttcagccgccaccagagcttcaccaccaagacagagaagggcaagcccagccgggagatcaagaagcacagcatgtccttcacctttgccccccacaagaaggtgctgaccaagaacctgtctgctggcagcggcaagagccaggacttcacccgggaccacgtgccccggggcgtgaggaaggagagccagctggccggcagaattgtgcaggagaatggctgtgagacccacaaccagacagcccggggcttctgcctgcggccccacgccctgtctgtggatgatgtgttccagggcgctgactgggagcggcccggcagccccccatcctatgaggaggccatgcagggccctgctgcccggctggtggccagcgagagccagacagtgggctccatgacagtgggctccatgagggccaggatgctggaggcccactgcctgctgccccccctgcccccagcccaccacgtggaggacagccgccaccggggcagcaaggagcccctgcccggccacggcctgagccccctgcctgagcgctggaagcagagcaggacagtgcacgccagcggggacagcctgggccacgtgtctggccctggccggcctgagctgctgcccctgaggacagtgtctgagagcgtgcagaggaacaagagggactgcctggtgcggcgctgcagccagcctgtgtttgaggccgaccagttccagtatgccaaggagagctacatctag

SEQ ID NO: 172813 - DNA, 828 bp, Artificial Sequence
  Description of Artificial Sequence: Synthetic coding sequence
atggccacagctgctggcctggacagcgctggcccccaggatgcccgggaggtgtccccagagcccatcgtgtccacagtggcccggctgaagagcagcctggcccagcctgaccggcgctacagcgagcccagcatgcccagcagccaggagtgcctggagagccgggtgaccaaccagaccctgaccaagtctgagggggacttccctgtgccccgggtgggcagccggctggagagcgaggaggccgaggaccccttccctgaggaggtgtttcctgctgtgcagggcaagaccaagaggcctgtggacctgaagatcaagaacctggcccctggctctgtgctgccccgggccctggtgctgaaggccttcagcagcagcagcctggatgccagcagtgacagcagccctgtggccagccccagcagccccaagaggaacttcttcagccgccaccagagcttcaccaccaagacagagaagggcaagcccagccgggagatcaagaagcacagcatgtccttcacctttgccccccacaagaaggtgctgaccaagaacctgtctgctggcagcggcaagagccaggacttcacccgggaccacgtgccccggggcgtgaggaaggagagccagctggccggccgcatcgtgcaggagaatggctgtgagacccacaaccagacagcccggggcttctgcctgcggccccacgccctgtctgtggatgatgtgttccagggcgctgactgggagaggcctggcagcccccccagctatgaggaggccatgcagggccctgctgcccggccctggggcgcctag

SEQ ID NO: 172814 - DNA, 327 bp, Artificial Sequence
  Description of Artificial Sequence: Synthetic coding sequence
atgaccaggaagatcttcaccaacacccgggagcgctggaggcagcagaatgtgaacagcgcctttgccaagctgaggaagctgatccccacccaccccccagacaagaagctgagcaagaatgagaccctgcggctggccatgagatacatcaacttcctggtgaaggtgctgggggagcagagcctgcagcagacaggagtggccgcccagggcaacatcctgggcctcttcccccagggcccccacctgcccggcctggaggacaggaccctgctggagaactaccaggtgcccagccctggccccagccaccacatcccctag

SEQ ID NO: 172815 - DNA, 780 bp, Artificial Sequence
  Description of Artificial Sequence: Synthetic coding sequence
atggccagcccccagggcggccagatcgccatcgccatgaggctgaggaaccagctgcagagcgtgtacaagatggaccccctgagaaatgaggaggaggtgcgggtgaagatcaaggacctgaatgagcacatcgtgtgctgcctgtgtgccggctactttgtggatgccaccaccatcacagagtgcctgcacaccttctgcaagagctgcatcgtgaagtacctgcagaccagcaagtactgccccatgtgcaacatcaagatccacgagacccagcccctgctgaacctgaagctggacagagtgatgcaggacatcgtgtacaagctggtgcccggcctgcaggacagcgaggagaagaggatccgggagttctaccagagccggggcctggacagagtgacccagcccactggagaggagcccgccctgagcaacctgggcctgcccttcagcagctttgaccacagcaaggcccactactaccgctatgatgagcagctgaacctgtgcctggagcggctgagcagcggcaaggacaagaacaagtctgtgctgcagaacaagtatgtgcgctgcagcgtgcgggcagaggtgcgccacctgcggcgggtgctgtgccaccggctgatgctgaacccccagcacgtgcagctgctgtttgacaatgaggtgctgcctgaccacatgaccatgaagcagatctggctgagccgctggtttgggaagcccagccccctgctgctgcagtacagcgtgaaggagaagagaagatag

SEQ ID NO: 172816 - DNA, 876 bp, Artificial Sequence
  Description of Artificial Sequence: Synthetic coding sequence
atggaggccccagccagcgcccagaccccccacccccatgagcccatcagctttggcatcgaccagatcctgaacagcccagaccaggacagcgccccagccccccggggcccagatggagccagctacctgggcggccccccaggcggccggcctggggccacctaccccagcctgcctgccagctttgctggcctgggcgccccctttgaagatgctggcagctacagcgtgaacctgagcctggccccagctggggtcatccgggtgcctgcccaccggcccctgcctggagctgtgcccccacccctgcccagcgccctgcctgccatgcccagcgtgcccaccgtgagcagcctgggcggcctgaacttcccctggatggagagcagccgccgctttgtgaaggaccgcttcaccgctgctgctgccctgacccccttcaccgtgacccggcgcatcggccacccctaccagaacagaacaccacccaagaggaagaagcccaggaccagcttcagccgggtgcagatctgtgagctggagaagcgcttccaccggcagaagtacctggccagcgctgagagagctgccctggccaagagcctgaagatgacagatgcccaggtgaagacctggttccagaacagaaggaccaagtggaggcggcagacagctgaggagcgggaggccgagcggcagcaggccagccggctgatgctgcagctgcagcatgatgccttccagaagagcctgaatgacagcatccagcctgaccccctgtgcctgcacaacagcagcctgtttgccctgcagaacctgcagccctgggaggaggacagcagcaaggtgcctgctgtgaccagcctggtgtag

SEQ ID NO: 172817 - DNA, 312 bp, Artificial Sequence
  Description of Artificial Sequence: Synthetic coding sequence
atggccgagagctggagcggccaggccctgcaggccctgcctgccaccgtgctgggcgccctgggcagcgagttcctgcgggagtgggaggcccaggacatgagggtgaccctcttcaagctgctgctgctgtggctggtgctgagcctgctgggcatccagctggcctggggcttctacggcaacacagtgacaggcctgtaccacaggcctggcctgggcggccagaatggcagcaccccagatggcagcacccacttccccagctgggagatggccgccaatgagcccctgaagacccaccgggagtag

SEQ ID NO: 172818 - DNA, 387 bp, Artificial Sequence
  Description of Artificial Sequence: Synthetic coding sequence
atggccagcgaggcctctgtgcggctgggcgtgcccccaggccgcctgtggatccagaggcctggcatctatgaagatgaggagggccgcacctgggtgacagtggtggtgcgcttcaaccccagcagaagagagtgggcccgggccagccagggcagccgctatgagcccagcatcaccgtgcacctgtggcagatggctgtgcacacccgggagctgctgagcagcggccagatgcccttcagccagctgcctgctgtgtggcagctgtacccaggcaggaagtacagagctgctgacagcagcttctgggagattgctgaccacggccagattgacagcatggagcagctggtgctgacctaccagcctgagaggaaggactag

SEQ ID NO: 172819 - DNA, 387 bp, Artificial Sequence; identical to SEQ ID NO: 172818
  Description of Artificial Sequence: Synthetic coding sequence

SEQ ID NO: 172820 - DNA, 4776 bp, Artificial Sequence
  Description of Artificial Sequence: Synthetic coding sequence
atgggaaatgctgagagccagcacgtggagcacgagttctacggggagaagcacgccagcctgggcaggaagcacaccagccgcagcctgcggctgagccacaagaccaggaggaccaggcatgccagcagcggcaaggtgatccacaggaacagcgaggtgtccaccaggagcagcagcacccccagcatcccccagagcctggccgagaatggcctggagcccttcagccaggacggcaccctggaggactttggcagccccatctgggtggacagagtggacatgggcctgcggcctgtgtcctacacagacagctctgtgaccccatctgtggacagcagcatcgtgctgacagctgcctctgtgcagagcatgccagacacagaggagagccggctgtatggagatgatgccacctacctggccgagggcggccggcggcagcacagctacaccagcaatggccccaccttcatggagacagccagcttcaagaagaagaggagcaagtctgctgacatctggagggaggacagcctggagttcagcctgagtgacctgagccaggagcacctgaccagcaatgaggagatcctgggcagcgctgaggagaaggactgtgaggaggcccggggcatggagacccgggccagcccccggcagctgagcacctgccagagggccaacagcctgggggacctgtatgcccagaagaacagcggcgtgacagccaacggcggccctggcagcaagtttgctggctactgcaggaacctggtgtctgacatccccaacctggccaaccacaagatgcctcctgctgctgctgaggagaccccaccctacagcaactacaacaccctgccctgcaggaagagccactgcctgtctgagggcgccaccaacccccagatcagccacagcaacagcatgcagggcagaagagccaagaccacccaggatgtgaatgctggggagggcagcgagtttgctgacagcggcatcgagggcgccaccacagacacagacctgctgagccgccgcagcaatgccaccaacagcagctacagccccaccaccggccgggcctttgtgggcagtgacagcggcagcagcagcactggagatgctgcccggcagggcgtgtatgagaacttccggcgggagctggagatgagcaccaccaacagcgagagcctggaggaggccggcagcgcccacagtgatgagcagagcagcggcaccctgagcagccctggccagagcgacatcctgctgacagctgcccagggcaccgtgaggaaggccggggccctggccgtgaagaacttcctggtgcacaagaagaacaagaaggtggagagcgccaccaggaggaagtggaagcactactgggtgtccctgaagggctgcaccctcttcttctatgaaagtgatggccgctctggaattgaccacaacagcatccccaagcatgctgtgtgggtggagaacagcatcgtgcaggccgtgcctgagcaccccaagaaggactttgtgttctgcctgagcaacagcctgggagatgccttcctgttccagaccaccagccagacagagctggagaactggatcacagccatccacagcgcctgtgccacagctgtggcccggcaccaccacaaggaggacaccctgcggctgctgaagtctgagatcaagaagctggagcagaagattgacatggatgagaagatgaagaagatgggagagatgcagctgagctctgtgacagacagcaagaagaagaagaccatcctggaccagatctttgtgtgggagcagaacctggagcagttccagatggacctcttccgcttccgctgctacctggccagcctgcagggcggggagctgcccaaccccaagaggctgctggcctttgccagccggcccaccaaggtggccatgggccgcctgggcatcttctctgtgtcctccttccacgccctggtggccgccaggactggagaaacaggagtgagaagaaggacccaggccatgagccgcagcgccagcaagagaagaagccgcttcagcagcctgtggggcctggacaccaccagcaagaagaagcagggccggcccagcatcaaccaggtgtttggagagggcacagaggccgtgaagaagagcctggagggcatctttgatgacatcgtgcctgatggcaagcgggagaaggaggtggtgctgcccaacgtgcaccagcacaacccagactgtgacatctgggtgcatgagtacttcacccccagctggttctgcctgcccaacaaccagcctgccctgactgtggtgcggcctggggacacagcccgggacaccctggagctgatctgcaagacccaccagctggaccacagcgcccactacctgcggctgaagttcctgattgagaacaagatgcagctgtatgtgccccagcctgaggaggacatctatgagctgctgtacaaggagattgagatctgccccaaggtgacccagagcatccacatcgagaagagtgacacagctgctgacacctacggcttcagcctgagctctgtggaggaggatggcatccggcggctgtatgtgaacagcgtgaaggagaccggcctggccagcaagaagggcctgaaggctggagatgagatcctggagatcaacaacagagctgctgatgccctgaacagctccatgctgaaggacttcctgagccagcccagcctgggcctgctggtgaggacctacccagagctggaggagggcgtggagctgctggagagccccccccaccgggtggatggccctgctgacctgggggagagccccctggccttcctgaccagcaaccctggccacagcctgtgcagcgagcagggcagcagcgctgagacagcccctgaggagacagagggccctgacctggagagcagtgatgaaacagaccacagcagcaagagcacagagcaggtggccgccttctgccgcagcctgcacgagatgaaccccagcgaccagagccccagcccccaggacagcacaggcccccagctggccaccatgaggcagctgagtgatgctgacaagctgaggaaggtgatctgtgagctgctggagacagagaggacctacgtgaaggacctgaactgcctgatggagcgctacctgaagcccctgcagaaggagaccttcctgacccaggatgagctggatgtgctgtttggaaacctgacagagatggtggagttccaggtggagttcctgaagaccctggaggatggagtgcggctggtgcctgacctggagaagctggagaaggtggaccagttcaagaaggtgctcttcagcctgggcggcagcttcctgtactatgctgaccgcttcaagctgtacagcgccttctgtgccagccacaccaaggtgcccaaggtgctggtgaaggccaagacagacacagccttcaaggccttcctggatgcccagaaccccaagcagcagcacagcagcaccctggagagctacctgatcaagcccatccagaggatcctgaagtaccccctgctgctgcgggagctgtttgccctgacagatgctgagagcgaggagcactaccacctggatgtggccatcaagaccatgaacaaggtggccagccacatcaatgagatgcagaagatccacgaggagtttggagctgtgtttgaccagctgattgctgagcagacaggagagaagaaggaggtggccgacctgtccatgggagacctgctgctgcacaccaccgtcatctggctgaaccccccagccagcctgggcaagtggaagaaggagcctgagctggccgcctttgtgttcaagacagctgtggtgctggtgtacaaggatggcagcaagcagaagaagaagctggtgggcagccaccggctgagcatctatgaggactgggaccccttccgcttccgccacatgatccccacagaggccctgcaggtgcgggccctggccagcgcagatgctgaggccaatgctgtgtgtgagatcgtgcacgtgaagtctgagagcgagggccggcctgagagggtcttccacctgtgctgcagcagccctgagagcaggaaggacttcctgaaggctgtgcacagcatcctgcgggacaagcaccggcggcagctgctgaagacagagagcctgcccagcagccagcagtatgtgccctttggaggcaagaggctgtgtgccctgaagggggcccggcctgccatgagcagagctgtgtctgcccccagcaagagcctgggcagaagaagaagaaggctggccaggaaccgcttcaccatcgacagtgatgctgtgtctgccagcagccctgagaaggagagccagcagcccccaggcggcggggacacagaccgctgggtggaggagcagtttgacctggcccagtatgaggagcaggatgacatcaaggagacagacatcctgagtgatgatgatgagttctgtgagagcgtgaagggggcctctgtggaccgggacctgcaggagcggctgcaggccaccagcatcagccagcgggagcggggcaggaagaccctggacagccacgccagcaggatggcccagctgaagaagcaggccgccctgagcggcatcaatggaggcctggagagcgccagcgaggaggtgatctgggtgagaagagaagattttgcccccagcaggaagctgaacacagagatctag

SEQ ID NO: 172821 - DNA, 3216 bp, Artificial Sequence
  Description of Artificial Sequence: Synthetic coding sequence
atggagacagccagcttcaagaagaagaggagcaagtctgctgacatctggagggaggacagcctggagttcagcctgagtgacctgagccaggagcacctgaccagcaatgaggagatcctgggcagcgctgaggagaaggactgtgaggaggcccggggcatggagacccgggccagcccccggcagctgagcacctgccagagggccaacagcctgggggacctgtatgcccagaagaacagcggcgtgacagccaatggaggccctggcagcaagtttgctggctactgcaggaacctggtgtctgacatccccaacctggccaaccacaagatgcccccagctgctgctgaggagaccccaccctacagcaactacaacaccctgccctgcaggaagagccactgcctgtctgagggcgccaccaacccccagatcagccacagcaacagcatgcagggccggcgggccaagaccacccaggatgtgaatgctggggagggcagcgagtttgctgacagcggcattgaaggagccaccacagacacagacctgctgagcagaagaagcaatgccaccaacagcagctacagccccaccaccggccgggcctttgtgggcagtgacagcggcagcagcagcactggagatgctgcccggcagggcgtgtatgagaacttcagaagagagctggagatgagcaccaccaacagcgagagcctggaggaggccggcagcgcccacagtgatgagcagagcagcggcaccctgagcagccctggccagagcgacatcctgctgacagctgcccagggcaccgtgaggaaggccggggccctggccgtgaagaacttcctggtgcacaagaagaacaagaaggtggagagcgccaccaggaggaagtggaagcactactgggtgtccctgaagggctgcaccctcttcttctatgaaagtgatggccgcagcggcatcgaccacaacagcatccccaagcatgctgtgtgggtggagaacagcatcgtgcaggccgtgcctgagcaccccaagaaggactttgtgttctgcctgagcaacagcctgggagatgccttcctgttccagaccaccagccagacagagctggagaactggatcacagccatccacagcgcctgtgccacagctgtggcccggcaccaccacaaggaggacaccctgcggctgctgaagtctgagatcaagaagctggagcagaagattgacatggatgagaagatgaagaagatgggagagatgcagctgagctctgtgacagacagcaagaagaagaagaccatcctggaccagatctttgtgtgggagcagaacctggagcagttccagatggacctcttccgcttccgctgctacctggccagcctgcagggcggggagctgcccaaccccaagaggctgctggcctttgccagccggcccaccaaggtggccatgggccgcctgggcatcttctctgtgagcagcttccacgccctggtggccgccaggactggagagaccggggtgagaagaaggacccaggccatgagccgcagcgccagcaagaggaggagccgcttcagcagcctgtggggcctggacaccaccagcaagaagaagcagggccggcccagcatcaaccaggtgtttggagagggcacagaagctgtgaagaagagcctggagggcatctttgatgacatcgtgcctgatggcaagcgggagaaggaggtggtgctgcccaacgtgcaccagcacaacccagactgtgacatctgggtgcatgagtacttcacccccagctggttctgcctgcccaacaaccagcctgccctgactgtggtgcggcctggggacacagcccgggacaccctggagctgatctgcaagacccaccagctggaccacagcgcccactacctgcggctgaagttcctgattgagaacaagatgcagctgtatgtgccccagcctgaggaggacatctatgagctgctgtacaaggagattgagatctgccccaaggtgacccagagcatccacatcgagaagagtgacacagctgctgacacctacggcttcagcctgagctctgtggaggaggatggcatccggcggctgtatgtgaacagcgtgaaggagaccggcctggccagcaagaagggcctgaaggctggagatgagatcctggagatcaacaacagagctgctgatgccctgaacagctccatgctgaaggacttcctgagccagcccagcctgggcctgctggtgaggacctacccagagctggaggagggcgtggagctgctggagagccccccccaccgggtggatggccctgctgacctgggggagagccccctggccttcctgaccagcaaccctggccacagcctgtgcagcgagcagggcagcagcgctgagacagcccctgaggagacagagggccctgacctggagagcagtgatgaaacagaccacagcagcaagagcacagagcaggtggccgccttctgccgcagcctgcacgagatgaaccccagcgaccagagccccagcccccaggacagcacaggcccccagctggccaccatgaggcagctgagtgatgctgacaagctgaggaaggtgatctgtgagctgctggagacagagaggacctacgtgaaggacctgaactgcctgatggagcgctacctgaagcccctgcagaaggagaccttcctgacccaggatgagctggatgtgctgtttggaaacctgacagagatggtggagttccaggtggagttcctgaagaccctggaggatggagtgcggctggtgcctgacctggagaagctggagaaggtggaccagttcaagaaggtgctcttcagcctgggcggcagcttcctgtactatgctgaccgcttcaagctgtacagcgccttctgtgcccacaagagcagccagggccctggagagagccaggacagacatggcttccagggcatcctgggctgcccagagcctgaggccgccgccctgattcatgctggggtggtgccccaccaggcccaccctgaggacccccaggtgcccaccagcgcccagggcgctgtgcggccagacagatgtggggagcggggggccctgcccccaggccggggccaccaggaccacgagcagggctgccagagccaccagtag

SEQ ID NO: 172822 - DNA, 678 bp, Artificial Sequence
  Description of Artificial Sequence: Synthetic coding sequence
atgggaaatgctgagagccagcacgtggagcacgagttctacggggagaagcacgccagcctgggcaggaagcacaccagccgcagcctgcggctgagccacaagaccaggaggaccaggcatgccagcagcggcaaggtgatccacaggaacagcgaggtgtccaccaggagcagcagcacccccagcatcccccagagcctggccgagaatggcctggagcccttcagccaggacggcaccctggaggactttggcagccccatctgggtggacagagtggacatgggcctgcggcctgtgtcctacacagacagctctgtgaccccatctgtggacagcagcatcgtgctgacagctgcctctgtgcagagcatgccagacacagaggagagccggctgtatggagatgatgccacctacctggccgagggcggccggcggcagcacagctacaccagcaatggccccaccttcatggagacagccagcttcaagaagaagaggagcaagtctgctgacatctggagggaggacagcctggagttcagcctgagtgacctgagccaggagcacctgaccagcaatgaggagatcctgggcagcgctgaggagaaggactgtgaggaggcccggggcatggagacccgggccagcccccggcagctgagcacctag

SEQ ID NO: 172823 - DNA, 4596 bp, Artificial Sequence
  Description of Artificial Sequence: Synthetic coding sequence
atgggaaatgctgagagccagcacgtggagcacgagttctacggggagaagcacgccagcctgggcaggaagcacaccagccgcagcctgcggctgagccacaagaccaggaggaccaggcatgccagcagcggcaaggtgatccacaggaacagcgaggtgtccaccaggagcagcagcacccccagcatcccccagagcctggccgagaatggcctggagcccttcagccaggacggcaccctggaggactttggcagccccatctgggtggacagagtggacatgggcctgcggcctgtgtcctacacagacagctctgtgaccccatctgtggacagcagcatcgtgctgacagctgcctctgtgcagagcatgccagacacagaggagagccggctgtatggagatgatgccacctacctggccgagggcggccggcggcagcacagctacaccagcaatggccccaccttcatggagacagccagcttcaagaagaagaggagcaagtctgctgacatctggagggaggacagcctggagttcagcctgagtgacctgagccaggagcacctgaccagcaatgaggagatcctgggcagcgctgaggagaaggactgtgaggaggcccggggcatggagacccgggccagcccccggcagctgagcacctgccagagggccaacagcctgggggacctgtatgcccagaagaacagcggcgtgacagccaacggcggccctggcagcaagtttgctggctactgcaggaacctggtgtctgacatccccaacctggccaaccacaagatgcctcctgctgctgctgaggagaccccaccctacagcaactacaacaccctgccctgcaggaagagccactgcctgtctgagggcgccaccaacccccagatcagccacagcaacagcatgcagggcagaagagccaagaccacccaggatgtgaatgctggggagggcagcgagtttgctgacagcggcatcgagggcgccaccacagacacagacctgctgagccgccgcagcaatgccaccaacagcagctacagccccaccaccggccgggcctttgtgggcagtgacagcggcagcagcagcactggagatgctgcccggcagggcgtgtatgagaacttccggcgggagctggagatgagcaccaccaacagcgagagcctggaggaggccggcagcgcccacagtgatgagcagagcagcggcaccctgagcagccctggccagagcgacatcctgctgacagctgcccagggcaccgtgaggaaggccggggccctggccgtgaagaacttcctggtgcacaagaagaacaagaaggtggagagcgccaccaggaggaagtggaagcactactgggtgtccctgaagggctgcaccctcttcttctatgaaagtgatggccgctctggaattgaccacaacagcatccccaagcatgctgtgtgggtggagaacagcatcgtgcaggccgtgcctgagcaccccaagaaggactttgtgttctgcctgagcaacagcctgggagatgccttcctgttccagaccaccagccagacagagctggagaactggatcacagccatccacagcgcctgtgccacagctgtggcccggcaccaccacaaggaggacaccctgcggctgctgaagtctgagatcaagaagctggagcagaagattgacatggatgagaagatgaagaagatgggagagatgcagctgagctctgtgacagacagcaagaagaagaagaccatcctggaccagatctttgtgtgggagcagaacctggagcagttccagatggacctcttccgcttccgctgctacctggccagcctgcagggcggggagctgcccaaccccaagaggctgctggcctttgccagccggcccaccaaggtggccatgggccgcctgggcatcttctctgtgtcctccttccacgccctggtggccgccaggactggagaaacaggagtgagaagaaggacccaggccatgagccgcagcgccagcaagagaagaagccgcttcagcagcctgtggggcctggacaccaccagcaagaagaagcagggccggcccagcatcaaccagcgggagaaggaggtggtgctgcccaacgtgcaccagcacaacccagactgtgacatctgggtgcatgagtacttcacccccagctggttctgcctgcccaacaaccagcctgccctgactgtggtgcggcctggggacacagcccgggacaccctggagctgatctgcaagctgtacaaggagattgagatctgccccaaggtgacccagagcatccacatcgagaagagtgacacagctgctgacacctacggcttcagcctgagctctgtggaggaggatggcatccggcggctgtatgtgaacagcgtgaaggagaccggcctggccagcaagaagggcctgaaggctggagatgagatcctggagatcaacaacagagctgctgatgccctgaacagctccatgctgaaggacttcctgagccagcccagcctgggcctgctggtgaggacctacccagagctggaggagggcgtggagctgctggagagccccccccaccgggtggatggccctgctgacctgggggagagccccctggccttcctgaccagcaaccctggccacagcctgtgcagcgagcagggcagcagcgctgagacagcccctgaggagacagagggccctgacctggagagcagtgatgaaacagaccacagcagcaagagcacagagcaggtggccgccttctgccgcagcctgcacgagatgaaccccagcgaccagagccccagcccccaggacagcacaggcccccagctggccaccatgaggcagctgagtgatgctgacaagctgaggaaggtgatctgtgagctgctggagacagagaggacctacgtgaaggacctgaactgcctgatggagcgctacctgaagcccctgcagaaggagaccttcctgacccaggatgagctggatgtgctgtttggaaacctgacagagatggtggagttccaggtggagttcctgaagaccctggaggatggagtgcggctggtgcctgacctggagaagctggagaaggtggaccagttcaagaaggtgctcttcagcctgggcggcagcttcctgtactatgctgaccgcttcaagctgtacagcgccttctgtgccagccacaccaaggtgcccaaggtgctggtgaaggccaagacagacacagccttcaaggccttcctggatgcccagaaccccaagcagcagcacagcagcaccctggagagctacctgatcaagcccatccagaggatcctgaagtaccccctgctgctgcgggagctgtttgccctgacagatgctgagagcgaggagcactaccacctggatgtggccatcaagaccatgaacaaggtggccagccacatcaatgagatgcagaagatccacgaggagtttggagctgtgtttgaccagctgattgctgagcagacaggagagaagaaggaggtggccgacctgtccatgggagacctgctgctgcacaccaccgtcatctggctgaaccccccagccagcctgggcaagtggaagaaggagcctgagctggccgcctttgtgttcaagacagctgtggtgctggtgtacaaggatggcagcaagcagaagaagaagctggtgggcagccaccggctgagcatctatgaggactgggaccccttccgcttccgccacatgatccccacagaggccctgcaggtgcgggccctggccagcgcagatgctgaggccaatgctgtgtgtgagatcgtgcacgtgaagtctgagagcgagggccggcctgagagggtcttccacctgtgctgcagcagccctgagagcaggaaggacttcctgaaggctgtgcacagcatcctgcgggacaagcaccggcggcagctgctgaagacagagagcctgcccagcagccagcagtatgtgccctttggaggcaagaggctgtgtgccctgaagggggcccggcctgccatgagcagagctgtgtctgcccccagcaagagcctgggcagaagaagaagaaggctggccaggaaccgcttcaccatcgacagtgatgctgtgtctgccagcagccctgagaaggagagccagcagcccccaggcggcggggacacagaccgctgggtggaggagcagtttgacctggcccagtatgaggagcaggatgacatcaaggagacagacatcctgagtgatgatgatgagttctgtgagagcgtgaagggggcctctgtggaccgggacctgcaggagcggctgcaggccaccagcatcagccagcgggagcggggcaggaagaccctggacagccacgccagcaggatggcccagctgaagaagcaggccgccctgagcggcatcaatggaggcctggagagcgccagcgaggaggtgatctgggtgagaagagaagattttgcccccagcaggaagctgaacacagagatctag

SEQ ID NO: 172824 - DNA, 2493 bp, Artificial Sequence
  Description of Artificial Sequence: Synthetic coding sequence
atgggctccatgttccgctctgaggaggtggccctggtgcagctgttcctgcccacagctgctgcctacacctgtgtgtcccggctgggggagctgggcctggtggagttccgggacctgaatgcctctgtgtctgccttccagaggagatttgtggtggatgtgcggcgctgtgaggagctggagaagaccttcaccttcctgcaggaggaggtgagaagagctggcctggtgctgcccccacccaagggccgcctgcctgcccccccaccccgggacctgctgcgcatccaggaggagacagagcggctggcccaggagctgagagatgtgcggggcaaccagcaggccctgcgggcccagctgcaccagctgcagctgcatgctgctgtgctgcggcagggccacgagccccagctggccgccgcccacacagatggagccagcgagaggacccccctgctgcaggcccctgggggcccccaccaggacctgcgggtgaactttgtggccggggctgtggagccccacaaggccccagccctggagcggctgctgtggagggcctgccggggcttcctgattgccagcttccgggagctggagcagcccctggagcaccctgtgactggagagcccgccacctggatgaccttcctgatctcctactggggcgagcagatcggccagaagatcaggaagatcacagactgcttccactgccacgtgttccccttcctgcagcaggaggaggcccggctgggcgccctgcagcagctgcagcagcagagccaggagctgcaggaggtgctgggggagacagagcgcttcctgagccaggtgctgggccgggtgctgcagctgctgcccccaggccaggtgcaggtgcacaagatgaaggctgtgtacctggccctgaaccagtgcagcgtgtccaccacccacaagtgcctgattgctgaggcctggtgcagcgtgcgggacctgcctgccctgcaggaggccctgcgggacagctccatggaggagggcgtgtctgctgtggcccaccgcatcccctgccgggacatgccacccaccctcatccgcaccaaccgcttcaccgccagcttccagggcatcgtggatgcctacggcgtgggccgctaccaggaggtgaacccagccccctacaccatcatcaccttccccttcctgtttgctgtgatgtttggagatgtgggccacggcctgctgatgttcctgtttgccctggccatggtgctggccgagaacagacctgctgtgaaggccgcccagaatgagatctggcagaccttcttccggggccgctacctgctgctgctgatgggcctcttcagcatctacacaggcttcatctacaatgaatgcttcagccgggccaccagcatcttccccagcggctggagcgtggccgccatggccaaccagagcggctggagcgatgccttcctggcccagcacaccatgctgaccctggaccccaacgtgactggagtcttcctgggcccctaccccttcggcatcgaccccatctggagcctggccgccaaccacctgtccttcctgaacagcttcaagatgaagatgtctgtcatcctgggcgtggtgcacatggccttcggcgtggtgctgggcgtcttcaaccacgtgcacttcggccagaggcaccggctgctgctggagaccctgcctgagctgaccttcctgctgggcctgtttggctacctggtgttcctggtgatctacaagtggctgtgtgtgtgggccgcccgggccgccagcgcccccagcatcctgatccacttcatcaacatgttcctgttcagccacagccccagcaaccggctgctgtacccccggcaggaggtggtgcaggccaccctggtggtgctggccctggccatggtgcccatcctgctgctgggcacccccctgcacctgctgcaccgccacagaagaaggctgcggcggcggcctgctgaccggcaggaggagaacaaggccggcctgctggacctgcctgatgcctctgtgaatggctggagcagtgatgaggagaaggccggcggcctggatgatgaggaggaggccgagctggtgcccagcgaggtgctgatgcaccaggccatccacaccatcgagttctgcctgggctgtgtgagcaacacagccagctacctgcggctgtgggccctgagcctggcccacgcccagctgtctgaggtgctgtgggccatggtgatgagaattggcctgggcctgggccgggaggtgggcgtggccgctgtggtgctggtgcccatctttgctgcctttgctgtgatgacagtggccatcctgctggtgatggagggcctgagcgccttcctgcacgccctgcggctgcactgggtggagttccagaacaagttctacagcggcaccggctacaagctgagccccttcacctttgctgccacagatgactag

SEQ ID NO: 172825 - DNA, 657 bp, Artificial Sequence
  Description of Artificial Sequence: Synthetic coding sequence
atgggctccatgttccgctctgaggaggtggccctggtgcagctgttcctgcccacagctgctgcctacacctgtgtgtcccggctgggggagctgggcctggtggagttccgggacctgaatgcctctgtgtctgccttccagaggagatttgtggtggatgtgcggcgctgtgaggagctggagaagaccttcaccttcctgcaggaggaggtgagaagagctggcctggtgctgcccccacccaagggccgcctgcctgcccccccaccccgggacctgctgcgcatccaggaggagacagagcggctggcccaggagctgagagatgtgcggggcaaccagcaggccctgcgggcccagctgcaccagctgcagctgcatgctgctgtgctgcggcagggccacgagccccagctggccgccgcccacacagatggagccagcgagaggacccccctgctgcaggcccctgggggcccccaccaggacctgcgggtgaactttgtggccggggctgtggagccccacaaggccccagccctggagcggctgctgtggagggcctgccggggcttcctgattgccagcttccgggagctggagcagcccctggagcaccctgtgactggagagcccgccacctggatgacctag

SEQ ID NO: 172826 - DNA, 186 bp, Artificial Sequence
  Description of Artificial Sequence: Synthetic coding sequence
gatgatgaggaggaggccgagctggtgcccagcgaggtgctgatgcaccaggccatccacaccatcgagttctgcctgggctgtgtgagcaacacagccagctacctgcggctgtgggccctgagcctggcccacgcccgctggaacagcaggaccagcagcacccaggcccgggccaccagctag

SEQ ID NO: 172827 - DNA, 1845 bp, Artificial Sequence
  Description of Artificial Sequence: Synthetic coding sequence
atgaccttcctgatctcctactggggcgagcagatcggccagaagatcaggaagatcacagactgcttccactgccacgtgttccccttcctgcagcaggaggaggcccggctgggcgccctgcagcagctgcagcagcagagccaggagctgcaggaggtgctgggggagacagagcgcttcctgagccaggtgctgggccgggtgctgcagctgctgcccccaggccaggtgcaggtgcacaagatgaaggctgtgtacctggccctgaaccagtgcagcgtgtccaccacccacaagtgcctgattgctgaggcctggtgcagcgtgcgggacctgcctgccctgcaggaggccctgcgggacagctccatggaggagggcgtgtctgctgtggcccaccgcatcccctgccgggacatgccacccaccctcatccgcaccaaccgcttcaccgccagcttccagggcatcgtggatgcctacggcgtgggccgctaccaggaggtgaacccagccccctacaccatcatcaccttccccttcctgtttgctgtgatgtttggagatgtgggccacggcctgctgatgttcctgtttgccctggccatggtgctggccgagaacagacctgctgtgaaggccgcccagaatgagatctggcagaccttcttccggggccgctacctgctgctgctgatgggcctcttcagcatctacacaggcttcatctacaatgaatgcttcagccgggccaccagcatcttccccagcggctggagcgtggccgccatggccaaccagagcggctggagcgatgccttcctggcccagcacaccatgctgaccctggaccccaacgtgactggagtcttcctgggcccctaccccttcggcatcgaccccatctggagcctggccgccaaccacctgtccttcctgaacagcttcaagatgaagatgtctgtcatcctgggcgtggtgcacatggccttcggcgtggtgctgggcgtcttcaaccacgtgcacttcggccagaggcaccggctgctgctggagaccctgcctgagctgaccttcctgctgggcctgtttggctacctggtgttcctggtgatctacaagtggctgtgtgtgtgggccgcccgggccgccagcgcccccagcatcctgatccacttcatcaacatgttcctgttcagccacagccccagcaaccggctgctgtacccccggcaggaggtggtgcaggccaccctggtggtgctggccctggccatggtgcccatcctgctgctgggcacccccctgcacctgctgcaccgccacagaagaaggctgcggcggcggcctgctgaccggcaggaggagaacaaggccggcctgctggacctgcctgatgcctctgtgaatggctggagcagtgatgaggagaaggccggcggcctggatgatgaggaggaggccgagctggtgcccagcgaggtgctgatgcaccaggccatccacaccatcgagttctgcctgggctgtgtgagcaacacagccagctacctgcggctgtgggccctgagcctggcccacgcccagctgtctgaggtgctgtgggccatggtgatgagaattggcctgggcctgggccgggaggtgggcgtggccgctgtggtgctggtgcccatctttgctgcctttgctgtgatgacagtggccatcctgctggtgatggagggcctgagcgccttcctgcacgccctgcggctgcactgggtggagttccagaacaagttctacagcggcaccggctacaagctgagccccttcacctttgctgccacagatgactag

SEQ ID NO: 172828 - DNA, 357 bp, Artificial Sequence
  Description of Artificial Sequence: Synthetic coding sequence
atggtgcccatcctgctgctgggcacccccctgcacctgctgcaccgccacagaagaaggctgcggcggcggcctgctgaccggcaggaggagaacaaggccggcctgctggacctgcctgatgcctctgtgaatggctggagcagtgatgaggagaaggccggcggcctggatgatgaggaggaggccgagctggtgcccagcgaggtgctgatgcaccaggccatccacaccatcgagttctgcctgggctgtgtgagcaacacagccagctacctgcggctgtgggccctgagcctggcccacgcccgctggaacagcaggaccagcagcacccaggcccgggccaccagctag

SEQ ID NO: 172829 - DNA, 1671 bp, Artificial Sequence
  Description of Artificial Sequence: Synthetic coding sequence
atggagggccccctgtctgtgtttggagacaggagcactggagagaccatccgcagccagaatgtgatggctgctgccagcatcgccaacatcgtgaagagcagcctgggccctgtgggcctggacaagatgctggtggatgacattggagatgtgaccatcaccaatgatggagccaccatcctgaagctgctggaggtggagcaccctgctgccaaggtgctgtgtgagctggccgacctgcaggacaaggaggtgggagatggcaccacctctgtggtgatcatcgctgctgagctgctgaagaatgctgatgagctggtgaagcagaagatccaccccaccagcgtcatcagcggctaccgcctggcctgcaaggaggccgtgcgctacatcaatgaaaacctgattgtgaacacagatgagctgggccgggactgcctgatcaatgctgccaagacctccatgagcagcaagatcatcggcatcaacggggacttctttgccaacatggtggtggatgctgtgctggccatcaagtacacagacatccggggccagccccgctaccctgtgaacagcgtgaacatcctgaaggcccacggccgcagccagatggagagcatgctgatcagcggctacgccctgaactgtgtggtgggcagccagggcatgcccaagagaattgtgaatgccaagatcgcctgcctggacttcagcctgcagaagaccaagatgaagctgggcgtgcaggtggtgatcacagatcctgagaagctggaccagatccggcagcgggagagtgacatcaccaaggagcgcatccagaagatcctggccactggagccaacgtcatcctgaccactggaggcattgatgacatgtgcctgaagtactttgtggaggccggggccatggctgtgagaagagtgctgaagagggacctgaagagaattgccaaggccagcggggccaccatcctgagcaccctggccaacctggagggggaggagacctttgaggccgccatgctgggccaggccgaggaggtggtgcaggagcgcatctgtgatgatgagctgatcctgatcaagaacaccaaggcccggaccagcgccagcatcatcctgcggggggccaatgacttcatgtgtgatgagatggagaggagcctgcatgatgccctgtgtgtggtgaagagggtgctggagagcaagtctgtggtgcctgggggcggcgctgtggaggccgccctgagcatctacctggagaactatgccacctccatgggcagccgggagcagctggccatcgccgagtttgcccggagcctgctggtgatccccaacaccctggccgtgaatgctgcccaggacagcacagacctggtggccaagctgcgggccttccacaatgaggcccaggtgaaccctgagaggaagaacctgaagtggattggcctggacctgagcaatggcaagccccgggacaacaagcaggccggcgtgtttgagcccaccatcgtgaaggtgaagagcctgaagtttgccacagaggccgccatcaccatcctgagaattgatgacctgatcaagctgcaccctgagagcaaggatgacaagcacggcagctatgaagatgctgtgcacagcggggccctgaatgactag

SEQ ID NO: 172830 - DNA, 1206 bp, Artificial Sequence
  Description of Artificial Sequence: Synthetic coding sequence
atgagcagcaagatcatcggcatcaatggagacttctttgccaacatggtggtggatgctgtgctggccatcaagtacacagacatccggggccagccccgctaccctgtgaacagcgtgaacatcctgaaggcccacggccgcagccagatggagagcatgctgatcagcggctacgccctgaactgtgtggtgggcagccagggcatgcccaagagaattgtgaatgccaagatcgcctgcctggacttcagcctgcagaagaccaagatgaagctgggcgtgcaggtggtgatcacagatcctgagaagctggaccagatccggcagcgggagagtgacatcaccaaggagcgcatccagaagatcctggccaccggggccaacgtcatcctgaccaccggcggcattgatgacatgtgcctgaagtactttgtggaggccggggccatggctgtgcggcgggtgctgaagagggacctgaagagaattgccaaggccagcggggccaccatcctgagcaccctggccaacctggagggggaggagacctttgaagctgccatgctgggccaggccgaggaggtggtgcaggagcgcatctgtgatgatgagctgatcctgatcaagaacaccaaggcccggaccagcgccagcatcatcctgcggggggccaatgacttcatgtgtgatgagatggagaggagcctgcatgatgccctgtgtgtggtgaagagggtgctggagagcaagtctgtggtgcctgggggcggcgctgtggaggccgccctgagcatctacctggagaactatgccacctccatgggcagccgggagcagctggccatcgccgagtttgcccggagcctgctggtgatccccaacaccctggccgtgaatgctgcccaggacagcacagacctggtggccaagctgcgggccttccacaatgaggcccaggtgaaccctgagaggaagaacctgaagtggattggcctggacctgagcaatggcaagccccgggacaacaagcaggccggcgtgtttgagcccaccatcgtgaaggtgaagagcctgaagtttgccacagaagctgccatcaccatcctgagaattgatgacctgatcaagctgcaccctgagagcaaggatgacaagcacggcagctatgaagatgctgtgcacagcggggccctgaatgactag

SEQ ID NO: 172831 - DNA, 1302 bp, Artificial Sequence
  Description of Artificial Sequence: Synthetic coding sequence
atggagggccccctgtctgtgtttggagacaggagcactggagagaccatccgcagccagaatgtgatggctgctgccagcatcgccaacatcgtgaagagcagcctgggccctgtgggcctggacaagatgctggtggatgacattggagatgtgaccatcaccaatgatggagccaccatcctgaagctgctggaggtggagcaccctgctgccaaggtgctgtgtgagctggccgacctgcaggacaaggaggtgggagatggcaccacctctgtggtgatcatcgctgctgagctgctgaagaatgctgatgagctggtgaagcagaagatccaccccaccagcgtcatcagcggctaccgcctggcctgcaaggaggccgtgcgctacatcaatgaaaacctgattgtgaacacagatgagctgggccgggactgcctgatcaatgctgccaagacctccatgagcagcaagatcatcggcatcaacggggacttctttgccaacatggtggtggatgctgtgctggccatcaagtacacagacatccggggccagccccgctaccctgtgaacagcgtgaacatcctgaaggcccacggccgcagccagatggagagcatgctgatcagcggctacgccctgaactgtgtggtgggcagccagggcatgcccaagagaattgtgaatgccaagatcgcctgcctggacttcagcctgcagaagaccaagatgaagctgggcgtgcaggtggtgatcacagatcctgagaagctggaccagatccggcagcgggagagtgacatcaccaaggagcgcatccagaagatcctggccactggagccaacgtcatcctgaccactggaggcattgatgacatgtgcctgaagtactttgtggaggccggggccatggctgtgagaagagtgctgaagagggacctgaagagaattgccaaggccagcggggccaccatcctgagcaccctggccaacctggagggggaggagacctttgaggccgccatgctgggccaggccgaggaggtggtgcaggagcgcatctgtgatgatgagctgatcctgatcaagaacaccaaggcccggaccagcgccagcatcatcctgcggggggccaatgacttcatgtgtgatgagatggagaggagcctgcatgatgccctgtgtgtggtgaagagggtgctggagagcaagtctgtggtgcctgggggcggcgctgtggaggccgccctgagcatctacctggagaactatgccacctccatggactggagctag

SEQ ID NO: 172832 - DNA, 648 bp, Artificial Sequence
  Description of Artificial Sequence: Synthetic coding sequence
atgctggccggccagctggaggcccgggaccccaaggagggcacccaccctgaggacccctgccctggggccggggctgtgatggagaagacagctgtggccgctgaggtgctgacagaggactgcaacacaggagagatgccacccctgcagcagcagatcatccggctgcaccaggagctgggccggcagaagagcctgtgggcagatgtgcacggcaagctgcggagccacattgatgccctgcgggagcagaacatggagctgcgggagaagctgcgggccctgcagctgcagcgctggaaggccaggaagaagtctgctgccagcccccatgctggccaggagagccacaccctggccctggagcccgccttcggcaagatcagccccctgtctgcagatgaggagaccatccccaagtatgccggccacaagaaccagagcgccaccctgctgggccagaggagcagcagcaacaacagcgccccacccaagcccatgagcctgaagattgaaagaatcagctcctggaagaccccaccccaggagaacagagacaagaacctgagcagaagacggcaggacagaagagccacccccaccggccggcccaccccctgtgccgagaggagaggaggagtgtag

SEQ ID NO: 172833 - DNA, 981 bp, Artificial Sequence
  Description of Artificial Sequence: Synthetic coding sequence
atggagaagaccccagctgctgctgaggtgccccgggaggacagcaatgctggggagatgcccagcctgcagcagcagatcaccagcctgcaccaggagctgggccggcagcagagcctgtgggccgacatccacaggaagctgcagagccacatggatgccctgaggaagcagaaccgggagctgcgggaggagctgcggggcctgcagaggcagcagtgggaggccggcaagaagccagctgccagcccccacgccggccgggagagccacaccctggccctggagcccgccttcggcaagatcagccacctgtctgcagatgaggacaccacccccaagtatgccggcaggaagagccagagcgccaccctgctgggccagcgctggagcagcaaccacctggccccacccaagcccatgagcctgaagacagagcgcatcaacagcggcaagaccccaccccaggaggaccgggagaagagccccccaggccggcggcaggacaggagccctgcccccaccggccggcccaccccaggagctgagcggcggggcgtgtctgaagatggcaagatcatgcaccccagcagccgcagcccccagaacagcggcggcaggaagagccctgtgcaggccagccaggccaccaccctgcaggagcagacagctgctgcccggggagctgacaggagcagctctgtgctgggcagcagcgagggcggcttcctgagccgggtgcaggctgatgaatttgccagcagcgccccagattctgctgagcggcagaacctgcctgtgaacccccccagcagcctggagatcgcccaggccatggacaccaagatgaagaaggaggaggtgcaggaggagaagaggcaccccaagggcaaggcagatgactgcagaagaagtggcttccccagcgagttccctggggccctgcatgctgcccccagccggcaggacatgggcccctag

SEQ ID NO: 172834 - DNA, 1326 bp, Artificial Sequence
  Description of Artificial Sequence: Synthetic coding sequence
atggcccccaagggcatcctgggcagcttccccacagccatgaacctgagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgcgcatcgagattgaggaggccctggacatggacctgctgaagcaggaggccgagcacggggccctgaaggtgctgtacctgagcaaatatgtgctgaacatgatggccctgctgtgtgcccctgtgagagatgaggccgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgagcgggccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaagctgccaacaaccctgagcccctgagccccaccatggtgctgtgccagggcttcctgaacctgctgctgtgggacctggagaatgaggagttccctgagaccctgctgatggacaggacccggctgcaggagctgaagagccagctgcaccagctgactgtgatggcctctgtgctgctggtggccagcagcttcagcggctctgtgctgtttggcagcccccagtttgtggacaagctgaagaggatcaccaagagcctgctggaggacttccacagcaggcctgaggaggccatcctgactgtgtctgagcaggtgtcccaggagatccaccagagcctgaagaacatgggcctggtggccctgagcagtgacaacacagccagcctgatgggccagctgcagaacatcgccaagaaggagaactgtgtgtgcagcgtcatcgaccagaggatccacctgttcctgaagtgctgcctggtgctgggcgtgcagaggagcctgctggacctgcccggcggcctgaccctcatcgaggccgagctggccgagctgggccagaagtttgtgaacctgacccaccacaaccagcaggtgtttggcccctactacacagagatcctgaagaccctcatcagccctgcccaggccctggagaccaaggtggagagcgtgtag

SEQ ID NO: 172835 - DNA, 1551 bp, Artificial Sequence
  Description of Artificial Sequence: Synthetic coding sequence
atgacccggggcggcggcggcggggacaccatcagcaagatgccagatgtgaaggagagcgtgccccccaagtacccaggggacagcgagggccgcagctgcaagccagagaccagcggccccccccaggaggacaagagcggcagcgaggaccccccacccttcctgtctgtgacaggcctgacagagaccgtgaatgaggtgtccaagctgagcaacaagattggcatgaactgtgactactacatggaggagaaggtgctgccccccagcagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgagaattgaaattgaggaggccctggacatggacctgctgaagcaggaggccgagcacggggccctgaaggtgctgtacctgagcaaatatgtgctgaacatgatggccctgctgtgtgcccctgtgagagatgaagctgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgaaagagccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaggccgccaacaaccctgagcccctgagccccaccatggtgctgtgccagggcttcctgaacctgctgctgtgggacctggagaatgaggagttccctgagaccctgctgatggacaggacccggctgcaggagctgaagagccagctgcaccagctgactgtgatggcctctgtgctgctggtggccagcagcttcagcggctctgtgctgtttggcagcccccagtttgtggacaagctgaagaggatcaccaagagcctgctggaggacttccacagcaggcctgaggaggccatcctgactgtgtctgagcaggtgtcccaggagatccaccagagcctgaagaacatgggcctggtggccctgagcagtgacaacacagccagcctgatgggccagctgcagaacatcgccaagaaggagaactgtgtgtgcagcgtgattgaccagaggatccacctgttcctgaagtgctgcctggtgctgggcgtgcagaggagcctgctggacctgcccggcggcctgaccctgattgaagctgagctggccgagctgggccagaagtttgtgaacctgacccaccacaaccagcaggtgtttggcccctactacacagagatcctgaagaccctcatcagccctgcccaggccctggagaccaaggtggagagcgtgtag

SEQ ID NO: 172836 - DNA, 822 bp, Artificial Sequence
  Description of Artificial Sequence: Synthetic coding sequence
ggcctgagccaccgggccaccccccagcctgctgccccaccccgctggtacgcccctggccggcaggccgcccggcccacagagaggacccctgtggatgacccccggcggggcagaagaagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgcgcatcgagattgaggaggccctggacatggacctgctgaagcaggaggccgagcacggggccctgaaggtgctgtacctgagcaaatatgtgctgaacatgatggccctgctgtgtgcccctgtgagagatgaggccgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgagcgggccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaagctgccaacaaccctgagcccctgagccccaccatggtgctgtgccagggcttcctgaacctgctgctgtgggacctggagaatgaggagttccctgagtag

SEQ ID NO: 172837 - DNA, 1326 bp, Artificial Sequence; identical to SEQ ID NO: 172834
  Description of Artificial Sequence: Synthetic coding sequence

SEQ ID NO: 172838 - DNA, 312 bp, Artificial Sequence
  Description of Artificial Sequence: Synthetic coding sequence
atggcccccaagggcatcctgggcagcttccccacagccatgaacctgagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgcgcatcgagattgaggaggccctggacatggacctgctgaagcaggaggccgagcacggggccctgaaggtgctgtacctgagcaaatatgtgctgaactag

SEQ ID NO: 172839 - DNA, 1512 bp, Artificial Sequence
  Description of Artificial Sequence: Synthetic coding sequence
atgccagatgtgaaggagagcgtgccccccaagtacccaggggacagcgagggccgcagctgcaagccagagaccagcggccccccccaggaggacaagagcggctctgaagatcctccacccttcctgtctgtgacaggcctgacagaaacagtgaatgaggtgtccaagctgagcaacaagattggcatgaactgtgactactacatggaggagaaggtgctgccccccagcagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgcgcatcgagattgaggaggccctggacatggacctgctgaagcaggaggccgagcacggggccctgaaggtgctgtacctgagcaaatatgtgctgaacatgatggccctgctgtgtgcccctgtgagagatgaggccgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgagcgggccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaagctgccaacaaccctgagcccctgagccccaccatggtgctgtgccagggcttcctgaacctgctgctgtgggacctggagaatgaggagttccctgagaccctgctgatggacaggacccggctgcaggagctgaagagccagctgcaccagctgactgtgatggcctctgtgctgctggtggccagcagcttcagcggctctgtgctgtttggcagcccccagtttgtggacaagctgaagaggatcaccaagagcctgctggaggacttccacagcaggcctgaggaggccatcctgactgtgtctgagcaggtgtcccaggagatccaccagagcctgaagaacatgggcctggtggccctgagcagtgacaacacagccagcctgatgggccagctgcagaacatcgccaagaaggagaactgtgtgtgcagcgtcatcgaccagaggatccacctgttcctgaagtgctgcctggtgctgggcgtgcagaggagcctgctggacctgcccggcggcctgaccctcatcgaggccgagctggccgagctgggccagaagtttgtgaacctgacccaccacaaccagcaggtgtttggcccctactacacagagatcctgaagaccctcatcagccctgcccaggccctggagaccaaggtggagagcgtgtag

SEQ ID NO: 172840 - DNA, 1413 bp, Artificial Sequence
  Description of Artificial Sequence: Synthetic coding sequence
atgacccggggcggcggcggcggcgtgctgtctgtgacaggcctgacagagaccgtgaatgaggtgtccaagctgagcaacaagattggcatgaactgtgactactacatggaggagaaggtgctgccccccagcagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgagaattgaaattgaggaggccctggacatggacctgctgaagcaggaggccgagcacggggccctgaaggtgctgtacctgagcaaatatgtgctgaacatgatggccctgctgtgtgcccctgtgagagatgaagctgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgaaagagccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaggccgccaacaaccctgagcccctgagccccaccatggtgctgtgccagggcttcctgaacctgctgctgtgggacctggagaatgaggagttccctgagaccctgctgatggacaggacccggctgcaggagctgaagagccagctgcaccagctgactgtgatggcctctgtgctgctggtggccagcagcttcagcggctctgtgctgtttggcagcccccagtttgtggacaagctgaagaggatcaccaagagcctgctggaggacttccacagcaggcctgaggaggccatcctgactgtgtctgagcaggtgtcccaggagatccaccagagcctgaagaacatgggcctggtggccctgagcagtgacaacacagccagcctgatgggccagctgcagaacatcgccaagaaggagaactgtgtgtgcagcgtgattgaccagaggatccacctgttcctgaagtgctgcctggtgctgggcgtgcagaggagcctgctggacctgcccggcggcctgaccctgattgaagctgagctggccgagctgggccagaagtttgtgaacctgacccaccacaaccagcaggtgtttggcccctactacacagagatcctgaagaccctcatcagccctgcccaggccctggagaccaaggtggagagcgtgtag

SEQ ID NO: 172841 - DNA, 1398 bp, Artificial Sequence
  Description of Artificial Sequence: Synthetic coding sequence
atgacccggggcggcggcggcggcggcctgacagaaacagtgaatgaggtgtccaagctgagcaacaagattggcatgaactgtgactactacatggaggagaaggtgctgccccccagcagcctggagggcaaggtgaaggagaccgtgcacaatgccttctgggaccacctgaaggagcagctgagcgccaccccaccagacttcagctgtgccctggagctgctgaaggagatcaaggagatcctgctgagcctgctgctgccccggcagaaccggctgcgcatcgagattgaggaggccctggacatggacctgctgaagcaggaggccgagcacggggccctgaaggtgctgtacctgagcaaatatgtgctgaacatgatggccctgctgtgtgcccctgtgagagatgaggccgtgcagaagctggagaacatcacagatcctgtgtggctgctgcggggcatcttccaggtgctgggccgcatgaagatggacatggtgaactacaccatccagagcctgcagccccacctgcaggagcacagcatccagtatgagcgggccaagttccaggagctgctgaacaagcagcccagcctgctgaaccacaccaccaagtggctgacccaggccgccggggacctgaccatgagcccccccacctgcccagacaccagtgacagcagctctgtggccggccccagccccaatgaagctgccaacaaccctgagcccctgagccccaccatggtgctgtgccagggcttcctgaacctgctgctgtgggacctggagaatgaggagttccctgagaccctgctgatggacaggacccggctgcaggagctgaagagccagctgcaccagctgactgtgatggcctctgtgctgctggtggccagcagcttcagcggctctgtgctgtttggcagcccccagtttgtggacaagctgaagaggatcaccaagagcctgctggaggacttccacagcaggcctgaggaggccatcctgactgtgtctgagcaggtgtcccaggagatccaccagagcctgaagaacatgggcctggtggccctgagcagtgacaacacagccagcctgatgggccagctgcagaacatcgccaagaaggagaactgtgtgtgcagcgtcatcgaccagaggatccacctgttcctgaagtgctgcctggtgctgggcgtgcagaggagcctgctggacctgcccggcggcctgaccctcatcgaggccgagctggccgagctgggccagaagtttgtgaacctgacccaccacaaccagcaggtgtttggcccctactacacagagatcctgaagaccctcatcagccctgcccaggccctggagaccaaggtggagagcgtgtag

SEQ ID NO: 172842 - DNA, 165 bp, Artificial Sequence
  Description of Artificial Sequence: Synthetic coding sequence
atgacccggggcggcggcggcggggacaccatcagcaagatgccagatgtgaaggagagcgtgccccccaagtacccaggggacagcgagggccgcagctgcaagccagagaccagcggccccccccaggaggacaagagcggcagcgaggaccccccaccctag

SEQ ID NO: 172843 - DNA, 165 bp, Artificial Sequence; identical to SEQ ID NO: 172842
  Description of Artificial Sequence: Synthetic coding sequence

SEQ ID NO: 172844 - DNA, 597 bp, Artificial Sequence
  Description of Artificial Sequence: Synthetic coding sequence
atgttctttgagcggcacctggagaacctgctgaagcacttcatccctggcaccacagatcctgctgtgatcctggacctgctgcccctgtgcaggaactacgtgcggcgggtgcacgtggaccagttcctgccccctgtgcagctgcctgcccagctgcggcctggggaccagagcgacagcggcagcgagggggagatggaggagcccaccgtggaccactaccagctgggggacctggtggccggcctgagccacctggaggagctggacctggtgtatgatgtgaaggactgtggcatgaactttgagtggaacctcttcctgttcacctacagagactgcctgagcctggccgccgccatcaaggcctgccacaccctgaaggatggcggcaagcagctgctggagggcatgtctgacaacaagaccctgctggagtttgacctgcggctgagtgatgtggcccaggagagcgagtacctgattggccaggccctgtatgccaaccgggaggccgcccggcagagggccctgaaccccagccacttcatgagcaccatcacagccaatggacctgagaacagcgtgggctag

SEQ ID NO: 172845 - DNA, 597 bp, Artificial Sequence; identical to SEQ ID NO: 172844
  Description of Artificial Sequence: Synthetic coding sequence

SEQ ID NO: 172846 - DNA, 1506 bp, Artificial Sequence
  Description of Artificial Sequence: Synthetic coding sequence
atgcaggacacagtgaccaccagcgccctgctggaccccagccacagctctgtgtccacccaggacaacagcagcactggaggccacaccagcagcaccagcccccagctgagcaagcccagcatcacccctgtgcctgccaagagcaggaacccccacccccgggccaacatccggaggatgaggcgcatcatcgcagaagatcctgagtggagcctggccatcgtgcccctgctgacagagctgtgcatccagcacatcatccggaacttccagaagaaccccatcctgaagcagatgctgcctgagcaccagcagaaggtgctgaaccacctgagcccagacctgcccctggccgtgacagccaacctgattgattctgagaactactggctgcgctgctgcatgcaccgctggcctgtgtgccacgtggcccaccacggcggctcctggaagaggatgttctttgagcggcacctggagaacctgctgaagcacttcatccctggcaccacagatcctgctgtgatcctggacctgctgcccctgtgcagaaattatgtgagaagagtgcacgtggaccagttcctgccccctgtgcagctgcctgcccagctgcggcctggggaccagagcgacagcggcagcgagggggagatggaggagcccaccgtggaccactaccagctgggggacctggtggccggcctgagccacctggaggagctggacctggtgtatgatgtgaaggactgtggcatgaactttgagtggaacctcttcctgttcacctacagagactgcctgagcctggccgccgccatcaaggcctgccacaccctgaagatcttcaagctgaccaggagcaaggtggatgatgacaaggcccgcatcatcatccgcagcctgctggaccaccctgtgctggaggagctggacctgagccagaacctgattggagacagaggagcccggggagctgccaagctgctgagccacagccggctgcgggtgctgaacctggccaacaaccaggtgcgggcccctggggcccagagcctggcccacgccctggcccacaacaccaacctgatcagcctgaacctgcggctgaactgcattgaagatgagggcggccaggccctggcccacgccctgcagaccaacaagtgcctgaccaccctgcacctgggcggcaatgagctgtctgagcccacagccaccctgctgagccaggtgctggccatcaacaccaccctgaccagcatcaacctgagctgcaaccacatcggcctggatggcggcaagcagctgctggagggcatgtctgacaacaagaccctgctggagtttgacctgcggctgagtgatgtggcccaggagagcgagtacctgattggccaggccctgtatgccaaccgggaggccgcccggcagagggccctgaaccccagccacttcatgagcaccatcacagccaacggcccagaaaattctgtgggctag

SEQ ID NO: 172847 - DNA, 597 bp, Artificial Sequence
  Description of Artificial Sequence: Synthetic coding sequence
atggagaagaggggccggggcgtgaagagcagccccatccagacccccaaccagaccccccagcaggcccctgtgacccccaggaaggagcggcggcccagcatgtttgagaaggaggcctacacccagatcctgcgggagcggctgcgggagagcatccacaacgtgcagtatgtggagcccccatttgatgacagcattgctgacatcggcaaggagtggaagagcgccctggccaagctgaagtttgccaacagctacaggatggagcccctgaagaagttccaggcccacagcgtggagaccaaggtgcagcagatcctgacagagagcctgaaggatgtgaagtatgatgacaaggtgttcagccacctgagcctggagctggccgaccgcatcctgctggccgtgaaggagtttggctaccaccgctacaagttcatcatcaaggtgctcttcatccagaagacaggccaggccatcaacatcgccagccgctggatctgggacatcgcctgggacagctgggtggccgccaagcatgaagctgagagctatgtggccctggtgctggtgtttgccctgtactatgaatag

SEQ ID NO: 172848 - DNA, 666 bp, Artificial Sequence
  Description of Artificial Sequence: Synthetic coding sequence
atggccagccggcccctgcccccaggccggcaggaggaggagaatgccaaggacagcggcaggaagcccagccctgtgcggccccggggctgcctgcccagcattgatgaggcccggcctgctggccctggccctgccccagccagccggcggggctccatgctgggcctggccgccagcttcagcagaagaaacagcctggtgggccctggggccggccctgggggccagaggcccagcctgggccctgtgccccccctgggcagccgggtgtccttcagcggcctgcccctggccccagcccgctgggtggcccccagctacagaacagagcctgtgcctggagagcgctgggaggccgcccgggcccagagggccctggaggccgccctggccgccggcctgcatgatgcctgctacagcagtgatgaagctgcccggctggtgcgggagctgtgtgagcaggtgcacgtgcggctgcgggagctgagccccccacgctacaagctggtgtgcagcgtggtgctgggcccccgggccggccagggcgtgcacgtggtgtcccgggccctgtgggatgtggccagagatggcctggcctctgtgtcctacaccaacaccagcctgtttgctgtggccaccgtgcacggcctgtactgtgagtag

SEQ ID NO: 172849 - DNA, 666 bp, Artificial Sequence; identical to SEQ ID NO: 172848
  Description of Artificial Sequence: Synthetic coding sequence

SEQ ID NO: 172850 - DNA, 1074 bp, Artificial Sequence
  Description of Artificial Sequence: Synthetic coding sequence
atggagaggatgtctgattctgctgacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgaactcatcgcccgctacatcaagctgaggacaggcaagaccaggaccaggaagcaggtgagcagccacatccaggtgctggcccggaggaagagccgggacttccacagcaagctgaaggtgacctccatggaccagacagccaaggacaaggccctgcagcacatggccgccatgagcagcgcccagatcgtgtctgccacagccatccacaacaagctgggcctgcccggcatcccccggcccaccttccctggggcccctggcttctggccaggcatgatccagacaggccagcccggcagcagccaggatgtgaagccctttgtgcagcaggcctaccccatccagcctgctgtgacagcccccatccctggctttgagcccgccagcgccccagcccccagcgtgcctgcctggcagggccgcagcatcggcaccaccaagctgcggctggtggagttcagcgccttcctggagcagcagagggaccctgacagcgctgacctgaactgcaacatccaggatgatgctggggccttctatggagtgaccagccagtatgagagcagcgagaacatgacagtgacctgcagcaccaaggtgtgcagctttgggaagcaggtggtggagaaggtggagacagaatatgccaggtttgaaaatggccgctttgtgtaccgcatcaacagaagccccatgtgtgagtacatgatcaacttcatccacaagctgaagcacctgcctgagaagtacatgatgaacagcgtgctggagaacttcaccatcctgctggtggtgaccaacagagacacccaggagaccctgctgtgcatggcctgtgtgtttgaggtgagcaacagcgagcacggggcccagcaccacatctaccgcctggtgaaggactag

SEQ ID NO: 172851 - DNA, 1236 bp, Artificial Sequence
  Description of Artificial Sequence: Synthetic coding sequence
atggagaggatgtctgattctgctgacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgaactcatcgcccgctacatcaagctgaggacaggcaagaccaggaccaggaagcaggtgagcagccacatccaggtgctggcccggaggaagagccgggacttccacagcaagctgaaggaccagacagccaaggacaaggccctgcagcacatggccgccatgagcagcgcccagatcgtgtctgccacagccatccacaacaagctgggcctgcccggcatcccccggcccaccttccctggggcccctggcttctggccaggcatgatccagacaggccagcccggcagcagccaggatgtgaagccctttgtgcagcaggcctaccccatccagcctgctgtgacagcccccatccctggctttgagcccgccagcgccccagcccccagcgtgcctgcctggcagggccgcagcatcggcaccaccaagctgcggctggtggagttcagcgccttcctggagcagcagagggaccctgacagctacaacaagcacctgtttgtgcacatcggccacgccaaccacagctacagcgaccccctgctggagagcgtggacatccggcagatctatgacaagtttcctgagaagaagggcggcctgaaggagctgtttgggaagggcccccagaatgccttcttcctggtgaagttctgggccgacctgaactgcaacatccaggatgatgctggggccttctatggagtgaccagccagtatgagagcagcgagaacatgacagtgacctgcagcaccaaggtgtgcagctttgggaagcaggtggtggagaaggtggagacagaatatgccaggtttgaaaatggccgctttgtgtaccgcatcaacagaagccccatgtgtgagtacatgatcaacttcatccacaagctgaagcacctgcctgagaagtacatgatgaacagcgtgctggagaacttcaccatcctgctggtggtgaccaacagagacacccaggagaccctgctgtgcatggcctgtgtgtttgaggtgagcaacagcgagcacggggcccagcaccacatctaccgcctggtgaaggactag

SEQ ID NO: 172852 - DNA, 1281 bp, Artificial Sequence
  Description of Artificial Sequence: Synthetic coding sequence
attgagcccagctcctggagcggcagcgagagccctgctgagaacatggagaggatgtctgacagcgctgacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaagagccgggacttccacagcaagctgaaggaccagacagccaaggacaaggccctgcagcacatggccgccatgagcagcgcccagatcgtgtctgccacagccatccacaacaagctgggcctgcccggcatcccccggcccaccttccctggggcccctggcttctggccaggcatgatccagacaggccagcccggcagcagccaggatgtgaagccctttgtgcagcaggcctaccccatccagcctgctgtgacagcccccatccctggctttgagcccgccagcgccccagcccccagcgtgcctgcctggcagggccgcagcatcggcaccaccaagctgcggctggtggagttcagcgccttcctggagcagcagagggaccctgacagctacaacaagcacctgtttgtgcacatcggccacgccaaccacagctacagcgaccccctgctggagagcgtggacatccggcagatctatgacaagtttcctgagaagaagggcggcctgaaggagctgtttgggaagggcccccagaatgccttcttcctggtgaagttctgggccgacctgaactgcaacatccaggatgatgctggggccttctacggcgtgaccagccagtatgagagcagcgagaacatgacagtgacctgcagcaccaaggtgtgcagctttgggaagcaggtggtggagaaggtggagacagaatatgccaggtttgaaaatggccgctttgtgtaccgcatcaacagaagccccatgtgtgagtacatgatcaacttcatccacaagctgaagcacctgcctgagaagtacatgatgaacagcgtgctggagaacttcaccatcctgctggtggtgaccaacagagacacccaggagaccctgctgtgcatggcctgtgtgtttgaggtgagcaacagcgagcacggggcccagcaccacatctaccgcctggtgaaggactag

SEQ ID NO: 172853 - DNA, 993 bp, Artificial Sequence
  Description of Artificial Sequence: Synthetic coding sequence
atgagatatgtgctgtcctggtgtgtgacagtgaccttcaaggaccagacagccaaggacaaggccctgcagcacatggccgccatgagcagcgcccagatcgtgtctgccacagccatccacaacaagctgggcctgcccggcatcccccggcccaccttccctggggcccctggcttctggccaggcatgatccagacaggccagcccggcagcagccaggatgtgaagccctttgtgcagcaggcctaccccatccagcctgctgtgacagcccccatccctggctttgagcccgccagcgccccagcccccagcgtgcctgcctggcagggccgcagcatcggcaccaccaagctgcggctggtggagttcagcgccttcctggagcagcagagggaccctgacagctacaacaagcacctgtttgtgcacatcggccacgccaaccacagctacagcgaccccctgctggagagcgtggacatccggcagatctatgacaagtttcctgagaagaagggcggcctgaaggagctgtttgggaagggcccccagaatgccttcttcctggtgaagttctgggccgacctgaactgcaacatccaggatgatgctggggccttctacggcgtgaccagccagtatgagagcagcgagaacatgacagtgacctgcagcaccaaggtgtgcagctttgggaagcaggtggtggagaaggtggagacagaatatgccaggtttgaaaatggccgctttgtgtaccgcatcaacagaagccccatgtgtgagtacatgatcaacttcatccacaagctgaagcacctgcctgagaagtacatgatgaacagcgtgctggagaacttcaccatcctgctggtggtgaccaacagagacacccaggagaccctgctgtgcatggcctgtgtgtttgaggtgagcaacagcgagcacggggcccagcaccacatctaccgcctggtgaaggactag

SEQ ID NO: 172854 - DNA, 207 bp, Artificial Sequence
  Description of Artificial Sequence: Synthetic coding sequence
attgagcccagctcctggagcggcagcgagagccctgctgagaacatggagaggatgtctgacagcgctgacaagcccatcgacaatgatgctgagggcgtgtggagcccagacatcgagcagagcttccaggaggccctggccatctacccaccctgtggccgcaggaagatcatcctgagtgatgagggcaagatgtatggatag

SEQ ID NO: 172855 - DNA, 1281 bp, Artificial Sequence; identical to SEQ ID NO: 172852
  Description of Artificial Sequence: Synthetic coding sequence

SEQ ID NO: 172856 - DNA, 1344 bp, Artificial Sequence
  Description of Artificial Sequence: Synthetic coding sequence
atgggagagccccgggccggggccgccctggatgatggcagcggctggacaggcagcgaggagggcagcgaggagggcactggaggcagcgagggcgctggaggagatggcggcccagatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaagagccgggagatccagagcaagctgaaggaccaggtgtccaaggacaaggccttccagaccatggccaccatgagcagcgcccagctgatcagcgcccccagcctgcaggccaagctgggccccaccggcccccaggccagcgagctgttccagttctggagcggcggcagcggccccccctggaatgtgcctgatgtgaagcccttcagccagacccccttcaccctgagcctgaccccacccagcacagacctgcccggctatgagcccccccaggccctgagccccctgcccccacccacccccagccccccagcctggcaggcccggggcctgggcacagcccggctgcagctggtggagttcagcgcctttgtggagcccccagatgctgtggacagctaccagaggcacctgtttgtgcacatcagccagcactgccccagccctggggccccacccctggagagcgtggatgtgcggcagatctatgacaagtttcctgagaagaagggcggcctgcgggagctgtatgaccggggcccccctcatgccttcttcctggtgaagttctgggccgacctgaactggggccccagcggggaggaggccggggccggcggcagcatcagcagcggcggcttctatggagtgagcagccagtatgagagcctggagcacatgaccctgacctgcagcagcaaggtgtgcagctttgggaagcaggtggtggagaaggtggagacagagcgggcccagctggaggatggccgctttgtgtaccgcctgctgcggagccccatgtgtgagtacctggtgaacttcctgcacaagctgcggcagctgcctgagcgctacatgatgaacagcgtgctggagaacttcaccatcctgcaggtggtgaccaacagagacacccaggagctgctgctgtgcacagcctacgtgtttgaggtgtccaccagcgagcggggggcccagcaccacatctaccgcctggtgcgggactag

SEQ ID NO: 172857 - DNA, 1353 bp, Artificial Sequence
  Description of Artificial Sequence: Synthetic coding sequence
atgggagagccccgggccggggccgccctggatgatggcagcggctggacaggcagcgaggagggcagcgaggagggcactggaggcagcgagggcgctggaggagatggcggcccagatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaagagccgggagatccagagcaagctgaaggaccaggtgtccaaggacaaggccttccagaccatggccaccatgagcagcgcccagctgatcagcgcccccagcctgcaggccaagctgggccccaccggcccccaggtggtgcaggccagcgagctgttccagttctggagcggcggcagcggccccccctggaatgtgcctgatgtgaagcccttcagccagacccccttcaccctgagcctgaccccacccagcacagacctgcccggctatgagcccccccaggccctgagccccctgcccccacccacccccagccccccagcctggcaggcccggggcctgggcacagcccggctgcagctggtggagttcagcgcctttgtggagcccccagatgctgtggacagctaccagaggcacctgtttgtgcacatcagccagcactgccccagccctggggccccacccctggagagcgtggatgtgcggcagatctatgacaagtttcctgagaagaagggcggcctgcgggagctgtatgaccggggccccccccacgccttcttcctggtgaagttctgggccgacctgaactggggccccagcggggaggaggccggggccggcggcagcatcagcagcggcggcttctacggcgtgagcagccagtatgagagcctggagcacatgaccctgacctgcagcagcaaggtgtgcagctttgggaagcaggtggtggagaaggtggagacagagcgggcccagctggaggatggccgctttgtgtaccgcctgctgcggagccccatgtgtgagtacctggtgaacttcctgcacaagctgcggcagctgcctgagcgctacatgatgaacagcgtgctggagaacttcaccatcctgcaggtggtgaccaacagagacacccaggagctgctgctgtgcacagcctacgtgtttgaggtgtccaccagcgagcggggggcccagcaccacatctaccgcctggtgcgggactag

SEQ ID NO: 172858 - DNA, 960 bp, Artificial Sequence
  Description of Artificial Sequence: Synthetic coding sequence
atggccaccatgagcagcgcccagctgatcagcgcccccagcctgcaggccaagctgggccccaccggcccccaggtggtgcaggccagcgagctgttccagttctggagcggcggcagcggccccccctggaatgtgcctgatgtgaagcccttcagccagacccccttcaccctgagcctgaccccacccagcacagacctgcccggctatgagcccccccaggccctgagccccctgcccccacccacccccagccccccagcctggcaggcccggggcctgggcacagcccggctgcagctggtggagttcagcgcctttgtggagcccccagatgctgtggacagctaccagaggcacctgtttgtgcacatcagccagcactgccccagccctggggccccacccctggagagcgtggatgtgcggcagatctatgacaagtttcctgagaagaagggcggcctgcgggagctgtatgaccggggcccccctcatgccttcttcctggtgaagttctgggccgacctgaactggggccccagcggggaggaggccggggccggcggcagcatcagcagcggcggcttctatggagtgagcagccagtatgagagcctggagcacatgaccctgacctgcagcagcaaggtgtgcagctttgggaagcaggtggtggagaaggtggagacagagcgggcccagctggaggatggccgctttgtgtaccgcctgctgcggagccccatgtgtgagtacctggtgaacttcctgcacaagctgcggcagctgcctgagcgctacatgatgaacagcgtgctggagaacttcaccatcctgcaggtggtgaccaacagagacacccaggagctgctgctgtgcacagcctacgtgtttgaggtgtccaccagcgagcggggggcccagcaccacatctaccgcctggtgcgggactag

SEQ ID NO: 172859 - DNA, 1356 bp, Artificial Sequence
  Description of Artificial Sequence: Synthetic coding sequence
atgggagagccccgggccggggccgccctggatgatggcagcggctggacaggcagcgaggagggcagcgaggagggcactggaggcagcgagggcgctggaggagatggcggcccagatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaagagccgggagatccagagcaagctgaaggccctgaatgtggaccaggtgtccaaggacaaggccttccagaccatggccaccatgagcagcgcccagctgatcagcgcccccagcctgcaggccaagctgggccccaccggcccccaggccagcgagctgttccagttctggagcggcggcagcggccccccctggaatgtgcctgatgtgaagcccttcagccagacccccttcaccctgagcctgaccccacccagcacagacctgcccggctatgagcccccccaggccctgagccccctgcccccacccacccccagccccccagcctggcaggcccggggcctgggcacagcccggctgcagctggtggagttcagcgcctttgtggagcccccagatgctgtggacagctaccagaggcacctgtttgtgcacatcagccagcactgccccagccctggggccccacccctggagagcgtggatgtgcggcagatctatgacaagtttcctgagaagaagggcggcctgcgggagctgtatgaccggggcccccctcatgccttcttcctggtgaagttctgggccgacctgaactggggccccagcggggaggaggccggggccggcggcagcatcagcagcggcggcttctatggagtgagcagccagtatgagagcctggagcacatgaccctgacctgcagcagcaaggtgtgcagctttgggaagcaggtggtggagaaggtggagacagagcgggcccagctggaggatggccgctttgtgtaccgcctgctgcggagccccatgtgtgagtacctggtgaacttcctgcacaagctgcggcagctgcctgagcgctacatgatgaacagcgtgctggagaacttcaccatcctgcaggtggtgaccaacagagacacccaggagctgctgctgtgcacagcctacgtgtttgaggtgtccaccagcgagcggggggcccagcaccacatctaccgcctggtgcgggactag

SEQ ID NO: 172860 - DNA, 1356 bp, Artificial Sequence; identical to SEQ ID NO: 172859
  Description of Artificial Sequence: Synthetic coding sequence

SEQ ID NO: 172861 - DNA, 1353 bp, Artificial Sequence; identical to SEQ ID NO: 172857
  Description of Artificial Sequence: Synthetic coding sequence

SEQ ID NO: 172862 - DNA, 1308 bp, Artificial Sequence
  Description of Artificial Sequence: Synthetic coding sequence
attgccagcaacagctggaatgccagcagcagccctggagaggccagagaagatggccctgagggcctggacaagggcctggacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggccaggaagaaggtgcgggagtaccaggtgggcatcaaggccatgaacctggaccaggtgtccaaggacaaggccctgcagagcatggcctccatgagcagcgcccagatcgtgtctgcctctgtgctgcagaacaagttcagcccccccagccccctgccccaggccgtgttcagcaccagcagccgcttctggagcagcccccccctgctgggccagcagcccggccccagccaggacatcaagccctttgcccagcctgcctaccccatccagccccccctgccccccaccctgagcagctatgagcccctggcccccctgcccagcgctgctgcctctgtgcctgtgtggcaggacaggaccatcgccagcagccggctgcggctgctggagtacagcgccttcatggaggtgcagagggaccctgacacctacagcaagcacctgtttgtgcacatcggccagaccaacccagccttcagtgacccccccctggaggccgtggatgtgcggcagatctatgacaagtttcctgagaagaagggcggcctgaaggagctgtatgagaagggccccccaaatgccttcttcctggtgaagttctgggccgacctgaacagcaccatccaggagggccctggggccttctatggagtgagcagccagtacagcagcgctgacagcatgaccatctctgtgtccaccaaggtgtgcagctttgggaagcaggtggtggagaaggtggagacagaatatgcccggctggagaatggccgctttgtgtaccgcatccacaggagccccatgtgtgagtacatgatcaacttcatccacaagctgaagcacctgcctgagaagtacatgatgaacagcgtgctggagaacttcaccatcctgcaggtggtgaccagccgggacagccaggagaccctgctggtgattgcctttgtgtttgaggtgtccaccagcgagcacggggcccagcaccacgtgtacaagctggtgaaggactag

SEQ ID NO: 172863 - DNA, 1356 bp, Artificial Sequence
  Description of Artificial Sequence: Synthetic coding sequence
ctgagcaggcctgtgggcagcggccctgagccccgggccaccagcaccatcgccagcaacagctggaatgccagcagcagccctggagaggccagagaagatggccctgagggcctggacaagggcctggacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacctgcaggtgctggcccggaggaagagccgggagatccagagcaagctgaagagcagcccccaggaccaggtgtccaaggacaaggccctgcagagcatggcctccatgagcagcgcccagatcgtgtctgcctctgtgctgcagaacaagttcagcccccccagccccctgccccaggccgtgttcagcaccagcagccgcttctggagcagcccccccctgctgggccagcagcccggccccagccaggacatcaagccctttgcccagcctgcctaccccatccagccccccctgccccccaccctgagcagctatgagcccctggcccccctgcccagcgctgctgcctctgtgcctgtgtggcaggacaggaccatcgccagcagccggctgcggctgctggagtacagcgccttcatggaggtgcagagggaccctgacacctacagcaagcacctgtttgtgcacatcggccagaccaacccagccttcagtgacccccccctggaggccgtggatgtgcggcagatctatgacaagtttcctgagaagaagggcggcctgaaggagctgtatgagaagggccccccaaatgccttcttcctggtgaagttctgggccgacctgaacagcaccatccaggagggccctggggccttctatggagtgagcagccagtacagcagcgctgacagcatgaccatctctgtgtccaccaaggtgtgcagctttgggaagcaggtggtggagaaggtggagacagaatatgcccggctggagaatggccgctttgtgtaccgcatccacaggagccccatgtgtgagtacatgatcaacttcatccacaagctgaagcacctgcctgagaagtacatgatgaacagcgtgctggagaacttcaccatcctgcaggtggtgaccagccgggacagccaggagaccctgctggtgattgcctttgtgtttgaggtgtccaccagcgagcacggggcccagcaccacgtgtacaagctggtgaaggactag

SEQ ID NO: 172864 - DNA, 1176 bp, Artificial Sequence
  Description of Artificial Sequence: Synthetic coding sequence
ctggagggcacagctggcaccatcaccagcaatgagtggagcagccccaccagccctgagggcagcacagccagcggcggcagccaggccctggacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaaggcccgggagatccaggccaagctgaagttctggcagggcgccctgcccggccaggccggcaccagccatgatgtgaagcccttcagccagcagacctatgctgtgcagccccccctgcccctgcccggctttgagagccctgctggccctgcccccagccccagcgcccccccagccccaccctggcagggccgctctgtggccagcagcaagctgtggatgctggagttcagcgccttcctggagcagcagcaggaccctgacacctacaacaagcacctgtttgtgcacatcggccagagcagccccagctacagcgacccctacctggaggccgtggacatccggcagatctatgacaagtttcctgagaagaagggcggcctgaaggacctgtttgagcggggccccagcaatgccttcttcctggtgaagttctgggccgacctgaacaccaacattgaagatgagggcagcagcttctatggagtgagcagccagtatgagagccctgagaacatgatcatcacctgcagcaccaaggtgtgcagctttgggaagcaggtggtggagaaggtggagacagaatatgcccgctatgaaaatggccactacagctaccgcatccacaggagccccctgtgtgagtacatgatcaacttcatccacaagctgaagcacctgcctgagaagtacatgatgaacagcgtgctggagaacttcaccatcctgcaggtggtgaccaacagagacacccaggagaccctgctgtgcatcgcctacgtgtttgaggtgtctgccagcgagcacggggcccagcaccacatctaccgcctggtgaaggagtag

SEQ ID NO: 172865 - DNA, 1305 bp, Artificial Sequence
  Description of Artificial Sequence: Synthetic coding sequence
ctggagggcacagctggcaccatcaccagcaatgagtggagcagccccaccagccctgagggcagcacagccagcggcggcagccaggccctggacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaaggcccgggagatccaggccaagctgaaggaccaggccgccaaggacaaggccctgcagagcatggccgccatgagcagcgcccagatcatcagcgccacagccttccacagctccatggccctggcccggggccctggccggcctgctgtgtctggcttctggcagggcgccctgcccggccaggccggcaccagccatgatgtgaagcccttcagccagcagacctatgctgtgcagccccccctgcccctgcccggctttgagagccctgctggccctgcccccagccccagcgcccccccagccccaccctggcagggccgctctgtggccagcagcaagctgtggatgctggagttcagcgccttcctggagcagcagcaggaccctgacacctacaacaagcacctgtttgtgcacatcggccagagcagccccagctacagcgacccctacctggaggccgtggacatccggcagatctatgacaagtttcctgagaagaagggcggcctgaaggacctgtttgagcggggccccagcaatgccttcttcctggtgaagttctgggccgacctgaacaccaacattgaagatgagggcagcagcttctacggcgtgagcagccagtatgagagccctgagaacatgatcatcacctgcagcaccaaggtgtgcagctttgggaagcaggtggtggagaaggtggagacagaatatgcccgctatgaaaatggccactacagctaccgcatccacaggagccccctgtgtgagtacatgatcaacttcatccacaagctgaagcacctgcctgagaagtacatgatgaacagcgtgctggagaacttcaccatcctgcaggtggtgaccaacagagacacccaggagaccctgctgtgcatcgcctacgtgtttgaggtgtctgccagcgagcacggggcccagcaccacatctaccgcctggtgaaggagtag

SEQ ID NO: 172866 - DNA, 918 bp, Artificial Sequence
  Description of Artificial Sequence: Synthetic coding sequence
atggccgccatgagcagcgcccagatcatcagcgccacagccttccacagctccatggccctggcccggggccctggccggcctgctgtgtctggcttctggcagggcgccctgcccggccaggccggcaccagccatgatgtgaagcccttcagccagcagacctatgctgtgcagccccccctgcccctgcccggctttgagagccctgctggccctgcccccagccccagcgcccccccagccccaccctggcagggccgctctgtggccagcagcaagctgtggatgctggagttcagcgccttcctggagcagcagcaggaccctgacacctacaacaagcacctgtttgtgcacatcggccagagcagccccagctacagcgacccctacctggaggccgtggacatccggcagatctatgacaagtttcctgagaagaagggcggcctgaaggacctgtttgagcggggccccagcaatgccttcttcctggtgaagttctgggccgacctgaacaccaacattgaagatgagggcagcagcttctatggagtgagcagccagtatgagagccctgagaacatgatcatcacctgcagcaccaaggtgtgcagctttgggaagcaggtggtggagaaggtggagacagaatatgcccgctatgaaaatggccactacagctaccgcatccacaggagccccctgtgtgagtacatgatcaacttcatccacaagctgaagcacctgcctgagaagtacatgatgaacagcgtgctggagaacttcaccatcctgcaggtggtgaccaacagagacacccaggagaccctgctgtgcatcgcctacgtgtttgaggtgtctgccagcgagcacggggcccagcaccacatctaccgcctggtgaaggagtag

SEQ ID NO: 172867 - DNA, 219 bp, Artificial Sequence
  Description of Artificial Sequence: Synthetic coding sequence
ctggagggcacagctggcaccatcaccagcaatgagtggagcagccccaccagccctgagggcagcacagccagcggcggcagccaggccctggacaagcccatcgacaatgatgctgagggcgtgtggagcccagacatcgagcagagcttccaggaggccctggccatctacccaccctgtggccgcaggaagatcatcctgagtgatgagggctag

SEQ ID NO: 172868 - DNA, 69 bp, Artificial Sequence
  Description of Artificial Sequence: Synthetic coding sequence
ctggagggcacagctggcaccatcaccagcaatgagtggagcagccccaccagccctgagggcagctag

SEQ ID NO: 172869 - DNA, 528 bp, Artificial Sequence
  Description of Artificial Sequence: Synthetic coding sequence
ctggagggcacagctggcaccatcaccagcaatgagtggagcagccccaccagccctgagggcagcacagccagcggcggcagccaggccctggacaagcccatcgacaatgatgctgagggcgtgtggagcccagacatcgagcagagcttccaggaggccctggccatctacccaccctgtggccgcaggaagatcatcctgagtgatgagggcaagatgtatggaagaaatgagctgattgcccgctacatcaagctgaggacaggcaagaccaggaccaggaagcaggtgagcagccacatccaggtgctggcccggaggaaggcccgggagatccaggccaagctgaaggaccaggccgccaaggacaaggccctgcagagcatggccgccatgagcagcgcccagatcatcagcgccacagccttccacagctccatggccctggcccggggccctggccggcctgctgtgtctggcttctggcagggcgccctgcccggccaggccggcaccagccactag

SEQ ID NO: 172870 - DNA, 3099 bp, Artificial Sequence
  Description of Artificial Sequence: Synthetic coding sequence
atgtgcaatgaggagacagagatcaaggaggcccagagctaccagaacagccctgtgtcctctgccaccaaccaggatgctggctacggcagccccttcagcgagagcagtgaccagctggcccacttcaagggcagcagcagccgggaggagaaggaggacccccagtgcccagacagcgtgtcctacccccaggacagcctggcccagatcaaggctgtgtatgccaacctcttcagcgagagctgctggagcagcctggccctggacctgaagaagagcggcagcaccaccagcaccaatgatgccagccagaaggagagcagcgcccccacccccaccccacccacctgccctgtgtccaccaccggccccaccaccagcacccccagcaccagctgcagcagcagcaccagccacagcagcaccaccagcaccagcagcagcagcggctatgactggcaccaggccgccctggccaagaccctgcagcagaccagcagctatggcctgctgcctgagcccagcctcttcagcacagtgcagctgtaccggcagaacaacaagctgtatggctctgtgttcaccggggccagcaagttccgctgcaaggactgcagcgctgcctatgacaccctggtggagctgactgtgcacatgaatgaaacaggccactacagagatgacaacagagacaaggacagcgagaagaccaagcgctggagcaagcccaggaagaggagcctgatggagatggagggcaaggaggatgcccagaaggtgctgaagtgcatgtactgcggccacagctttgagagcctgcaggacctgtctgtgcacatgatcaagaccaagcactaccagaaggtgcccctgaaggagcctgtgcctgccatcaccaagctggtgcccagcaccaagaagagggccctgcaggacctggccccaccctgcagccctgagcctgctggcatggctgctgaggtggccctgtctgagagcgccaaggaccagaaggccgccaacccctacgtgacccccaacaacagatatggctaccagaatggagccagctacacctggcagtttgaggccaggaaggcccagatcctgaagtgcatggagtgtggcagcagccatgacaccctgcagcagctgacagcccacatgatggtgacaggccacttcctgaaggtgaccaccagcgccagcaagaagggcaagcagctggtgctggaccctgtggtggaggagaagatccagagcatccccctgccccccaccacccacacccggctgcctgccagcagcatcaagaagcagcctgacagccctgctggcagcaccaccagcgaggagaagaaggagcctgagaaggagaagccccctgtggccggagatgctgagaagatcaaggaggagagcgaggacagcctggagaagtttgagcccagcaccctgtacccctacctgcgggaggaggacctggatgacagccccaagggcggcctggacatcctgaagagcctggagaacacagtgtccacagccatcagcaaggcccagaatggagcccccagctggggcggctaccccagcatccacgccgcctaccagctgcccggcaccgtgaagcccctgcctgctgctgtgcagagcgtgcaggtgcagcccagctatgctgggggcgtgaagagcctgagcagcgctgagcacaatgccctgctgcacagccctggcagcctgaccccaccaccccacaagagcaatgtgtctgccatggaggagctggtggagaaggtgacaggcaaggtgaacatcaagaaggaggagaggcctcctgagaaggagaagagcagcctggccaaggccgccagccccatcgccaaggagaacaaggacttccccaagacagaggaggtgtctgggaagccccagaagaagggccctgaggccgagaccgggaaggccaagaaggagggccccctggatgtgcacaccccaaatggaacagagcccctgaaggccaaggtgaccaacggctgcaacaacctgggcatcatcatggaccacagccctgagcccagcttcatcaaccccctgagcgccctgcagagcatcatgaacacccacctgggcaaggtgtccaagcctgtgagccccagcctggaccccctggccatgctgtacaagatcagcaacagcatgctggacaagcctgtgtacccagccacccctgtgaagcaggctgatgccatcgaccgctactactatgaaaattctgaccagcccatcgacctgaccaagagcaagaacaagcccctggtgtcctctgtggccgacagcgtggccagccccctgcgggagagcgccctgatggacatcagtgacatggtgaagaacctgaccggccgcctgacccccaagagcagcacccccagcacagtgtctgagaagagtgatgctgatggcagcagctttgaggaggccctggatgagctgagccctgtgcacaagaggaagggccggcagagcaactggaacccccagcacctgctgatcctgcaggcccagtttgccagcagcctgcgggagaccacagagggcaagtacatcatgtctgacctgggcccccaggagcgggtgcacatcagcaagttcaccggcctgtccatgaccaccatcagccactggctggccaacgtgaagtaccagctgcggaggactggaggcaccaagttcctgaagaacctggacaccggccaccctgtgttcttctgcaatgactgtgccagccagttcagaacagccagcacctacatcagccacctggagacccacctgggcttcagcctgaaggacctgagcaagctgcccctgaaccagatccaggagcagcagaatgtgtccaaggtgctgaccaacaagaccctgggccccctgggcgccacagaggaggacctgggcagcaccttccagtgcaagctgtgcaacagaacatttgccagcaagcatgctgtgaagctgcacctgagcaagacccacggcaagagccctgaggaccacctgatctacgtgacagagctggagaagcagtag

SEQ ID NO: 172871 - DNA, 237 bp, Artificial Sequence
  Description of Artificial Sequence: Synthetic coding sequence
atgtgcaatgaggagacagagatcaaggaggcccagagctaccagaacagccctgtgtcctctgccaccaaccaggatgctggctacggcagccccttcagcgagagcagtgaccagctggcccacttcaagggcagcagcagccgggaggagaaggaggacccccagtgcccagacagcgtgtcctacccccaggacagcctggcccagatcaaggctgtgtatgccaacctgtag

SEQ ID NO: 172872 - DNA, 321 bp, Artificial Sequence
  Description of Artificial Sequence: Synthetic coding sequence
atgtgcaatgaggagacagagatcaaggaggcccagagctaccagaacagccctgtgtcctctgccaccaaccaggatgctggctacggcagccccttcagcgagagcagtgaccagctggcccacttcaagggcagcagcagccgggaggagaaggaggacccccagtgcccagacagcgtgtcctacccccaggacagcctggcccagatcaaggctgtgtatgccaacctcttcagcgagagctgctggagcagcctggccctggacctgaagaagagcggcagcaccaccagcaccaatgatgccagccagaagtag

SEQ ID NO: 172873 - DNA, 3096 bp, Artificial Sequence
  Description of Artificial Sequence: Synthetic coding sequence
atgatggccgccgccctgctgcactacacaggctacgcccaggaggagcagctgaaggaggaggaggagatcaaggaggaggaggaggaggaggacagcggctctgtggcccagctgcagggcggcaatgacacaggaacagatgaggagctggagactggacctgagcagaagggctgcttctcctaccagaacagccctggcagccacctgagcaaccaggatgctgaaaatgaaagcctgctgagtgatgccagtgaccaggtgtctgacatcaagtctgtgtgtggcagagatgccagtgacaagaaggcccacacccacgtgcggctgcccaatgaggcccacaactgcatggacaagatgacagctgtgtatgccaacatcctgagtgacagctactggagcggcctgggcctgggcttcaagctgagcaacagcgagaggaggaactgtgacaccagaaatggcagcaacaagagtgactttgactggcaccaggatgccctgagcaagagcctgcagcagaacctgcccagccgctctgtgtccaagcccagcctcttcagctctgtgcagctgtaccggcagagcagcaagatgtgtggcaccgtcttcaccggggccagccgcttccgctgccggcagtgcagcgctgcctatgacaccctggtggagctgactgtgcacatgaatgagaccggccactaccaggatgacaacaggaagaaggacaagctgcggcccaccagctacagcaagcccaggaagagggccttccaggacatggacaaggaggatgcccagaaggtgctgaagtgcatgttctgtggggacagctttgacagcctgcaggacctgtctgtgcacatgatcaagaccaagcactaccagaaggtgcccctgaaggagcctgtgcccaccatcagcagcaagatggtgaccccagccaagaagagggtgtttgatgtgaaccggccctgcagcccagacagcaccaccggcagctttgctgacagcttcagcagccagaagaatgccaacctgcagctgagcagcaacaacagatatggctaccagaatggagccagctacacctggcagtttgaggcctgcaagagccagatcctgaagtgcatggagtgtggcagcagccatgacaccctgcagcagctgaccacccacatgatggtgacaggccacttcctgaaggtgaccagcagcgccagcaagaagggcaagcagctggtgctggaccccctggccgtggagaagatgcagagcctgtctgaggcccccaacagcgacagcctggcccccaagcccagcagcaacagcgccagtgactgcacagccagcaccacagagctgaagaaggagagcaagaaggagaggcctgaggagaccagcaaggatgagaaggtggtgaagtcagaagattatgaggaccccctgcagaagcccctggaccccaccatcaagtaccagtacctgcgggaggaggacctggaggatggcagcaagggcggcggggacatcctgaagagcctggagaacacagtgaccacagccatcaacaaggcccagaatggagcccccagctggagcgcctaccccagcatccatgctgcctaccagctgtctgagggcaccaagccacccctgcccatgggcagccaggtgctgcagatccggcccaacctgaccaacaagctgcggcccatcgcccccaagtggaaggtgatgcccctggtgtccatgcccacccacctggccccctacacccaggtgaagaaggagagcgaggacaaggatgaagctgtgaaggaatgtgggaaggagagcccccatgaggaggccagcagcttcagccacagcgagggggacagcttcaggaagtctgagaccccacctgaggccaagaagacagagctgggccccctgaaggaggaggagaagctgatgaaggagggcagcgagaaggagaagccccagcccctggagcccaccagcgccctgagcaatggctgtgccctggccaaccacgccccagccctgccctgcatcaaccccctgagcgccctgcagagcgtgctgaacaaccacctgggcaaggccacagagcccctgcggagccccagctgcagcagccccagcagcagcaccatctccatgttccacaagagcaacctgaatgtgatggacaagcctgtgctgagccctgccagcaccaggtctgcctctgtgtcccggcgctacctgtttgagaacagcgaccagcccatcgacctgaccaagagcaagagcaagaaggccgagagcagccaggcccagagctgcatgagccccccccagaagcacgccctgagtgacattgctgacatggtgaaggtgctgcccaaggccaccacccccaagccagccagcagcagccgggtgccccccatgaagctggagatggatgtgagaagatttgaagatgtgagcagcgaggtgtccaccctgcacaagaggaagggccggcagagcaactggaacccccagcacctgctgatcctgcaggcccagtttgccagcagcctcttccagaccagcgagggcaagtacctgctgagtgacctgggcccccaggagaggatgcagatcagcaagttcaccggcctgtccatgaccaccatcagccactggctggccaacgtgaagtaccagctgaggaagacaggaggcaccaagttcctgaagaacatggacaagggccaccccatcttctactgcagcgactgtgccagccagttccgcacccccagcacctacatcagccacctggagagccacctgggcttccagatgaaggacatgacccggctgtctgtggaccagcagagcaaggtggagcaggagatcagccgggtgtcctctgcccagaggagccctgagaccatcgctgctgaggaggacacagacagcaagttcaagtgcaagctgtgctgcaggacctttgtgtccaagcatgctgtgaagctgcacctgagcaagacccacagcaagagccctgagcaccacagccagtttgtgacagatgtggatgaggagtag

SEQ ID NO: 172874 - DNA, 3105 bp, Artificial Sequence
  Description of Artificial Sequence: Synthetic coding sequence
atgcccaggaggaagcagcaggcccccaagagagctgctggctacgcccaggaggagcagctgaaggaggaggaggagatcaaggaggaggaggaggaggaggacagcggctctgtggcccagctgcagggcggcaatgacaccggcacagatgaggagctggagaccggccctgagcagaagggctgcttctcctaccagaacagccctggcagccacctgagcaaccaggatgctgaaaatgaaagcctgctgagtgatgccagtgaccaggtgtctgacatcaagtctgtgtgtggcagagatgccagtgacaagaaggcccacacccacgtgcggctgcccaatgaggcccacaactgcatggacaagatgacagctgtgtatgccaacatcctgagtgacagctactggagcggcctgggcctgggcttcaagctgagcaacagcgagaggaggaactgtgacaccagaaatggcagcaacaagagtgactttgactggcaccaggatgccctgagcaagagcctgcagcagaacctgcccagccgctctgtgtccaagcccagcctcttcagctctgtgcagctgtaccggcagagcagcaagatgtgtggcaccgtcttcaccggggccagccgcttccgctgccggcagtgcagcgctgcctatgacaccctggtggagctgactgtgcacatgaatgaaacaggccactaccaggatgacaacaggaagaaggacaagctgcggcccaccagctacagcaagcccaggaagagggccttccaggacatggacaaggaggatgcccagaaggtgctgaagtgcatgttctgtggggacagctttgacagcctgcaggacctgtctgtgcacatgatcaagaccaagcactaccagaaggtgcccctgaaggagcctgtgcccaccatcagcagcaagatggtgaccccagccaagaagagggtgtttgatgtgaaccggccctgcagcccagacagcaccaccggcagctttgctgacagcttcagcagccagaagaatgccaacctgcagctgagcagcaacaacagatatggctaccagaatggagccagctacacctggcagtttgaggcctgcaagagccagatcctgaagtgcatggagtgtggcagcagccatgacaccctgcagcagctgaccacccacatgatggtgacaggccacttcctgaaggtgaccagcagcgccagcaagaagggcaagcagctggtgctggaccccctggccgtggagaagatgcagagcctgtctgaggcccccaacagcgacagcctggcccccaagcccagcagcaacagcgccagtgactgcacagccagcaccacagagctgaagaaggagagcaagaaggagaggcctgaggagaccagcaaggatgagaaggtggtgaagtctgaggactatgaggaccccctgcagaagcccctggaccccaccatcaagtaccagtacctgcgggaggaggacctggaggatggcagcaaaggaggaggagacatcctgaagagcctggagaacacagtgaccacagccatcaacaaggcccagaatggagcccccagctggagcgcctaccccagcatccacgccgcctaccagctgtctgagggcaccaagccacccctgcccatgggcagccaggtgctgcagatccggcccaacctgaccaacaagctgcggcccatcgcccccaagtggaaggtgatgcccctggtgtccatgcccacccacctggccccctacacccaggtgaagaaggagagcgaggacaaggatgaggccgtgaaggaatgtgggaaggagagcccccatgaggaggccagcagcttcagccacagcgagggggacagcttcaggaagtctgagaccccacctgaggccaagaagacagagctgggccccctgaaggaggaggagaagctgatgaaggagggcagcgagaaggagaagccccagcccctggagcccaccagcgccctgagcaatggctgtgccctggccaaccacgccccagccctgccctgcatcaaccccctgagcgccctgcagagcgtgctgaacaaccacctgggcaaggccacagagcccctgcggagccccagctgcagcagccccagcagcagcaccatctccatgttccacaagagcaacctgaatgtgatggacaagcctgtgctgagccctgccagcaccaggtctgcctctgtgagccgccgctacctgtttgaaaattctgaccagcccatcgacctgaccaagagcaagagcaagaaggccgagagcagccaggcccagagctgcatgagccccccccagaagcacgccctgagtgacattgctgacatggtgaaggtgctgcccaaggccaccacccccaagccagccagcagcagccgggtgccccccatgaagctggagatggatgtgagaagatttgaagatgtgtcctctgaggtgtccaccctgcacaagaggaagggccggcagagcaactggaacccccagcacctgctgatcctgcaggcccagtttgccagcagcctcttccagaccagcgagggcaagtacctgctgagtgacctgggcccccaggagaggatgcagatcagcaagttcaccggcctgtccatgaccaccatcagccactggctggccaacgtgaagtaccagctgaggaagacaggaggcaccaagttcctgaagaacatggacaagggccaccccatcttctactgcagcgactgtgccagccagttccgcacccccagcacctacatcagccacctggagagccacctgggcttccagatgaaggacatgacccggctgtctgtggaccagcagagcaaggtggagcaggagatcagccgggtgagcagcgcccagaggagccctgagaccatcgctgctgaggaggacacagacagcaagttcaagtgcaagctgtgctgcaggacctttgtgtccaagcatgctgtgaagctgcacctgagcaagacccacagcaagagccctgagcaccacagccagtttgtgacagatgtggatgaggagtag

SEQ ID NO: 172875 - DNA, 3246 bp, Artificial Sequence
  Description of Artificial Sequence: Synthetic coding sequence
atgcccaggaggaagcagcaggccccccggcgggctgctgcctacgtgtctgaggagctgaaggctgctgccctggtggatgagggcctggaccctgaggagcacacagcagatggagagcccagcgccaagtacatgtgcccagagaaggagctggcccgggcctgccccagctaccagaacagccctgctgctgagttcagctgccacgagatggacagcgagagccacatcagcgagaccagtgacaggatggctgactttgagagcggcagcatcaagaatgaggaggagaccaaggaggtgacagtgcccctggaggacaccaccgtgtctgacagcctggagcagatgaaggctgtgtacaacaacttcctgagcaacagctactggagcaacctgaacctgaacctgcaccagcccagcagcgagaagaacaacggcagcagcagcagcagcagcagcagcagcagcagctgtggcagcggcagctttgactggcaccagagcgccatggccaagaccctgcagcaggtgtcccagagcaggatgctgcctgagcccagcctcttcagcacagtgcagctgtaccggcagagcagcaagctgtatggcagcatcttcaccggggccagcaagttccgctgcaaggactgcagcgctgcctatgacaccctggtggagctgactgtgcacatgaatgagaccggccactacagagatgacaaccacgagacagacaacaacaaccccaagcgctggagcaagcccaggaagaggagcctgctggagatggagggcaaggaggatgcccagaaggtgctgaagtgcatgtactgcggccacagctttgagagcctgcaggacctgtctgtgcacatgatcaagaccaagcactaccagaaggtgcccctgaaggagcctgtgacccctgtggccgccaagatcatcccagccaccaggaagaaggccagcctggagctggagctgcccagcagcccagacagcactggaggcacccccaaggccaccatcagtgacaccaatgatgccctgcagaagaacagcaacccctacatcacccccaacaacagatatggccaccagaatggagccagctatgcctggcactttgaggccaggaagagccagatcctgaagtgcatggagtgtggcagcagccatgacaccctgcaggagctgacagcccacatgatggtgacaggccacttcatcaaggtgaccaacagcgccatgaagaagggcaagcccatcgtggagacccctgtgacccccaccatcaccaccctgctggatgagaaggtgcagagcgtgcccctggccgccaccaccttcaccagccccagcaacaccccagccagcatcagccccaagctgaatgtggaggtgaagaaggaggtggacaaggagaaggctgtgacagatgagaagcccaagcagaaggacaagccaggagaggaggaggagaagtgtgacatcagcagcaagtaccactacctgacagaaaatgacctggaggagagccccaagggcggcctggacatcctgaagagcctggagaacacagtgaccagcgccatcaacaaggcccagaatggcacccccagctggggcggctaccccagcatccacgccgcctaccagctgcccaacatgatgaagctgagcctgggcagcagcggcaagagcacccccctgaagcccatgtttggaaacagcgagatcgtgagccccaccaagaaccagaccctggtgagcccccccagcagccagaccagccccatgcccaagaccaacttccacgccatggaggagctggtgaagaaggtgacagagaaggtggccaaggtggaggagaagatgaaggagccagatggcaagctgagcccccccaagagggccacccccagcccctgcagcagcgaggtgggggagcccatcaagatggaggccagcagtgatggcggcttccgcagccaggagaacagccccagccccccaagagatggctgcaaggatggcagccccctggccgagcctgtggagaatggcaaggagctggtgaagcccctggccagcagcctgagcggcagcacagccatcatcacagaccaccccccagagcagccctttgtgaaccccctgagcgccctgcagagcgtgatgaacatccacctgggcaaggccgccaagcccagcctgcctgccctggaccccatgtccatgctgttcaagatgagcaacagcctggccgagaaggctgctgtggccaccccaccacccctgcagagcaagaaggctgaccacctggaccgctacttctaccacgtgaacaatgaccagcccatcgacctgaccaagggcaagagtgacaagggctgcagcctgggctctgtgctgctgagccccaccagcacagccccagccaccagcagcagcacagtgaccacagccaagaccagcgctgtggtgtccttcatgagcaacagccccctgagagaaaatgccctgagtgacatcagtgacatgctgaagaacctgacagagagccacaccagcaagagcagcacccccagcagcatcagcgagaagagtgacattgatggagccaccctggaggaggccgaggagagcaccccagcccagaagaggaagggccggcagagcaactggaacccccagcacctgctgatcctgcaggcccagtttgctgccagcctgcggcagaccagcgagggcaagtacatcatgtctgacctgagcccccaggagaggatgcacatcagccgcttcaccggcctgtccatgaccaccatcagccactggctggccaacgtgaagtaccagctgcggaggactggaggcaccaagttcctgaagaacctggacaccggccaccctgtgttcttctgcaatgactgtgccagccagatccgcacccccagcacctacatcagccacctggagagccacctgggcttccggctgcgggacctgagcaagctgagcacagagcagatcaacagccagatcgcccagaccaagagccccagcgagaagatggtgaccagcagccctgaggaggacctgggcaccagctaccagtgcaagctgtgcaacagaacatttgccagcaagcatgctgtgaagctgcacctgagcaagacccacggcaagagccctgaggaccacctgctgtatgtgtctgagctggagaagcagtag

SEQ ID NO: 172876 - DNA, 1896 bp, Artificial Sequence
  Description of Artificial Sequence: Synthetic coding sequence
atgaacttcaacaccatcctggaggagatcctgatcaagaggagccagcagaagaagaagaccagccccctgaactacaaggagcggctgtttgtgctgaccaagtccatgctgacctactatgagggccgggcagagaagaagtacaggaagggcttcattgatgtgtccaagatcaagtgtgtggagatcgtgaagaatgatgatggagtcatcccctgccagaacaagtaccccttccaggtggtgcatgatgccaacaccctgtacatctttgcccccagcccccagagccgggacctgtgggtgaagaagctgaaggaggagatcaagaacaacaacaacatcatgatcaagtaccaccccaagttctggacagatggcagctaccagtgctgccggcagacagagaagctggcccctggctgtgagaagtacaacctgtttgagagcagcatcaggaaggccctgcccccagcccctgagaccaagaagaggcggcccccaccacccatccccctggaggaggaggacaacagcgaggagatcgtggtggccatgtatgacttccaggccgctgagggccatgacctgcggctggagcggggccaggagtacctgatcctggagaagaatgatgtgcactggtggagggcccgggacaagtatggaaatgaaggctacatccccagcaactacgtgacaggcaagaagagcaacaacctggaccagtatgagtggtactgcaggaacatgaacagaagcaaggccgagcagctgctgcggtctgaggacaaggagggcggcttcatggtgcgggacagcagccagcccggcctgtacacagtgtccctgtacaccaagtttggaggagagggcagcagcggcttccgccactaccacatcaaggagaccaccaccagccccaagaagtactacctggccgagaagcacgccttcggcagcatccctgagatcatcgagtaccacaagcacaatgctgctggcctggtgacccggctgcgctaccctgtgtctgtgaagggcaagaatgcccccaccacagctggcttctcctatgagaagtgggagatcaaccccagcgagctgaccttcatgagggagctgggcagcggcctgtttggagtggtgcggctgggcaagtggagggcccagtacaaggtggccatcaaggccatccgggagggcgccatgtgtgaggaggacttcatcgaggaggccaaggtgatgatgaagctgacccaccccaagctggtgcagctgtatggagtgtgcacccagcagaagcccatctacatcgtgacagagttcatggagcggggctgcctgctgaacttcctgcggcagaggcagggccacttcagcagagatgtgctgctgtccatgtgccaggatgtgtgtgagggcatggagtacctggagaggaacagcttcatccaccgggacctggccgccaggaactgcctggtgtctgaggccggcgtggtgaaggtgtctgactttggcatggcccgctacgtgctggatgaccagtacaccagcagcagcggggccaagtttcctgtgaagtggtgccccccagaggtgttcaactacagccgcttcagcagcaagagtgatgtgtggagctttggagtgctgatgtgggaggtgttcacagagggccgcatgccctttgagaagtacaccaactatgaggtggtgaccatggtgacccggggccaccggctgtaccagcccaagctggccagcaactacgtgtatgaggtgatgctgcgctgctggcaggagaagccagagggccggcccagctttgaggacctgctgcggaccattgatgagctggtggagtgtgaggagacctttggaagatag

SEQ ID NO: 172877 - DNA, 2094 bp, Artificial Sequence
  Description of Artificial Sequence: Synthetic coding sequence
atgggcttccagcccccagctgccctgctgctgcggctcttcctgctgcagggcatcctgcggctgctgtggggagacctggccttcatcccccccttcatccgcatgagcggccctgctgtgtctgccagcctggtgggggacacagaaggagtgacagtgtccctggccgtgctgcaggatgaagctggcatcctgcccatccccacctgtggggtgctgaacaatgaaacagaggactggagcgtgaccgtcatccctggggccaaggtgctggaggtgacagtgcgctggaagaggggcctggactggtgcagcagcaatgaaacagacagcttcagcgagagcccctgcatcctgcagaccctgctggtgtctgccagccacaacagcagctgcagcgcccacctgctgatccaggtggagatctatgccaacagcagcctgacccacaatgcctctgaaaatgtgaccgtcatccccaaccaggtgtaccagcccctgggcccctgcccctgcaacctgacagctggggcctgtgatgtgcgctgctgctgtgaccaggagtgcagcagcaacctgaccaccctcttcagaagaagctgcttcaccggggtgtttggaggagatgtgaaccccccatttgaccagctgtgcagcgctggcaccaccacccggggcgtgcctgactggttccccttcctgtgtgtgcagagccccctggccaacacccccttcctgggctacttctaccacggggctgtgagccccaagcaggacagcagctttgaggtgtatgtggacacagatgccaaggactttgctgactttggctacaagcagggcgaccccatcatgacagtgaagaaggcctacttcaccatcccccaggtgtccctggccggccagtgcatgcagaatgcccctgtggccttcctgcacaactttgatgtgaagtgtgtgaccaacctggagctgtaccaggagagagatggcatcatcaatgccaagatcaagaatgtggccctgggcggcatcgtgacccccaaggtgatctatgaggaggccacagacctggacaagttcatcaccaacacagagacccccctgaacaacggcagcaccccccgcatcgtgaatgtggaggagcactacatcttcaagtggaacaacaacaccatcagcgagatcaacgtgaagatcttccgggcagagatcaatgcccaccagaagggcatcatgacccagagatttgtggtgaagttcctgagctacaacagcggaaatgaggaggagctgagcggcaaccctggctaccagctgggcaagcctgtgcgggccctgaacatcaacaggatgaacaacgtgaccaccctgcacctgtggcagagcgctggccggggcctgtgcaccagcgccaccttcaagcccatcctgtttggagaaaatgtgctgagcggctgcctgctggaggtgggcatcaatgaaaactgcacccagctgagagaaaatgctgtggagcggctggacagcctcatccaggccacccacgtggccatgaggggcaacagcgactatgctgacctgagtgatggctggctggagatcatccgggtggatgccccagaccccggggctgaccccctggccagctctgtgaatggcatgtgcctggacatcccagcccacctgagcatccgcatcctgatcagtgatgctggagctgtggagggcatcacccagcaggagatcctgggcgtggagacccgcttcagctctgtgaactggcagtaccagtgtggcctgacctgtgagcacaaggctgacctgctgcccatcagcgcctctgtgcagttcatcaagatcccagcccagctgccccaccccctgacccgcttccagatcaactacacagaatatgactgcaacagaaatgaggtgtgctggccccagctgctgtacccctggacccagtactaccagggcgagctgcacagccagtgtgtggccaagggcctgctgctgctgctcttcctgaccctggccctcttcctgagcaacccctggacccgcatctgcaaggcctacagctag

SEQ ID NO: 172878 - DNA, 2091 bp, Artificial Sequence
  Description of Artificial Sequence: Synthetic coding sequence
atgggcttccagcccccagctgccctgctgctgcggctcttcctgctgcagggcatcctgcggctgctgtggggagacctggccttcatcccccccttcatccgcatgagcggccctgctgtgtctgccagcctggtgggggacacagaaggagtgacagtgtccctggccgtgctgcaggatgaagctggcatcctgcccatccccacctgtggggtgctgaacaatgaaacagaggactggagcgtgaccgtcatccctggagctgtgctggaggtgacagtgcgctggaagaggggcctggactggtgcagcagcaatgaaacagacagcttcagcgagagcccctgcatcctgcagaccctgctggtgtctgccagccacaacagcagctgcagcgcccacctgctgatccaggtggagatctatgccaacagcagcctgacccacaatgcctctgaaaatgtgaccgtcatccccaaccaggtgtaccagcccctgggcccctgcccctgcaacctgacagctggggcctgtgatgtgcgctgctgctgtgaccaggagtgcagcagcaacctgaccaccctcttccgccgcagctgcttcaccggggtgtttggaggagatgtgaaccccccatttgaccagctgtgcagcgctggcaccaccacccggggcgtgcctgactggttccccttcctgtgtgtgcagagccccctggccaacacccccttcctgggctacttctaccatggagctgtgagccccaagcaggacagcagctttgaggtgtatgtggacacagatgccaaggactttgctgactttggctacaagcagggcgaccccatcatgacagtgaagaaggcctacttcaccatcccccaggtgtccctggccggccagtgcatgcagaatgcccctgtggccttcctgcacaactttgatgtgaagtgtgtgaccaacctggagctgtaccaggagagagatggcatcatcaatgccaagatcaagaatgtggccctgggcggcatcgtgacccccaaggtgatctatgaggaggccacagacctggacaagttcatcaccaacacagagacccccctgaacaacggcagcaccccaagaattgtgaatgtggaggagcactacatcttcaagtggaacaacaacaccatcagcgagatcaacgtgaagatcttccgggcagagatcaatgcccaccagaagggcatcatgacccagagatttgtggtgaagttcctgagctacaacagcggaaatgaggaggagctgagcggcaaccctggctaccagctgggcaagcctgtgcgggccctgaacatcaacaggatgaacaacgtgaccaccctgcacctgtggcagagcgctggccggggcctgtgcaccagcgccaccttcaagcccatcctgtttggagaaaatgtgctgagcggctgcctgctggaggtgggcatcaatgaaaactgcacccagctgcgggagaatgctgtggagcggctggacagcctcatccaggccacccacgtggccatgaggggcaacagcgactatgctgacctgagtgatggctggctggagatcatccgggtggatgccccagaccctggagctgaccccctggccagctctgtgaatggcatgtgcctggacatcccagcccacctgagcatccgcatcctgatcagtgatgctggagctgtggagggcatcacccagcaggagatcctgggcgtggagacccgcttcagctctgtgaactggcagtaccagtgtggcctgacctgtgagcacaaggctgacctgctgcccatcagcgcctctgtgcagttcatcaagatcccagcccagctgccccaccccctgacccgcttccagatcaactacacagaatatgactgcaacagaaatgaggtgtgctggccccagctgctgtacccctggacccagtactaccagggcgagctgcacagccagtgtgtggccaagggcctgctgctgctgctcttcctgaccctggccctcttcctgagcaacccctggacccgcatctgcaaggcctacagctag

SEQ ID NO: 172879 - DNA, 1824 bp, Artificial Sequence
  Description of Artificial Sequence: Synthetic coding sequence
atgaggaccccccagctggccctgctgcaggtgttcttcctggtgtttcctgatggagtgcggccccagcccagcagcagccccagcggggctgtgcccaccagcctggagctgcagaggggcacagatggcggcaccctgcagagccccagcgaggccacagccaccaggcctgctgtgcccggcctgcccaccgtggtgcccaccctggtgacccccagcgcccctggcaacagaacagtggacctcttccctgtgctgcccatctgtgtgtgtgacctgacccctggggcctgtgacatcaactgctgctgtgaccgggactgctacctgctgcaccccaggacagtgttctccttctgcctgcccggctctgtgcgcagcagctcctgggtgtgtgtggacaacagcgtcatcttccgcagcaacagccccttccccagcagggtcttcatggacagcaatggcatccggcagttctgtgtgcacgtgaacaacagcaacctgaactacttccagaagctgcagaaggtgaatgccaccaacttccaggccctggccgctgagtttggaggagagagcttcaccagcaccttccagacccagagcccccccagcttctaccgggccggggaccccatcctgacctacttccccaagtggagcgtcatcagcctgctgcggcagcctgctggggtgggcgccggcggcctgtgtgccgagagcaacccagctggcttcctggagagcaagagcaccacctgcacccgcttcttcaagaacctggccagcagctgcaccctggacagcgccctgaatgctgccagctactacaacttcaccgtgctgaaggtgcccaggtccatgacagacccccagaacatggagttccaggtgcctgtgatcctgaccagccaggccaatgcccccctgctggccggcaacacctgccagaatgtggtgtcccaggtgacctatgaaattgagaccaacggcaccttcggcatccagaaggtgtctgtgtccctgggccagaccaacctgactgtggagcccggggccagcctgcagcagcacttcatcctgcgcttccgggccttccagcagagcacagctgccagcctgaccagccccaggagcggcaaccctggctacatcgtgggcaagcccctgctggccctgacagatgacatctcctacagcatgaccctgctgcagagccagggcaatggcagctgcagcgtgaagagacatgaggtgcagtttggagtgaatgccatcagcggctgcaagctgcggctgaagaaggctgactgcagccacctgcagcaggagatctaccagaccctgcacggccggcccaggccagaatatgtggccatctttggaaatgctgaccctgcccagaagggcggctggacccgcatcctgaacagacactgcagcatcagcgccatcaactgcaccagctgctgcctgatccctgtgtccctggagatccaggtgctgtgggcctacgtgggcctgctgagcaacccccaggcccacgtgtctggagtgcgcttcctgtaccagtgccagagcatccaggacagccagcaggtgacagaggtgtccctgaccaccctggtgaactttgtggacatcacccagaagccccagcccccccggggccagcccaagatggactggaagtggccctttgacttcttccccttcaaggtggccttcagccggggcgtcttcagccagaagtgcagcgtgagccccatcctgatcctgtgcctgctgctgctgggcgtgctgaacctggagaccatgtag

SEQ ID NO: 172880 - DNA, 1290 bp, Artificial Sequence
  Description of Artificial Sequence: Synthetic coding sequence
atggacagcaatggcatccggcagttctgtgtgcacgtgaacaacagcaacctgaactacttccagaagctgcagaaggtgaatgccaccaacttccaggccctggccgctgagtttggaggagagagcttcaccagcaccttccagacccagagccccccatccttctacagagctggggaccccatcctgacctacttccccaagtggagcgtcatcagcctgctgcggcagcctgctggggtgggcgctgggggcctgtgtgccgagagcaacccagctggcttcctggagagcaagagcaccacctgcacccgcttcttcaagaacctggccagcagctgcaccctggacagcgccctgaatgctgccagctactacaacttcaccgtgctgaaggtgcccaggtccatgacagacccccagaacatggaggtgacctatgaaattgagaccaacggcaccttcggcatccagaaggtgtctgtgtccctgggccagaccaacctgactgtggagcccggggccagcctgcagcagcacttcatcctgcgcttccgggccttccagcagagcacagctgccagcctgaccagccccaggagcggcaaccctggctacatcgtgggcaagcccctgctggccctgacagatgacatctcctacagcatgaccctgctgcagagccagggcaatggcagctgcagcgtgaagagacatgaggtgcagtttggagtgaatgccatcagcggctgcaagctgcggctgaagaaggctgactgcagccacctgcagcaggagatctaccagaccctgcacggccggcccaggccagaatatgtggccatctttggaaatgctgaccctgcccagaagggcggctggacccgcatcctgaacagacactgcagcatcagcgccatcaactgcaccagctgctgcctgatccctgtgtccctggagatccaggtgctgtgggcctacgtgggcctgctgagcaacccccaggcccacgtgtctggagtgcgcttcctgtaccagtgccagagcatccaggacagccagcaggtgacagaggtgtccctgaccaccctggtgaactttgtggacatcacccagaagccccagcccccccggggccagcccaagatggactggaagtggccctttgacttcttccccttcaaggtggccttcagccggggcgtcttcagccagaagtgcagcgtgagccccatcctgatcctgtgcctgctgctgctgggcgtgctgaacctggagaccatgtag

SEQ ID NO: 172881 - DNA, 1332 bp, Artificial Sequence
  Description of Artificial Sequence: Synthetic coding sequence
atgaggaccccccagctggccctgctgcaggtgttcttcctggtgtttcctgatggagtgcggccccagcccagcagcagccccagcggggctgtgcccaccagcctggagctgcagaggggcacagatggcggcaccctgcagagccccagcgaggccacagccaccaggcctgctgtgcccggcctgcccaccgtggtgcccaccctggtgacccccagcgcccctggcaacagaacagtggacctcttccctgtgctgcccatctgtgtgtgtgacctgacccctggggcctgtgacatcaactgctgctgtgaccgggactgctacctgctgcaccccaggacagtgttctccttctgcctgcccggctctgtgcgcagcagctcctgggtgtgtgtggacaacagcgtcatcttccgcagcaacagccccttccccagcagggtcttcatggacagcaatggcatccggcagttctgtgtgcacgtgaacaacagcaacctgaactacttccagaagctgcagaaggtgaatgccaccaacttccaggccctggccgctgagtttggaggagagagcttcaccagcaccttccagacccagagcccccccagcttctaccgggccggggaccccatcctgacctacttccccaagtggagcgtcatcagcctgctgcggcagcctgctggggtgggcgccggcggcctgtgtgccgagagcaacccagctggcttcctggagagcaagagcaccacctgcacccgcttcttcaagaacctggccagcagctgcaccctggacagcgccctgaatgctgccagctactacaacttcaccgtgctgaaggtgcccaggtccatgacagacccccagaacatggagttccaggtgcctgtgatcctgaccagccaggccaatgcccccctgctggccggcaacacctgccagaatgtggtgtcccaggtgacctatgaaattgagaccaacggcaccttcggcatccagaaggtgtctgtgtccctgggccagaccaacctgactgtggagcccggggccagcctgcagcagcacttcatcctgcgcttccgggccttccagcagagcacagctgccagcctgaccagccccaggagcggcaaccctggctacatcgtgggcaagcccctgctggccctgacagatgacatctcctacagcgtgtccttcctggagctgggcggcctgctgcagcccaatgagaagagctgcaagggcttccagacctacgtgcggctggccaagggggaggagttctttgtgcactacaatgaggtgctgatctactag

SEQ ID NO: 172882 - DNA, 1878 bp, Artificial Sequence
  Description of Artificial Sequence: Synthetic coding sequence
atgaggctggagacagctgaggcctacgtgggccctgggggccctgagtgccccatgaggaccccccagctggccctgctgcaggtgttcttcctggtgtttcctgatggagtgcggccccagcccagcagcagccccagcggggctgtgcccaccagcctggagctgcagaggggcacagatggcggcaccctgcagagccccagcgaggccacagccaccaggcctgctgtgcccggcctgcccaccgtggtgcccaccctggtgacccccagcgcccctggcaacagaacagtggacctcttccctgtgctgcccatctgtgtgtgtgacctgacccctggggcctgtgacatcaactgctgctgtgaccgggactgctacctgctgcaccccaggacagtgttctccttctgcctgcccggctctgtgcgcagcagctcctgggtgtgtgtggacaacagcgtcatcttccgcagcaacagccccttccccagcagggtcttcatggacagcaatggcatccggcagttctgtgtgcacgtgaacaacagcaacctgaactacttccagaagctgcagaaggtgaatgccaccaacttccaggccctggccgctgagtttggaggagagagcttcaccagcaccttccagacccagagcccccccagcttctaccgggccggggaccccatcctgacctacttccccaagtggagcgtcatcagcctgctgcggcagcctgctggggtgggcgccggcggcctgtgtgccgagagcaacccagctggcttcctggagagcaagagcaccacctgcacccgcttcttcaagaacctggccagcagctgcaccctggacagcgccctgaatgctgccagctactacaacttcaccgtgctgaaggtgcccaggtccatgacagacccccagaacatggagttccaggtgcctgtgatcctgaccagccaggccaatgcccccctgctggccggcaacacctgccagaatgtggtgtcccaggtgacctatgaaattgagaccaacggcaccttcggcatccagaaggtgtctgtgtccctgggccagaccaacctgactgtggagcccggggccagcctgcagcagcacttcatcctgcgcttccgggccttccagcagagcacagctgccagcctgaccagccccaggagcggcaaccctggctacatcgtgggcaagcccctgctggccctgacagatgacatctcctacagcatgaccctgctgcagagccagggcaatggcagctgcagcgtgaagagacatgaggtgcagtttggagtgaatgccatcagcggctgcaagctgcggctgaagaaggctgactgcagccacctgcagcaggagatctaccagaccctgcacggccggcccaggccagaatatgtggccatctttggaaatgctgaccctgcccagaagggcggctggacccgcatcctgaacagacactgcagcatcagcgccatcaactgcaccagctgctgcctgatccctgtgtccctggagatccaggtgctgtgggcctacgtgggcctgctgagcaacccccaggcccacgtgtctggagtgcgcttcctgtaccagtgccagagcatccaggacagccagcaggtgacagaggtgtccctgaccaccctggtgaactttgtggacatcacccagaagccccagcccccccggggccagcccaagatggactggaagtggccctttgacttcttccccttcaaggtggccttcagccggggcgtcttcagccagaagtgcagcgtgagccccatcctgatcctgtgcctgctgctgctgggcgtgctgaacctggagaccatgtag

SEQ ID NO: 172883 - DNA, 1380 bp, Artificial Sequence
  Description of Artificial Sequence: Synthetic coding sequence
atgaggaccccccagctggccctgctgcaggtgttcttcctggtgtttcctgatggagtgcggccccagcccagcagcagccccagcggggctgtgcccaccagcctggagctgcagaggggcacagatggcggcaccctgcagagccccagcgaggccacagccaccaggcctgctgtgcccggcctgcccaccgtggtgcccaccctggtgacccccagcgcccctggcaacagaacagtggacctcttccctgtgctgcccatctgtgtgtgtgacctgacccctggggcctgtgacatcaactgctgctgtgaccgggactgctacctgctgcaccccaggacagtgttctccttctgcctgcccggctctgtgcgcagcagctcctgggtgtgtgtggacaacagcgtcatcttccgcagcaacagccccttccccagcagggtcttcatggacagcaatggcatccggcagttctgtgtgcacgtgaacaactgcttcctggagagcaagagcaccacctgcacccgcttcttcaagaacctggccagcagctgcaccctggacagcgccctgaatgctgccagctactacaacttcaccgtgctgaaggtgcccaggtccatgacagacccccagaacatggaggccttccagcagagcacagctgccagcctgaccagccccaggagcggcaaccctggctacatcgtgggcaagcccctgctggccctgacagatgacatctcctacagcatgaccctgctgcagagccagggcaatggcagctgcagcgtgaagagacatgaggtgcagtttggagtgaatgccatcagcggctgcaagctgcggctgaagaaggctgactgcagccacctgcagcaggagatctaccagaccctgcacggccggcccaggccagaatatgtggccatctttggaaatgctgaccctgcccagaagggcggctggacccgcatcctgaacagacactgcagcatcagcgccatcaactgcaccagctgctgcctgatccctgtgtccctggagatccaggtgctgtgggcctacgtgggcctgctgagcaacccccaggcccacgtgtctggagtgcgcttcctgtaccagtgccagagcatccaggacagccagcaggtgacagaggtgtccctgaccaccctggtgaactttgtggacatcacccagaagccccagcccccccggggccagcccaagatggactggaagtggccctttgacttcttccccttcaaggtggccttcagccggggcgtcttcagccagaagtgcagcgtgagccccatcctgatcctgtgcctgctgctgctgggcgtgctgaacctggagaccatgtag

SEQ ID NO: 172884 - DNA, 6468 bp, Artificial Sequence
  Description of Artificial Sequence: Synthetic coding sequence
atgaactacagcagcttcctgcgcatctgggtgtccttcatctttgccctggtgcagcaccaggcccagccccgggagctgatgtaccccttctggcagaatgacaccaagacccccaaggtggatgatggcagcagcagcgagatcaagctggccatccctgtgttcttcttcggcgtgccctacagaacagtgtatgtgaacaacaacggggtggtgtccttcaacgtgctggtgtcccagttcaccccagagagcttccccctgacagatggccgggcctttgtggcccccttctgggcagatgtgcacaacggcatccggggggagatctactaccgggagaccatggagcccgccatcctgaagagggccaccaaggacatcaggaagtacttcaaggacatggccaccttcagcgccacctgggtgttcatcgtgacctgggaggaggtgaccttctatggaggcagcagcaccacccctgtgaacaccttccaggccgtgctggtgtctgatggcagctacaccttcaccctcttcaactactatgagatcaactggaccaccggcacagccagcggcggggaccccctgaccggcctgggcggcgtgatggcccaggccggcttcaacggcggcaacctgaccaacttcttcagcctgcccggcagcaggaccccagagatcgtgaacatccaggagaccaccaacgtgaatgtgcccggccgctgggccttcaaggtggatggcaaggagattgatcctgccaacggctgcaccagccggggccagttcctgcggcggggggaggtgttctgggatgacctgaactgcaccgtgaagtgccgctgcctggacttcaacaatgagatctactgccaggaggccagctgcagcccctatgaggtgtgtgagcccaagggcaagttcttctactgcagcgctgtggagaccagcacctgtgtggtgtttggagagccccactaccacacctttgatggcttcctgttccacttccagggcagctgtgcctacctgctggcccggcagtgcctgcagaccagcagcctgcccttcttctctgtggaggccaagaatgagcaccggcggggcagcgctgtgtcctgggtgaaggagctgtctgtggaggtgaatggctacaagatcctgatccccaagggcagctatggccgggtgaaggtgaatgacctggtgaccagcctgcctgtgaccctggacctgggcaccgtgaagatctaccagagcggcatcagcacagctgtggagacagactttggcctgctggtgacctttgatggccagcactacgccagcatctctgtgcccggcagctacatcaacagcacctgtggcctgtgtggcaactacaacaagaaccccctggatgacttcctgcggccagatggccgcccagccatgtctgtgctggacctgggggagagctggagggtgtaccacgccgactggaagtgtgacagcggctgtgtggacaactgcacccagtgtgatgctgccacagaggccctgtactttggaagtgactactgcggcttcctgaacaagacagatggccccctgtgggagtgtggcaccgtggtggaccccacagcctttgtgcacagctgtgtgtatgacctgtgcagcgtgcgggacaatggcaccctgctgtgccaggccatccaggcctatgccctggtgtgccaggccctgggcatccccatcggggactggaggacccagacaggctgtgtgtccacagtgcagtgccccagcttcagccactacagcgtgtgcaccagcagctgcccagacacctgcagcgacctgacagccagcaggaactgtgccaccccctgcacagagggctgtgagtgcaaccagggctttgtgctgagcaccagccagtgtgtgcccctgcacaagtgtggctgtgactttgatggccactactacaccatgggagagttcttctgggccacagccaactgcaccgtgcagtgcctgtgtgaggagggcggagatgtgtactgcttcaacaagacctgtggcagcggggaggtgtgtgctgtggaggatggctaccagggctgcttccccaagcgggagaccgtgtgcctgctgagccagaaccaggtgctgcacacctttgatggagccagctatgccttccccagcgagttctcctacaccctgctgaagacctgcccagagaggcctgagtacctggagattgacatcaacaagaagaagccagatgctggccctgcctggctgcggggcctgcgcatcctggtggccgaccaggaggtgaagattggaggcattggagccagcgaggtgaagctgaatggccaggaggtggagctgcccttcttccaccccagcggcaagctggagatctacagaaacaagaacagcaccaccgtggagagcaagggcgtggtgacagtgcagtacagcgacatcggcctgctgtacatccggctgagcaccacctacttcaactgcacaggaggcctgtgtggcttctacaatgccaatgccagtgatgagttctgcctgcccaacgggaagtgcacagacaacctggccgtgttcctggagagctggaccacctttgaggagatctgcaatggagaatgtggggacctgctgaaggcctgcaacaatgacagcgagctgctgaagttctaccgcagccgcagccgctgtggcatcatcaatgaccccagcaacagcagcttcctggagtgccacggcgtggtgaatgtgacagcctactaccgcacctgcctcttccggctgtgccagagcggcggcaatgaaagtgagctgtgtgacagcgtggcccgctatgccagcgcctgcaagaatgctgatgtggaggtgggcccctggaggacctatgacttctgccccctggagtgcccagagaacagccactttgaggagtgcatcacctgcacagagacctgtgagaccctgaccctgggccccatctgtgtggacagctgcagcgagggctgccagtgtgatgagggctacgccctgctgggcagccagtgtgtgaccaggagtgaatgtggctgcaactttgagggccaccagctggccaccaatgagaccttctgggtggacctggactgccagatcttctgctactgcagcggcacagacaacagagtgcactgtgagaccatcccctgcaaggatgatgagtactgcatggaggagggcggcctgtactactgccaggccaggacagatgccagctgcatcgtgtctggctacggccactacctgacctttgatggcttcccctttgacttccagaccagctgccccctcatcctgtgcaccaccggcagccggcccagcagtgacagcttccccaagtttgtggtgacagccaagaatgaagatcgggaccccagcctggccctgtgggtgaagcaggtggatgtgacagtgtttggctacagcatcgtcatccaccgggcctacaagcacacagtgctggtgaacagcgagcggctgtacctgcccctgaagctgggccagggcaagatcaacatcttctcctttggcttccacgtggtggtggagacagactttggcctgaaggtggtgtatgactggaagaccttcctgagcatcaccgtgcccaggtccatgcagaacagcacctacggcctgtgtggccgctacaatggaaatccagatgatgacctggagatgcccatgggcctgctggccagctctgtgaatgaatttggccagagctgggtgaagagggacaccttctgccaggtgggctgtggggaccgctgccccagctgtgccaaggtggagggcttcagcaaggtgcagcagctgtgcagcctcatccccaaccagaatgctgccttcagcaagtgccacagcaaggtgaaccccaccttcttctacaagaactgcctgtttgacagctgcattgatggcggcgctgtgcagacagcctgctcctggctgcagaactatgccagcacctgccagacccagggcatcaccgtgacaggctggaggaactacaccagctgcaccgtgacctgcccccccaacagccactatgagagctgtgtgtctgtgtgccagccccgctgtgccgccatccggctgaagagtgactgcagccactactgtgtggagggctgccactgtgatgctggctacgtgctgaatggcaagagctgcatcctgccccacagctgtggctgctacagtgatggcaagtactatgagcccaagcagctgttctggaacagcgactgcacccggcgctgccgctgcttcagaagaaatgtcatccagtgtgacccccggcagtgcaagagtgatgaagaatgtgccctgagaaatggagtgcggggctgcttcagcaccaagaccagctactgcctggccgccggcggcggcgtcttccgcacctttgatggagccttcctgcgcttccctgccaactgtgcctttgtgctgagcaccatctgccagaagctgcctgacatctccttccagctgatcatcaactttgacaagtggagcgcccccaacctgaccatcatcagccctgtgtacttctacatcaatgaggagcagatcctgatcaatgacaggaacacagtgaaggtgaatggcacccaggtgaatgtgcccttcatcaccggcctggccaccaagatctacagcagcgagggcttcctggtgattgacaccagcccagacatccagatctactacaacggcttcaacgtcatcaagatcagcatcagcgagcggctgcagaacaaggtgtgtggcctgtgtggcaacttcaacggggacctgacagatgattatgtgaccctgcggggcaagcctgtggtgtcctctgtggtgctggcccagagctggaagaccaacggcatgcagaagaggcccctggcccccagctgcaatgagctgcagttcagccagtatgctgccatgtgtgacaacgtgcacatccagaagatgcagggagatggctactgcctgaagctgacagacatgaagggcttcttccagccctgctacggcctgctggaccccctgcccttctatgagagctgctacctggatggctgctacagccacaagaagttccagctgtgtggcagcctggccgcctatggagaggcctgccgcagctttggcatcctgagcacagagtggattgagaaggagaactgcagcggcgtggtggaggacccctgtgtgggcgctgactgccccaacagaacctgtgagctgggcaatggccgggagctgtgtggctgcatcgagcccccaccctacggcaacaacagccatgacatcattgatgctgaggtgacctgcaaggccgcccagatggaggtgtccatcagcaagtgcaagctgttccagctgggctttgagcgggagggcgtgcgcatcaatgaccggcagtgcaccggcatcgagggggaggacttcatctccttccagatcaacaacaccaagggcaactgtggcaacatcgtgcagagcaatggcacccacatcatgtacaagaacaccctgtggattgagagcgccaacaacacaggcaacatcatcacccgggacaggaccatcaacgtggagttcagctgtgcctatgagctggacatcaagatcagcctggacagcgtggtgaagcccatgctgagcgtcatcaacctgactgtgcccacccaggagggcagcttcatcaccaagatggccctgtacaagaatgccagctacaagcacccctaccggcagggcgaggtggtgctgaccaccagagatgtgctgtatgtgggcgtgtttgtggtgggcgcagatgccacccacctgatcctgaccctgaacaagtgctacgccacccccacccgggacagcaatgacaagctgcgctacttcatcattgaaggaggctgccagaacctgaaggacaacaccatcggcattgaagaaaatgctgtgtccctgacctgccgcttccacgtgacagtgttcaagttcatcggggactatgatgaggtgcacctgcactgtgctgtgtccctgtgtgacagcgagaagtacagctgcaagatcacctgcccccacaacagccgcatcgccacagactacaccaaggagcccaaggagcagatcatctctgtgggccccatccggaggaagaggctggactggtgtgaagataatggaggctgtgagcagatctgcaccagccgggtggatggccccctgtgcagctgtgtgacaggcaccctgcaggaggatggcaagagctgccgggccagcaacagctccatggagctgcaggtgtggaccctgctgctgatcatgatccagatcagcctgtggcactttgtgtacaagagcggcaccaccagctag

SEQ ID NO: 172885 - DNA, 6468 bp, Artificial Sequence; identical to SEQ ID NO: 172884
  Description of Artificial Sequence: Synthetic coding sequence

SEQ ID NO: 172886 - DNA, 1257 bp, Artificial Sequence
  Description of Artificial Sequence: Synthetic coding sequence
atggccaagctgctgcagcccccacccaagttcctgcccagcgagtggcacatcgccaacaagaaccagtaccacagagcagatgcccagaggagccgctctgagcggctggtggccgagagccagaggctggtggatgaaattgagaagaccaccaggaagagccagagtgatgtgaacaagaagctggagcagaggctggaggaggtgcagttctggaagaaggagctggatgacaagctggagcagctggtgaatgtgacagatgacctgctgatctacaagatccggctggagaaggccctggagaccctgaaggagcccctgcacatcacagagacctgcctggcctaccgggagaagagaattggaattgacctggtgcatgacacagtggagcacgagctgatcaaggaggccgagatcatccagggcatcatggccctgctgaccaggaccctggaggaggccagcgagcagatccgcatgaacagaagtgccaagtacaacctggagaaggacctgaaggacaagtttgtggccctgaccattgatgacatctgcttcagcctgaacaacaacagccccaacatccgctacagtgaaaatgctgtgagaattgagcccaacagcgtgtccctggaggactggctggacttcagcagcaccaacgtggagaaggctgacaagcagaggaacaacagcctgatgctgaaggccctggtggaccgcatcctgagccagacagccaatgacctgaggaagcagtgtgatgtggtggacacagccttcaagaatggcctgaaggacaccaaggatgcccgggacaagctggccgaccacctggccaaggtgatggaggagatcgccagccaggagaagaacatcacagccctggagaaggccatcctggaccaggagggccctgccaaggtggcccacacccggctggagaccaggacccaccggcccaacgtggagctgtgcagagatgtggcccagtaccgcctgatgaaggaggtgcaggagatcacccacaacgtggcccggctgaaggagaccctggcccaggcccaggccgagctgaagggcctgcaccggcggcagctggccctgcaggaggagatccaggtgaaggagaacaccatctacattgatgaggtgctgtgcatgcagatgaggaagagcatccccctgagagatggagaagatcatggagtgtgggccggcggcctgcggccagatgctgtgtgctag

SEQ ID NO: 172887 - DNA, 819 bp, Artificial Sequence
  Description of Artificial Sequence: Synthetic coding sequence
atggccctgctgaccaggaccctggaggaggccagcgagcagatccgcatgaacagaagtgccaagtacaacctggagaaggacctgaaggacaagtttgtggccctgaccattgatgacatctgcttcagcctgaacaacaacagccccaacatccgctacagtgaaaatgctgtgagaattgagcccaacagcgtgtccctggaggactggctggacttcagcagcaccaacgtggagaaggctgacaagcagaggaacaacagcctgatgctgaaggccctggtggaccgcatcctgagccagacagccaatgacctgaggaagcagtgtgatgtggtggacacagccttcaagaatggcctgaaggacaccaaggatgcccgggacaagctggccgaccacctggccaaggtgatggaggagatcgccagccaggagaagaacatcacagccctggagaaggccatcctggaccaggagggccctgccaaggtggcccacacccggctggagaccaggacccaccggcccaacgtggagctgtgcagagatgtggcccagtaccgcctgatgaaggaggtgcaggagatcacccacaacgtggcccggctgaaggagaccctggcccaggcccaggccgagctgaagggcctgcaccggcggcagctggccctgcaggaggagatccaggtgaaggagaacaccatctacattgatgaggtgctgtgcatgcagatgaggaagagcatccccctgagagatggagaagatcatggagtgtgggccggcggcctgcggccagatgctgtgtgctag

SEQ ID NO: 172888 - DNA, 1473 bp, Artificial Sequence
  Description of Artificial Sequence: Synthetic coding sequence
atggagcgggtgggctgcaccctgaccaccacctacgcccacccccggcccacccccaccaacttcctgcctgccatcagcaccatggccagcagctacagagaccgcttcccccacagcaacctgacccacagcctgagcctgccctggaggcccagcacctactacaaggtggccagcaacagccccagcgtggccccctactgcaccaggagccagagggtgtctgagaacaccatgctgccctttgtgagcaacagaaccaccttcttcacccgctacaccccagatgactggtaccgcagcaacctgaccaactaccaggagagcaacaccagccgccacaacagcgagaagctgcgggtggacaccagccgcctcatccaggacaagtaccagcagaccaggaagacccaggccgacaccacccagaacctgggggagcgggtgaatgacatcggcttctggaagtctgagatcatccacgagctggatgagatgattggagagaccaatgccctgacagatgtgaagaagaggctggagcgggccctgatggagacagaggcccccctgcaggtggccagagaatgtctcttccaccgggagaagaggatgggcatcgacctggtgcatgatgaggtggaggcccagctgctgacagaggtggacaccatcctgtgctgccaggagaggatgaagctgcacctggacaaggccatcgcccagctggccgccaacagagccagccagcacgagctggagaaggacctgagtgacaagcagacagcctacagaattgatgacaagtgccaccacctgaggaacaccagtgatggagtgggctacttccggggcgtggagcgggtggatgccaccgtgtctgtgcctgagagctgggccaagttcacagatgacaacatcctgcggagccagagcgagcgggccgccagcgccaagctgagagatgacatcgagaacctgctggtggtgacagccaatgagatgtggaaccagttcaacaaggtgaacctgtccttcaccaacagaattgctgagacagcagatgccaagaacaagatccagacccacctggccaagaccctgcaggagatcttccagacagagatgaccatcgagagcatcaagaaggccatcaaggacaagacagccttcctgaaggtggcccagacccggctggatgagaggacccggcggcccaacatcgagctgtgccgggacatggcccagctgcggctggtgaatgaggtgcatgaggtggatgacaccatccagaccctgcagcagaggctgagagatgctgaggacaccctgcagagcctggtgcacatcaaggccaccctggagtatgacctggccgtgaaggccaacagcctgtacatcgaccaggagaagtgcatgtccatgaggaagagctaccccaacaccctgcggctggtgggcttctgctag

SEQ ID NO: 172889 - DNA, 1473 bp, Artificial Sequence; identical to SEQ ID NO: 172888
  Description of Artificial Sequence: Synthetic coding sequence

SEQ ID NO: 172890 - DNA, 444 bp, Artificial Sequence
  Description of Artificial Sequence: Synthetic coding sequence
atggagcgggtgggctgcaccctgaccaccacctacgcccacccccggcccacccccaccaacttcctgcctgccatcagcaccatggccagcagctacagagaccgcttcccccacagcaacctgacccacagcctgagcctgccctggaggcccagcacctactacaaggtggccagcaacagccccagcgtggccccctactgcaccaggagccagagggtgtctgagaacaccatgctgccctttgtgagcaacagaaccaccttcttcacccgctacaccccagatgactggtaccgcagcaacctgaccaactaccaggagagcaacaccagccgccacaacagcgagaagctgcgggtggacaccagccgcctcatccaggacaagtaccagcagaccaggaagacccaggccgacaccacccagaacctgggctag

SEQ ID NO: 172891 - DNA, 423 bp, Artificial Sequence
  Description of Artificial Sequence: Synthetic coding sequence
atggagcgggtgggctgcaccctgaccaccacctacgcccacccccggcccacccccaccaacttcctgcctgccatcagcaccatggccagcagctacagagaccgcttcccccacagcaacctgacccacagcctgagcctgccctggaggcccagcacctactacaaggtggccagcaacagccccagcgtggccccctactgcaccaggagccagagggtgtctgagaacaccatgctgccctttgtgagcaacagaaccaccttcttcacccgctacaccccagatgactggtaccgcagcaacctgaccaactaccaggagagcaacaccagccgccacaacagcgagaagctgcgggtggacaccagccgcctcatccaggacaagtaccagcagaccaggaagacccaggcctag

SEQ ID NO: 172892 - DNA, 249 bp, Artificial Sequence
  Description of Artificial Sequence: Synthetic coding sequence
atggagcgggtgggctgcaccctgaccaccacctacgcccacccccggcccacccccaccaacttcctgcctgccatcagcaccatggccagcagctacagagaccgcttcccccacagcaacctgacccacagcctgagcctgccctggaggcccagcacctactacaaggtggccagcaacagccccagcgtggccccctactgcaccaggagccagagggtgtctgagaacaccatgctgccctag

SEQ ID NO: 172893 - DNA, 2514 bp, Artificial Sequence
  Description of Artificial Sequence: Synthetic coding sequence
atggagcccgcccccagcgaggtgcggctggccgtgcgggaggccatccacgccctgagcagcagtgaagatggcggccacatcttctgcaccctggagagcctgaagcgctacctgggggagatggagcccccagccctgccccgggagaaggaggagtttgccagcgcccacttcagccctgtgctgcgctgcctggccagccggctgagccctgcctggctggagctgctgccccacggccgcctggaggagctgtgggccagcttcttcctggagggccctgctgaccaggccttcctggtgctgatggagaccattgaaggagctgctggccccagcttccggctgatgaagatggcccggctgctggcccgcttcctgcgggagggccgcctggccgtgctgatggaggcccagtgccggcagcagacccagcccggcttcatcctgctgcgggagaccctgctgggcaaggtggtggccctgcctgaccacctgggcaaccggctgcagcaggagaacctggccgagttcttcccccagaactacttccggctgctgggggaggaggtggtgcgggtgctgcaggccgtggtggacagcctgcagggcggcctggacagctctgtgtcctttgtgtcccaggtgctgggcaaggcctgtgtgcacggccggcagcaggagatcctgggcgtgctggtgccccggctggccgccctgacccagggcagctacctgcaccagagggtgtgctggaggctggtggagcaggtgcctgaccgggccatggaggccgtgctgaccggcctggtggaggccgccctgggccctgaggtgctgagccggctgctgggcaacctggtggtgaagaacaagaaggcccagtttgtgatgacccagaagctgctcttcctgcagagccggctgaccacccccatgctgcagagcctgctgggccacctggccatggacagccagaggcggcccctgctgctgcaggtgctgaaggagctgctggagacctggggcagcagcagcgccatccgccacacccccctgccccagcagagacatgtgtccaaggctgtgctgatctgcctggcccagctgggggagcctgagctgcgggacagcagagatgagctgctggcctccatgatggccggcgtgaagtgccgcctggacagcagcctgccccctgtgcggcggctgggcatgattgtggccgaggtggtgtctgcccgcatccaccctgagggcccccccctgaagttccagtatgaggaggatgagctgagcctggagctgctggccctggccagcccccagcctgctggagatggagccagcgaggccggcaccagcctggtgcctgccacagctgagcccccagctgagaccccagctgagatcgtggatggcggcgtgccccaggcccagctggccggcagtgacagcgacctggacagtgatgatgaatttgtgccctatgacatgtctggggaccgggagctgaagagcagcaaggccccagcctacgtgcgggactgtgtggaggccctgaccaccagcgaggacatcgagcgctgggaggccgccctgcgggccctggagggcctggtgtaccgcagccccacagccacccgggaggtgtctgtggagctggccaaggtgctgctgcacctggaggagaagacctgtgtggtgggctttgctggcctgcggcagagggccctggtggccgtgacagtgacagatcctgcccctgtggccgactacctgaccagccagttctacgccctgaactacagcctgcggcagaggatggacatcctggatgtgctgaccctggccgcccaggagctgagccggcccggctgcctgggccgcaccccccagcccggcagccccagccccaacaccccctgcctgcctgaggccgctgtgtcccagcccggcagcgctgtggccagtgactggagggtggtggtggaggagcgcatccgcagcaagacccagaggctgagcaagggcggcccccggcagggccctgctggcagccccagccgcttcaacagcgtggccggccacttcttcttccccctgctgcagagatttgaccggcccctggtgacctttgacctgctgggggaggaccagctggtgctgggccgcctggcccacaccctgggcgccctgatgtgcctggccgtgaacaccaccgtggccgtggccatgggcaaggccctgctggagtttgtgtgggccctgcgcttccacattgatgcctacgtgcggcagggcctgctgtctgctgtgtcctctgtgctgctgagcctgcctgctgcccggctgctggaggacctgatggatgagctgctggaggcccgctcctggctggctgatgtggccgagaaggaccctgatgaggactgcaggaccctggccctgcgggccctgctgctgctgcagaggctgaagaaccggctgctgcccccagccagcccctag

SEQ ID NO: 172894 - DNA, 1083 bp, Artificial Sequence
  Description of Artificial Sequence: Synthetic coding sequence
atgatggccggcgtgaagtgccgcctggacagcagcctgccccctgtgcggcggctgggcatgattgtggccgaggtggtgtctgcccgcatccaccctgagggcccccccctgaagttccagtatgaggaggatgagctgagcctggagctgctggccctggccagcccccagcctgctggagatggagccagcgaggccggcaccagcctggtgcctgccacagctgagcccccagctgagaccccagctgagatcgtggatggcggcgtgccccaggcccagctggccggcagtgacagcgacctggacagtgatgatgaatttgtgccctatgacatgtctggggaccgggagctgaagagcagcaaggccccagcctacgtgcgggactgtgtggaggtgctggatgtgctgaccctggccgcccaggagctgagcaggcctggctgcctgggccgcaccccccagcccggcagccccagccccaacaccccctgcctgcctgaggccgctgtgtcccagcccggcagcgctgtggccagtgactggagggtggtggtggaggagcgcatccgcagcaagacccagaggctgagcaaaggaggcccccggcagggccctgctggcagccccagccgcttcaacagcgtggccggccacttcttcttccccctgctgcagagatttgaccggcccctggtgacctttgacctgctgggggaggaccagctggtgctgggccgcctggcccacaccctgggcgccctgatgtgcctggccgtgaacaccaccgtggccgtggccatgggcaaggccctgctggagtttgtgtgggccctgcgcttccacattgatgcctacgtgcggcagggcctgctgtctgctgtgtcctctgtgctgctgagcctgcctgctgcccggctgctggaggacctgatggatgagctgctggaggcccgctcctggctggctgatgtggccgagaaggaccctgatgaggactgcaggaccctggccctgcgggccctgctgctgctgcagaggctgaagaaccggctgctgcccccagccagcccctag

SEQ ID NO: 172895 - DNA, 3270 bp, Artificial Sequence
  Description of Artificial Sequence: Synthetic coding sequence
atggctgtgtttgacaccccagaggaggcctttggagtgctgcggcctgtgtgtgtgcagctgaccaagacccagacagtggagaatgtggagcacctgcagacccggctgcaggccgtgtctgattctgccctgcaggagctgcagcagtacatcctcttccccctgcgcttcaccctgaagaccccaggccccaagcgggagcggctcatccagagcgtggtggagtgcctgacctttgtgctgagcagcacctgtgtgaaggagcaggagctgctgcaggagctgttcagcgagctgagcgcctgcctgtacagccccagcagccagaagccagctgctgtgtctgaggagctgaagctggccgtcatccagggcctgagcaccctgatgcacagcgcctatggagacatcatcctgaccttctatgagcccagcatcctgccccggctgggctttgctgtgtccctgctgctgggcctggccgagcaggagaagagcaagcagatcaagattgctgccctgaagtgcctgcaggtgctgctgctgcagtgtgactgccaggaccaccccaggagcctggatgagctggagcagaagcagctgggggacctgtttgccagcttcctgcccggcatcagcacagccctgaccaggctcatcaccggggacttcaagcagggccacagcatcgtggtgagcagcctgaagatcttctacaagacagtgtccttcatcatggctgatgagcagctgaagaggatcagcaaggtgcaggccaagccagctgtggagcaccgggtggccgagctgatggtgtaccgggaggccgactgggtgaagaagacaggagacaagctgaccatcctgatcaagaagatcattgaatgtgtgtctgtgcacccccactggaaggtgcggctggagctggtggagctggtggaggacctgctgctgaagtgcagccagagcctggtggagtgtgccggccccctgctgaaggccctggtgggcctggtgaatgatgagagccctgagatccaggcccagtgcaacaaggtgctgcggcactttgctgaccagaaggtggtggtgggcaacaaggccctggccgacatcctgtctgagagcctgcacagcctggccaccagcctgccccggctgatgaacagccaggatgaccagggcaagttcagcaccctgagcctgctgctgggctacctgaagctgctgggccccaagatcaactttgtgctgaacagcgtggcccacctgcagaggctgagcaaggccctgatccaggtgctggagctggatgtggccgacatcaagatcgtggaggagcggcgctggaacagtgatgacctgaatgccagccccaagaccagcgccacccagccctggaaccgcatccagaggcgctacttccgcttcttcacagatgagcgcatcttcatgctgctgcggcaggtgtgccagctgctgggctactacggcaacctgtacctgctggtggaccacttcatggagctgtaccaccagagcgtggtgtacaggaagcaggccgccatgatcctgaatgagctggtgactggagctgctggcctggaggtggaggacctgcacgagaagcacatcaagaccaaccctgaggagctgcgggagatcgtgaccagcatcctggaggagtacaccagccaggagaactggtacctggtgacctgcctggagacagaggagatgggagaggagctgatgatggagcaccctggcctgcaggccatcaccagcggggagcacacctgccaggtgaccagcttcctggccttcagcaagcccagccccaccatctgcagcatgaacagcaacatctggcagatctgcatccagctggagggcatcggccagtttgcctatgccctgggcaaggacttctgcctgctgctgatgtctgccctgtaccctgtgctggagaaggccggggaccagaccctgctgatcagccaggtggccaccagcaccatgatggatgtgtgccgggcctgtggctatgacagcctgcagcacctgatcaaccagaacagcgactacctggtgaatggcatcagcctgaacctgcggcacctggccctgcacccccacacccccaaggtgctggaggtgatgctgaggaacagtgatgccaacctgctgcccctggtggctgatgtggtgcaggatgtgctggccaccctggaccagttctatgacaagagagctgccagctttgtgtctgtgctgcacgccctgatggccgccctggcccagtggttcccagacaccggcaacctgggccacctgcaggagcagagcctgggggaggagggcagccacctgaaccagaggcctgctgccctggagaagagcaccaccacagcagaagatattgagcagttcctgctgaactacctgaaggagaaggatgtggctgatggaaatgtgtctgactttgacaatgaggaggaggagcagagcgtgccccccaaggtggatgaaaatgacaccaggccagatgtggagccccccctgcccctgcagatccagatcgccatggatgtgatggagcgctgcatccacctgctgagtgacaagaacctgcagatccggctgaaggtgctggatgtgctggacctgtgtgtggtggtgctgcagagccacaagaaccagctgctgcccctggcccaccaggcctggcccagcctggtgcaccggctgaccagagatgcccccctggccgtgctgcgggccttcaaggtgctgcggaccctgggcagcaaatgtggggacttcctgcggagccgcttctgcaaggatgtgctgcccaagctggccggcagcctggtgacccaggcccccatcagcgcccgggccggccctgtgtacagccacaccctggccttcaagctgcagctggccgtgctgcagggcctgggccccctgtgtgagcggctggacctgggggagggggacctgaacaaggtggctgatgcctgcctgatctacctgtctgtgaagcagcctgtgaagctgcaggaggccgcccggtctgtgttcctgcacctgatgaaggtggaccctgacagcacctggttcctgctgaatgagctgtactgccctgtgcagttcaccccaccccaccccagcctgcaccctgtgcagctgcacggggccagcggccagcagaacccctacaccaccaacgtgctgcagctgctgaaggagctgcagtag

SEQ ID NO: 172896 - DNA, 3270 bp, Artificial Sequence; identical to SEQ ID NO: 172895
  Description of Artificial Sequence: Synthetic coding sequence

SEQ ID NO: 172897 - DNA, 3270 bp, Artificial Sequence; identical to SEQ ID NO: 172895
  Description of Artificial Sequence: Synthetic coding sequence

SEQ ID NO: 172898 - DNA, 1527 bp, Artificial Sequence
  Description of Artificial Sequence: Synthetic coding sequence
atggagctggacagcgccctggaggcccccagccaggaggacagcaacctgtctgaggagctgagccacagcgccttcggccaggccttcagcaagatcctgcactgcctggcccggcctgaggccaggagaggaaatgtgaaggatgctgtgctgaaggacctgggggacctgattgaggccacagaatttgaccggctgtttgagggcactggagcccggctgcggggcatgcctgagaccctgggccaggtggccaaggccctggagaagtatgctgcccccagcaaggaggaggagggcggcggagatggccacagcgaggccgctgagaaggccgcccaggtgggcctgctcttcctgaagctgctgggcaaggtggagacagccaagaacagcctggtgggccctgcctggcagacaggcctgcaccacctggccggccctgtgtacatctttgccatcacccacagcctggagcagccctggaccacccccaggagccgggaggtggcccgggaggtgctgaccagcctgctgcaggtgacagaatgtggctctgtggccggcttcctgcatggagaaaatgaagatgagaagggccgcctgagcgtcatcctgggcctgctgaagccagacctgtacaaggagagctggaagaacaacccagccatcaagcacgtgttctcctggaccctgcagcaggtgacccggccctggctgagccagcacctggagcgggtgctgcctgccagcctggtgatcagtgatgactaccagacagagaacaagatcctgggcgtgcactgcctgcaccacatcgtgctgaatgtgcctgctgctgacctgctgcagtacaacagagcccaggtgctgtaccacgccatcagcaaccacctgtacaccccagagcaccacctgatccaggccgtgctgctgtgcctgctggacctcttccccatcctggagaagaccctgcactggaagggagatggagcccggcccaccacccactgtgatgaggtgctgcggctcatcctgacccacatggagcctgagcaccggctgctgctgcggaggacctacgccaggaacctgcctgcctttgtgaaccggctgggcatcctgactgtgcgccacctgaagaggctggagagggtcatcatcggctacctggaggtgtatgatggccctgaggaggaggcccggctgaagatcctggagaccctgaagctgctgatgcagcacacctggccccgggtgtcctgccgcctggtggtgctgctgaaggccctgctgaagctgatctgtgatgtggcccgggaccccaacctgaccccagagagcgtgaagagcgccctgctgcaggaggccacagactgcctgatcctgctggaccgctgcagccagggccgggtgaagggcctgctggccaagatcccccagagctgtgaggacaggaaggtggtgaactacatcaggaaggtgcagcaggtgtctgagggcgccccctacaacggcacctag

SEQ ID NO: 172899 - DNA, 1527 bp, Artificial Sequence; identical to SEQ ID NO: 172898
  Description of Artificial Sequence: Synthetic coding sequence

SEQ ID NO: 172900 - DNA, 1494 bp, Artificial Sequence
  Description of Artificial Sequence: Synthetic coding sequence
atggagctggacagcgccctggaggcccccagccaggaggacagcaacctgtctgaggagctgagccacagcgccttcggccaggccttcagcaagatcctgcactgcctggcccggcctgaggccaggagaggaaatgtgaaggatgctgtgctgaaggacctgggggacctgattgaggccacagaatttgaccggctgtttgagggcactggagcccggctgcggggcatgcctgagaccctgggccaggtggccaaggccctggagaagtatgctgcccccagcaaggaggaggagggcggcggagatggccacagcgaggccgctgagaaggccgcccaggtgggcctgctcttcctgaagctgctgggcaaggtggagacagccaagaacagcctggtgggccctgcctggcagacaggcctgcaccacctggccggccctgtgtacatctttgccatcacccacagcctggagcagccctggaccacccccaggagccgggaggtggcccgggaggtgctgaccagcctgctgcaggtgacagaatgtggctctgtggccggcttcctgcatggagaaaatgaagatgagaagggccgcctgagcgtcatcctgggcctgctgaagccagacctgtacaaggagagctggaagaacaacccagccatcaagcacgtgttctcctggaccctgcagcaggtgacccggccctggctgagccagcacctggagcgggtgctgcctgccagcctggtgatcagtgatgactaccagacagagaacaagatcctgggcgtgcactgcctgcaccacatcgtgctgaatgtgcctgctgctgacctgctgcagtacaacagagcccaggtgctgtaccacgccatcagcaaccacctgtacaccccagagcaccacctgatccaggccgtgctgctgtgcctgctggacctcttccccatcctggagaagaccctgcactggaagggagatggagcccggcccaccacccactgtgatgaggtgctgcggctcatcctgacccacatggagcctgagcaccggctgctgctgcggaggacctacgccaggaacctgcctgcctttgtgaaccggctggagagggtcatcatcggctacctggaggtgtatgatggccctgaggaggaggcccggctgaagatcctggagaccctgaagctgctgatgcagcacacctggccccgggtgtcctgccgcctggtggtgctgctgaaggccctgctgaagctgatctgtgatgtggcccgggaccccaacctgaccccagagagcgtgaagagcgccctgctgcaggaggccacagactgcctgatcctgctggaccgctgcagccagggccgggtgaagggcctgctggccaagatcccccagagctgtgaggacaggaaggtggtgaactacatcaggaaggtgcagcaggtgtctgagggcgccccctacaacggcacctag

SEQ ID NO: 172901 - DNA, 306 bp, Artificial Sequence
  Description of Artificial Sequence: Synthetic coding sequence
atggagctggacagcgccctggaggcccccagccaggaggacagcaacctgtctgaggagctgagccacagcgccttcggccaggccttcagcaagatcctgcactgcctggcccggcctgaggccaggagaggaaatgtgaaggatgctgtgctgaaggacctgggggacctgattgaggccacagaatttgaccggctgtttgagggcactggagcccggctgcggggcatgcctgagaccctgggccaggtggccaaggccctggagaagtatgctgcccccagcaaggaggaggagggctag

SEQ ID NO: 172902 - DNA, 2424 bp, Artificial Sequence
  Description of Artificial Sequence: Synthetic coding sequence
atgccccgggccccccgctgcagagctgtgcgcagcctgctgcggagccactaccgggaggtgctgcccctggccacctttgtgcggcggctgggcccccagggctggaggctggtgcagagaggagaccctgctgccttccgggccctggtggcccagtgcctggtgtgtgtgccctgggatgcccggcccccacctgctgcccccagcttccggcaggtgtcctgcctgaaggagctggtggcccgggtgctgcagaggctgtgtgagcggggggccaagaatgtgctggcctttggatttgccctgctggatggagcccggggcggccccccagaggccttcaccacctctgtgcgcagctacctgcccaacacagtgacagatgccctgcggggcagcggggcctggggcctgctgctgcggcgggtgggagatgatgtgctggtgcacctgctggcccgctgtgccctgtttgtgctggtggcccccagctgtgcctaccaggtgtgtggcccccccctgtaccagctgggcgccgccacccaggcccggcccccacctcatgccagcggcccccggcggcggctgggctgtgagcgggcctggaaccacagcgtgcgggaggccggcgtgcccctgggcctgcctgcccctggggccaggagaagaggaggcagcgccagccgcagcctgcccctgcccaagaggcccaggagaggagctgcccctgagcctgagaggacccctgtgggccagggctcctgggcccaccctggccgcacccggggccccagcgaccggggcttctgtgtggtgtccccagcccggcctgctgaggaggccaccagcctggagggcgccctgagcggcaccaggcacagccaccccagcgtgggccggcagcaccacgccggcccccccagcaccagcaggcctccccggccctgggacaccccctgcccccctgtgtatgcagagaccaagcacttcctgtacagcagcggggacaaggagcagctgcggcccagcttcctgctgagcagcctgcggcccagcctgactggagcccggcggctggtggagaccatcttcctgggcagccggccctggatgcctggcaccccccggcggctgccccggctgccccagcgctactggcagatgaggcccctcttcctggagctgctgggcaaccacgcccagtgcccctatggagtgctgctgaagacccactgccccctgcgggctgctgtgaccccagctgctggggtgtgtgcccgggagaagccccagggctctgtggccgcccctgaggaggaggacacagacccccggcggctggtgcagctgctgcggcagcacagcagcccctggcaggtgtatggctttgtgcgggcctgcctgcggcggctggtgcccccaggcctgtggggcagccgccacaatgaaagacgcttcctgaggaacaccaagaagttcatcagcctgggcaagcacgccaagctgagcctgcaggagctgacctggaagatgtctgtgcgggactgtgcctggctgcggcgcagccctggggtgggctgtgtgcctgctgctgagcaccggctgcgggaggagatcctggccaagttcctgcactggctgatgtctgtgtatgtggtggagctgctgcgctccttcttctacgtgacagagaccaccttccagaagaacagactcttcttctacaggaagtctgtgtggagcaagctgcagagcatcggcatccggcagcacctgaagagggtgcagctgcgggagctgtctgaggccgaggtgcggcagcaccgggaggcccggcctgccctgctgaccagccggctgcgcttcatccccaagccagatggcctgcggcccatcgtgaacatggactatgtggtgggcgcccggaccttccggcgggagaagagagctgagcggctgaccagccgggtgaaggccctcttctctgtgctgaactatgagcgggcccggcggcccggcctgctgggcgcctctgtgctgggcctggatgacatccaccgggcctggaggacctttgtgctgcgggtgcgggcccaggaccccccacctgagctgtactttgtgaaggtggatgtgactggagcctatgacaccatcccccaggaccggctgacagaggtgattgccagcatcatcaagccccagaacacctactgtgtgcggcgctatgctgtggtgcagaaggccgcccacggccacgtgaggaaggccttcaagagccacgtgctgcggcctgtgcctggggaccctgctggcctgcaccccctgcatgctgccctgcagcctgtgctgcggcggcacggggagcaggccgtgtgtggggacagcgctggccgggccgccccagcctttggaggatag

SEQ ID NO: 172903 - DNA, 3399 bp, Artificial Sequence
  Description of Artificial Sequence: Synthetic coding sequence
atgccccgggccccccgctgcagagctgtgcgcagcctgctgcggagccactaccgggaggtgctgcccctggccacctttgtgcggcggctgggcccccagggctggaggctggtgcagagaggagaccctgctgccttccgggccctggtggcccagtgcctggtgtgtgtgccctgggatgcccggcccccacctgctgcccccagcttccggcaggtgtcctgcctgaaggagctggtggcccgggtgctgcagaggctgtgtgagcggggggccaagaatgtgctggcctttggatttgccctgctggatggagcccggggcggccccccagaggccttcaccacctctgtgcgcagctacctgcccaacacagtgacagatgccctgcggggcagcggggcctggggcctgctgctgcggcgggtgggagatgatgtgctggtgcacctgctggcccgctgtgccctgtttgtgctggtggcccccagctgtgcctaccaggtgtgtggcccccccctgtaccagctgggcgccgccacccaggcccggcccccacctcatgccagcggcccccggcggcggctgggctgtgagcgggcctggaaccacagcgtgcgggaggccggcgtgcccctgggcctgcctgcccctggggccaggagaagaggaggcagcgccagccgcagcctgcccctgcccaagaggcccaggagaggagctgcccctgagcctgagaggacccctgtgggccagggctcctgggcccaccctggccgcacccggggccccagcgaccggggcttctgtgtggtgtccccagcccggcctgctgaggaggccaccagcctggagggcgccctgagcggcaccaggcacagccaccccagcgtgggccggcagcaccacgccggcccccccagcaccagcaggcctccccggccctgggacaccccctgcccccctgtgtatgcagagaccaagcacttcctgtacagcagcggggacaaggagcagctgcggcccagcttcctgctgagcagcctgcggcccagcctgactggagcccggcggctggtggagaccatcttcctgggcagccggccctggatgcctggcaccccccggcggctgccccggctgccccagcgctactggcagatgaggcccctcttcctggagctgctgggcaaccacgcccagtgcccctatggagtgctgctgaagacccactgccccctgcgggctgctgtgaccccagctgctggggtgtgtgcccgggagaagccccagggctctgtggccgcccctgaggaggaggacacagacccccggcggctggtgcagctgctgcggcagcacagcagcccctggcaggtgtatggctttgtgcgggcctgcctgcggcggctggtgcccccaggcctgtggggcagccgccacaatgaaagacgcttcctgaggaacaccaagaagttcatcagcctgggcaagcacgccaagctgagcctgcaggagctgacctggaagatgtctgtgcgggactgtgcctggctgcggcgcagccctggggtgggctgtgtgcctgctgctgagcaccggctgcgggaggagatcctggccaagttcctgcactggctgatgtctgtgtatgtggtggagctgctgcgctccttcttctacgtgacagagaccaccttccagaagaacagactcttcttctacaggaagtctgtgtggagcaagctgcagagcatcggcatccggcagcacctgaagagggtgcagctgcgggagctgtctgaggccgaggtgcggcagcaccgggaggcccggcctgccctgctgaccagccggctgcgcttcatccccaagccagatggcctgcggcccatcgtgaacatggactatgtggtgggcgcccggaccttccggcgggagaagagagctgagcggctgaccagccgggtgaaggccctcttctctgtgctgaactatgagcgggcccggcggcccggcctgctgggcgcctctgtgctgggcctggatgacatccaccgggcctggaggacctttgtgctgcgggtgcgggcccaggaccccccacctgagctgtactttgtgaaggtggatgtgactggagcctatgacaccatcccccaggaccggctgacagaggtgattgccagcatcatcaagccccagaacacctactgtgtgcggcgctatgctgtggtgcagaaggccgcccacggccacgtgaggaaggccttcaagagccacgtgtccaccctgacagacctgcagccctacatgaggcagtttgtggcccacctgcaggagaccagccccctgagagatgctgtggtgattgagcagagcagcagcctgaatgaggccagcagcggcctgtttgatgtgttcctgcgcttcatgtgccaccacgctgtgcgcatccggggcaagagctatgtgcagtgccagggcatcccccagggcagcatcctgagcaccctgctgtgcagcctgtgctacggggacatggagaacaagctgtttgctggcatcagaagagatggcctgctgctgcggctggtggatgacttcctgctggtgaccccccacctgacccacgccaagaccttcctgcggaccctggtgcggggcgtgcctgaatatggctgtgtggtgaacctgaggaagacagtggtgaacttccctgtggaggatgaggccctgggcggcacagcctttgtgcagatgcctgcccacggcctcttcccctggtgtggcctgctgctggacaccaggaccctggaggtgcagagcgactacagcagctatgcccggaccagcatccgggccagcctgaccttcaacagaggcttcaaggccggcaggaacatgaggaggaagctgtttggagtgctgcggctgaagtgccacagcctcttcctggacctgcaggtgaacagcctgcagacagtgtgcaccaacatctacaagatcctgctgctgcaggcctaccgcttccacgcctgtgtgctgcagctgcccttccaccagcaggtgtggaagaaccccaccttcttcctgcgggtcatcagtgacacagccagcctgtgctacagcatcctgaaggccaagaatgccggcatgagcctgggcgccaagggagctgctggccccctgcccagcgaggccgtgcagtggctgtgccaccaggccttcctgctgaagctgaccaggcaccgggtgacctacgtgcccctgctgggcagcctgaggacagcccagacccagctgagcaggaagctgcccggcaccaccctgacagccctggaggccgccgccaacccagccctgcccagcgacttcaagaccatcctggactag

SEQ ID NO: 172904 - DNA, 3210 bp, Artificial Sequence
  Description of Artificial Sequence: Synthetic coding sequence
atgccccgggccccccgctgcagagctgtgcgcagcctgctgcggagccactaccgggaggtgctgcccctggccacctttgtgcggcggctgggcccccagggctggaggctggtgcagagaggagaccctgctgccttccgggccctggtggcccagtgcctggtgtgtgtgccctgggatgcccggcccccacctgctgcccccagcttccggcaggtgtcctgcctgaaggagctggtggcccgggtgctgcagaggctgtgtgagcggggggccaagaatgtgctggcctttggatttgccctgctggatggagcccggggcggccccccagaggccttcaccacctctgtgcgcagctacctgcccaacacagtgacagatgccctgcggggcagcggggcctggggcctgctgctgcggcgggtgggagatgatgtgctggtgcacctgctggcccgctgtgccctgtttgtgctggtggcccccagctgtgcctaccaggtgtgtggcccccccctgtaccagctgggcgccgccacccaggcccggcccccacctcatgccagcggcccccggcggcggctgggctgtgagcgggcctggaaccacagcgtgcgggaggccggcgtgcccctgggcctgcctgcccctggggccaggagaagaggaggcagcgccagccgcagcctgcccctgcccaagaggcccaggagaggagctgcccctgagcctgagaggacccctgtgggccagggctcctgggcccaccctggccgcacccggggccccagcgaccggggcttctgtgtggtgtccccagcccggcctgctgaggaggccaccagcctggagggcgccctgagcggcaccaggcacagccaccccagcgtgggccggcagcaccacgccggcccccccagcaccagcaggcctccccggccctgggacaccccctgcccccctgtgtatgcagagaccaagcacttcctgtacagcagcggggacaaggagcagctgcggcccagcttcctgctgagcagcctgcggcccagcctgactggagcccggcggctggtggagaccatcttcctgggcagccggccctggatgcctggcaccccccggcggctgccccggctgccccagcgctactggcagatgaggcccctcttcctggagctgctgggcaaccacgcccagtgcccctatggagtgctgctgaagacccactgccccctgcgggctgctgtgaccccagctgctggggtgtgtgcccgggagaagccccagggctctgtggccgcccctgaggaggaggacacagacccccggcggctggtgcagctgctgcggcagcacagcagcccctggcaggtgtatggctttgtgcgggcctgcctgcggcggctggtgcccccaggcctgtggggcagccgccacaatgaaagacgcttcctgaggaacaccaagaagttcatcagcctgggcaagcacgccaagctgagcctgcaggagctgacctggaagatgtctgtgcgggactgtgcctggctgcggcgcagccctggggtgggctgtgtgcctgctgctgagcaccggctgcgggaggagatcctggccaagttcctgcactggctgatgtctgtgtatgtggtggagctgctgcgctccttcttctacgtgacagagaccaccttccagaagaacagactcttcttctacaggaagtctgtgtggagcaagctgcagagcatcggcatccggcagcacctgaagagggtgcagctgcgggagctgtctgaggccgaggtgcggcagcaccgggaggcccggcctgccctgctgaccagccggctgcgcttcatccccaagccagatggcctgcggcccatcgtgaacatggactatgtggtgggcgcccggaccttccggcgggagaagagagctgagcggctgaccagccgggtgaaggccctcttctctgtgctgaactatgagcgggcccggcggcccggcctgctgggcgcctctgtgctgggcctggatgacatccaccgggcctggaggacctttgtgctgcgggtgcgggcccaggaccccccacctgagctgtactttgtgaaggtggatgtgactggagcctatgacaccatcccccaggaccggctgacagaggtgattgccagcatcatcaagccccagaacacctactgtgtgcggcgctatgctgtggtgcagaaggccgcccacggccacgtgaggaaggccttcaagagccacgtgtccaccctgacagacctgcagccctacatgaggcagtttgtggcccacctgcaggagaccagccccctgagagatgctgtggtgattgagcagagcagcagcctgaatgaggccagcagcggcctgtttgatgtgttcctgcgcttcatgtgccaccacgctgtgcgcatccggggcaagagctatgtgcagtgccagggcatcccccagggcagcatcctgagcaccctgctgtgcagcctgtgctacggggacatggagaacaagctgtttgctggcatcagaagagatggcctgctgctgcggctggtggatgacttcctgctggtgaccccccacctgacccacgccaagaccttcctgtcctatgcccggaccagcatccgggccagcctgaccttcaacagaggcttcaaggccggcaggaacatgaggaggaagctgtttggagtgctgcggctgaagtgccacagcctcttcctggacctgcaggtgaacagcctgcagacagtgtgcaccaacatctacaagatcctgctgctgcaggcctaccgcttccacgcctgtgtgctgcagctgcccttccaccagcaggtgtggaagaaccccaccttcttcctgcgggtcatcagtgacacagccagcctgtgctacagcatcctgaaggccaagaatgccggcatgagcctgggcgccaagggagctgctggccccctgcccagcgaggccgtgcagtggctgtgccaccaggccttcctgctgaagctgaccaggcaccgggtgacctacgtgcccctgctgggcagcctgaggacagcccagacccagctgagcaggaagctgcccggcaccaccctgacagccctggaggccgccgccaacccagccctgcccagcgacttcaagaccatcctggactag

SEQ ID NO: 172905 - DNA, 2424 bp, Artificial Sequence; identical to SEQ ID NO: 172902
  Description of Artificial Sequence: Synthetic coding sequence

SEQ ID NO: 172906 - DNA, 372 bp, Artificial Sequence
  Description of Artificial Sequence: Synthetic coding sequence
atgatgctgcccaagccaggcacctactacctgccctgggaggtgtctgctggccaggtgcctgatggcagcaccctgcggaccttcggccgcctgtgcctgtatgacatgatccagagccgggtgaccctgatggcccagcacggcagtgaccagcaccaggtgctggtgtgcaccaagctggtggagcccttccacgcccaggtgggcagcctgtacatcgtgctgggggagctgcagcaccagcaggaccggggctctgtggtgaaggcccgggtgctgacctgtgtggagggcatgaacctgcccctgctggagcaggccatccgggagcagaggctgtacaagcaggagcggggcggcagccagtag

SEQ ID NO: 172907 - DNA, 369 bp, Artificial Sequence
  Description of Artificial Sequence: Synthetic coding sequence
atgctgcccaagccaggcacctactacctgccctgggaggtgtctgctggccaggtgcctgatggcagcaccctgcggaccttcggccgcctgtgcctgtatgacatgatccagagccgggtgaccctgatggcccagcacggcagtgaccagcaccaggtgctggtgtgcaccaagctggtggagcccttccacgcccaggtgggcagcctgtacatcgtgctgggggagctgcagcaccagcaggaccggggctctgtggtgaaggcccgggtgctgacctgtgtggagggcatgaacctgcccctgctggagcaggccatccgggagcagaggctgtacaagcaggagcggggcggcagccagtag

SEQ ID NO: 172908 - DNA, 5514 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagccaaggagcctgagatcggcaacctgaatgtgtctgacatcaccccagagagcttcaacctgtcctggatggccacagatggcatctttgagaccttcaccatcgagatcatcgacagcaaccggctgctggagaccgtggagtacaacatctctggagctgagaggacagcccacatcagcggcctgccccccagcacagacttcatcgtgtacctgagcggcctggcccccagcatccgcaccaagaccatcagcgccacagccaccacagaggccctgcccctgctggagaacctgaccatcagtgacatcaacccctacggcttcaccgtgtcctggatggcctctgaaaatgcctttgacagcttcctggtgacagtggtggacagcggcaagctgctggacccccaggagttcaccctgagcggcacccagaggaagctggagctgcggggcctcatcactggaattggctatgaggtgatggtgtctggcttcacccagggccaccagaccaagcccctgcgggcagaaattgtgacagaagctgagcctgaggtggacaacctgctggtgtctgatgccaccccagatggcttccggctgtcctggacagcagatgaaggagtgtttgacaactttgtgctgaagatccgggacaccaagaagcagagcgagcccctggagatcaccctgctggcccctgagaggacccgggacatcaccggcctgcgggaggccacagaatatgaaattgagctgtatggcatcagcaaaggaagaagaagccagacagtgtctgccatcgccaccacagccatgggcagccccaaggaggtgatcttcagtgacatcacagaaaattctgccaccgtgtcctggagggcccccacagcccaggtggagagcttccgcatcacctacgtgcccatcaccggcggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagattctgaggccctggcccgctggcagcctgccatcgccaccgtggacagctatgtgatctcctacaccggggagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgaatctgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggccgggagaacttctaccagaactggaaggcctatgctgctggctttggagaccggcgggaggagttctggctgggcctggacaacctgaacaagatcacagcccagggccagtatgagctgcgggtggacctgcgggaccatggagaaacagcctttgctgtgtatgacaagttctctgtgggagatgccaagacccgctacaagctgaaggtggagggctacagcggcacagctggggacagcatggcctaccacaacggccgctccttcagcacctttgacaaggacacagattctgccatcaccaactgtgccctgagctacaagggggccttctggtacagaaactgccaccgggtgaacctgatgggccgctacggggacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172909 - DNA, 4695 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagccatgggcagccccaaggaggtgatcttcagtgacatcacagagaacagcgccaccgtgtcctggagggcccccacagcccaggtggagagcttccgcatcacctacgtgcccatcactggaggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagacagcgaggccctggcccgctggcagcctgccatcgccaccgtggacagctatgtgatctcctacacaggagagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgagagcgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggaagagagaacttctaccagaactggaaggcctatgctgctggctttggagacagaagagaggagttctggctgggcctggacaacctgaacaagatcacagcccagggccagtatgagctgcgggtggacctgcgggaccacggggagacagcctttgctgtgtatgacaagttctctgtgggagatgccaagacccgctacaagctgaaggtggagggctacagcggcacagctggggacagcatggcctaccacaacggccgctccttcagcacctttgacaaggacacagacagcgccatcaccaactgtgccctgagctacaagggggccttctggtacagaaactgccaccgggtgaacctgatgggccgctatggagacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172910 - DNA, 4968 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagaagctgagcctgaggtggacaacctgctggtgtctgatgccaccccagatggcttccggctgtcctggacagcagatgaaggagtgtttgacaactttgtgctgaagatccgggacaccaagaagcagagcgagcccctggagatcaccctgctggcccctgagaggacccgggacatcaccggcctgcgggaggccacagaatatgaaattgagctgtatggcatcagcaaaggaagaagaagccagacagtgtctgccatcgccaccacagccatgggcagccccaaggaggtgatcttcagtgacatcacagaaaattctgccaccgtgtcctggagggcccccacagcccaggtggagagcttccgcatcacctacgtgcccatcaccggcggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagattctgaggccctggcccgctggcagcctgccatcgccaccgtggacagctatgtgatctcctacaccggggagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgaatctgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggccgggagaacttctaccagaactggaaggcctatgctgctggctttggagaccggcgggaggagttctggctgggcctggacaacctgaacaagatcacagcccagggccagtatgagctgcgggtggacctgcgggaccatggagaaacagcctttgctgtgtatgacaagttctctgtgggagatgccaagacccgctacaagctgaaggtggagggctacagcggcacagctggggacagcatggcctaccacaacggccgctccttcagcacctttgacaaggacacagattctgccatcaccaactgtgccctgagctacaagggggccttctggtacagaaactgccaccgggtgaacctgatgggccgctacggggacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172911 - DNA, 6606 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagagcaggcccctgagctggagaacctgactgtgacagaggtgggctgggatggcctgcggctgaactggacagctgctgaccaggcctatgagcacttcatcatccaggtgcaggaggccaacaaggtggaggccgccaggaacctgactgtgcccggcagcctgcgggctgtggacatccctggcctgaaggccgccaccccctacacagtgtccatctatggagtcatccagggctaccgcacccctgtgctgtctgctgaggccagcactggagagacccccaacctgggggaggtggtggtggccgaggtgggctgggatgccctgaagctgaactggacagcccctgagggcgcctatgagtacttcttcatccaggtgcaggaggccgacacagtggaggccgcccagaacctgactgtgcctgggggcctgcggagcacagacctgcccggcctgaaggccgccacccactacaccatcaccatccggggcgtgacccaggacttcagcaccacccccctgtctgtggaggtgctgacagaggaggtgcctgacatgggcaacctgactgtgacagaggtgtcctgggatgccctgcggctgaactggaccaccccagatggcacctatgaccagttcaccatccaggtgcaggaggccgaccaggtggaggaggcccacaacctgactgtgcccggcagcctgcgctccatggagatccctggcctgcgggccggcaccccctacacagtgaccctgcatggagaggtgcggggccacagcacccggcccctggccgtggaggtggtgacagaggacctgccccagctgggggacctggccgtgtctgaggtgggctgggatggcctgcggctgaactggacagctgctgacaatgcctatgagcactttgtgatccaggtgcaggaggtgaacaaggtggaggccgcccagaacctgaccctgcccggcagcctgcgggctgtggacatccctggcctggaggccgccaccccctacagagtgtccatctacggcgtcatccggggctaccgcacccctgtgctgtctgctgaggccagcacagccaaggagcctgagatcggcaacctgaatgtgtctgacatcaccccagagagcttcaacctgtcctggatggccacagatggcatctttgagaccttcaccatcgagatcatcgacagcaaccggctgctggagaccgtggagtacaacatctctggagctgagaggacagcccacatcagcggcctgccccccagcacagacttcatcgtgtacctgagcggcctggcccccagcatccgcaccaagaccatcagcgccacagccaccacagaggccctgcccctgctggagaacctgaccatcagtgacatcaacccctacggcttcaccgtgtcctggatggcctctgaaaatgcctttgacagcttcctggtgacagtggtggacagcggcaagctgctggacccccaggagttcaccctgagcggcacccagaggaagctggagctgcggggcctcatcactggaattggctatgaggtgatggtgtctggcttcacccagggccaccagaccaagcccctgcgggcagaaattgtgacagaagctgagcctgaggtggacaacctgctggtgtctgatgccaccccagatggcttccggctgtcctggacagcagatgaaggagtgtttgacaactttgtgctgaagatccgggacaccaagaagcagagcgagcccctggagatcaccctgctggcccctgagaggacccgggacatcaccggcctgcgggaggccacagaatatgaaattgagctgtatggcatcagcaaaggaagaagaagccagacagtgtctgccatcgccaccacagccatgggcagccccaaggaggtgatcttcagtgacatcacagaaaattctgccaccgtgtcctggagggcccccacagcccaggtggagagcttccgcatcacctacgtgcccatcaccggcggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagattctgaggccctggcccgctggcagcctgccatcgccaccgtggacagctatgtgatctcctacaccggggagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgaatctgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggccgggagaacttctaccagaactggaaggcctatgctgctggctttggagaccggcgggaggagttctggctgggcctggacaacctgaacaagatcacagcccagggccagtatgagctgcgggtggacctgcgggaccatggagaaacagcctttgctgtgtatgacaagttctctgtgggagatgccaagacccgctacaagctgaaggtggagggctacagcggcacagctggggacagcatggcctaccacaacggccgctccttcagcacctttgacaaggacacagattctgccatcaccaactgtgccctgagctacaagggggccttctggtacagaaactgccaccgggtgaacctgatgggccgctacggggacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172912 - DNA, 3240 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccatcacagccaagttcaccacagacctggacagcccccgggacctgacagccacagaggtgcagagcgagacagccctgctgacctggaggcctccccgggcctctgtgacaggctacctgctggtgtatgaatctgtggatggcaccgtgaaggaggtgattgtgggccctgacaccaccagctacagcctggccgacctgagcccccccagcctcttcctgcacttcatccagcagaagccagagaagcagtactgcttccacttcaaggacatgatcaacatcatcaacatcatcatgatgatgatgatgatgaagaccaaggacttcagccgggacctgtccttccagaacatcagcggccagtacctgattgtgttcttcttctag

SEQ ID NO: 172913 - DNA, 279 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtgtag

SEQ ID NO: 172914 - DNA, 5241 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagccaaggagcctgagatcggcaacctgaatgtgtctgacatcaccccagagagcttcaacctgtcctggatggccacagatggcatctttgagaccttcaccatcgagatcatcgacagcaaccggctgctggagaccgtggagtacaacatctctggagctgagaggacagcccacatcagcggcctgccccccagcacagacttcatcgtgtacctgagcggcctggcccccagcatccgcaccaagaccatcagcgccacagccaccacagaggccgagcctgaggtggacaacctgctggtgtctgatgccaccccagatggcttccggctgtcctggacagcagatgagggcgtgtttgacaactttgtgctgaagatccgggacaccaagaagcagagcgagcccctggagatcaccctgctggcccctgagaggacccgggacatcaccggcctgcgggaggccacagaatatgaaattgagctgtatggcatcagcaagggccgccgcagccagacagtgtctgccatcgccaccacagccatgggcagccccaaggaggtgatcttcagtgacatcacagagaacagcgccaccgtgtcctggagggcccccacagcccaggtggagagcttccgcatcacctacgtgcccatcactggaggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagacagcgaggccctggcccgctggcagcctgccatcgccaccgtggacagctatgtgatctcctacacaggagagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgagagcgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggaagagagaacttctaccagaactggaaggcctatgctgctggctttggagacagaagagaggagttctggctgggcctggacaacctgaacaagatcacagcccagggccagtatgagctgcgggtggacctgcgggaccacggggagacagcctttgctgtgtatgacaagttctctgtgggagatgccaagacccgctacaagctgaaggtggagggctacagcggcacagctggggacagcatggcctaccacaacggccgctccttcagcacctttgacaaggacacagacagcgccatcaccaactgtgccctgagctacaagggggccttctggtacagaaactgccaccgggtgaacctgatgggccgctatggagacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172915 - DNA, 5517 bp, Artificial Sequence
  Description of Artificial Sequence: Synthetic coding sequence
atgggcgccatgacccagctgctggccggggtcttcctggccttcctggccctggccacagagggcggcgtgctgaagaaggtgatccgccacaagaggcagagcggcgtgaatgccaccctgcctgaggagaaccagcctgtggtgttcaaccacgtgtacaacatcaagctgcctgtgggcagccagtgcagcgtggacctggagagcgccagcggggagaaggacctggcccctccttctgagcccagcgagagcttccaggagcacacagtggatggagagaaccagatcgtgttcacccaccgcatcaacatcccccggcgggcctgtggctgtgccgccgccccagatgtgaaggagctgctgagccggctggaggagctggagaacctggtgagcagcctgcgggagcagtgcacagctggggccggctgctgcctgcagcctgccaccggccgcctggacacccggcccttctgcagcggccggggcaacttcagcacagagggctgcggctgtgtgtgtgagcccggctggaagggccccaactgcagcgagccagaatgtcctggcaactgccacctgcggggccgctgcattgatggccagtgcatctgtgatgatggcttcaccggggaggactgcagccagctggcctgccccagcgactgcaatgaccagggcaaatgtgtgaatggagtgtgcatctgctttgagggctacgccggggctgactgcagccgggagatctgccctgtgccctgcagcgaggagcacggcacctgtgtggatggcctgtgtgtgtgccatgatggctttgctggagatgactgcaacaagcccctgtgcctgaacaactgctacaacagaggccgctgtgtggagaatgaatgtgtgtgtgatgagggcttcaccggggaggactgcagcgagctgatctgccccaatgactgctttgaccggggccgctgcatcaatggcacctgctactgtgaggagggcttcaccggggaggactgtgggaagcccacctgcccccacgcctgccacacccagggccgctgtgaggagggccagtgtgtgtgtgatgagggctttgctggggtggactgcagcgagaagcgctgcccagctgactgccacaacagaggccgctgtgtggatggccgctgtgaatgtgatgatggcttcaccggggctgactgtggggagctgaagtgccccaacggctgcagcggccacggccgctgtgtgaatggccagtgtgtgtgtgatgagggctacaccggggaggactgcagccagctgcgctgccccaatgactgccacagccggggccgctgtgtggagggcaaatgtgtgtgtgagcagggcttcaagggctatgactgcagcgacatgagctgccccaatgactgccaccagcacggccgctgtgtgaatggcatgtgtgtgtgtgatgatggctacaccggggaggactgccgggaccggcagtgcccccgggactgcagcaacagaggcctgtgtgtggatggccagtgtgtgtgtgaagatggcttcaccggccctgactgtgccgagctgagctgccccaatgactgccacggccagggccgctgtgtgaatggccagtgtgtgtgccacgagggcttcatgggcaaggactgcaaggagcagcgctgccccagcgactgccacggccagggccgctgtgtggatggccagtgcatctgccacgagggcttcaccggcctggactgtggccagcacagctgccccagcgactgcaacaacctgggccagtgtgtgtctggccgctgcatctgcaatgaaggctacagcggggaggactgcagcgaggtgtccccacccaaggacctggtggtgacagaggtgacagaggagaccgtgaacctggcctgggacaatgagatgagggtgacagagtacctggtggtgtacacccccacccatgagggcggcctggagatgcagttccgggtgcctggggaccagaccagcaccatcatccaggagctggagcccggggtggagtacttcatccgggtgtttgccatcctggagaacaagaagagcatccctgtgtctgcccgggtggccacctacctgcctgcccctgagggcctgaagttcaagagcatcaaggagacctctgtggaggtggagtgggaccccctggacatcgcctttgagacctgggagatcatcttcaggaacatgaacaaggaggatgaaggagagatcaccaagagcctgcggcggcctgagaccagctaccggcagacaggcctggcccctggccaggagtatgagatcagcctgcacatcgtgaagaacaacacccggggccctggcctgaagagggtgaccaccacccggctggatgcccccagccagatcgaggtgaaggatgtgacagacaccacagccctgatcacctggttcaagcccctggccgagattgatggcatcgagctgacctacggcatcaaggatgtgcctggggacaggaccaccatcgacctgacagaagatgagaaccagtacagcatcggcaacctgaagccagacacagaatatgaggtgtccctcatcagccggcggggggacatgagcagcaacccagccaaggagaccttcaccaccggcctggatgcccccaggaacctgcggcgggtgtcccagacagacaacagcatcaccctggagtggagaaatggcaaggccgccatcgacagctaccgcatcaagtatgcccccatctctggaggagaccacgccgaggtggatgtgcccaagagccagcaggccaccaccaagaccaccctgaccggcctgcggcctggaacagaatatggaattggagtgtctgctgtgaaggaggacaaggagagcaacccagccaccatcaatgctgccacagagctggacacccccaaggacctgcaggtgtctgaaacagctgagaccagcctgaccctgctgtggaagacccccctggccaagtttgaccgctaccgcctgaactacagcctgcccaccggccagtgggtgggcgtgcagctgcccaggaacaccaccagctatgtgctgcggggcctggagcccggccaggagtacaacgtgctgctgacagctgagaagggccgccacaagagcaagccagcccgggtgaaggccagcacagccaaggagcctgagatcggcaacctgaatgtgtctgacatcaccccagagagcttcaacctgtcctggatggccacagatggcatctttgagaccttcaccatcgagatcatcgacagcaaccggctgctggagaccgtggagtacaacatctctggagctgagaggacagcccacatcagcggcctgccccccagcacagacttcatcgtgtacctgagcggcctggcccccagcatccgcaccaagaccatcagcgccacagccaccacagagcccaagccccagctgggcaccctcatcttcagcaacatcacccccaagagcttcaacatgtcctggaccacccaggccggcctgtttgccaagatcgtcatcaacgtgtctgatgcccacagcctgcacgagagccagcagttcaccgtgtctggagatgccaagcaggcccacatcaccggcctggtggagaacacaggctatgatgtgtctgtggccggcaccaccctggccggggaccccacccggcccctgacagcctttgtgatcacagaggccgagcctgaggtggacaacctgctggtgtctgatgccaccccagatggcttccggctgtcctggacagcagatgagggcgtgtttgacaactttgtgctgaagatccgggacaccaagaagcagagcgagcccctggagatcaccctgctggcccctgagaggacccgggacatcaccggcctgcgggaggccacagaatatgaaattgagctgtatggcatcagcaagggccgccgcagccagacagtgtctgccatcgccaccacagccatgggcagccccaaggaggtgatcttcagtgacatcacagagaacagcgccaccgtgtcctggagggcccccacagcccaggtggagagcttccgcatcacctacgtgcccatcactggaggcacccccagcatggtgacagtggatggcaccaagacccagacccggctggtgaagctgatccctggggtggagtacctggtgtccatcatcgccatgaagggctttgaggagagcgagcctgtgtctggcagcttcaccacagccctggatggccccagcggcctggtgacagccaacatcacagacagcgaggccctggcccgctggcagcctgccatcgccaccgtggacagctatgtgatctcctacacaggagagaaggtgcctgagatcaccaggacagtgtctggcaacacagtggagtatgccctgacagacctggagcccgccacagagtacaccctgcgcatctttgctgagaagggcccccagaagagcagcaccatcacagccaagttcaccacagacctggacagcccccgggacctgacagccacagaggtgcagagcgagacagccctgctgacctggaggcctccccgggcctctgtgacaggctacctgctggtgtatgagagcgtggatggcaccgtgaaggaggtgattgtgggccctgacaccaccagctacagcctggccgacctgagccccagcacccactacacagccaagatccaggccctgaatggccccctgcggagcaacatgatccagaccatcttcaccaccatcggcctgctgtaccccttccccaaggactgcagccaggccatgctgaatggagacaccaccagcggcctgtacaccatctacctgaatggagacaaggccgaggccctggaggtgttctgtgacatgaccagtgatggcggcggctggatcgtgttcctgcggaggaagaatggaagagagaacttctaccagaactggaaggcctatgctgctggctttggagacagaagagaggagttctggctgggcctggacaacctgaacaagatcacagcccagggccagtatgagctgcgggtggacctgcgggaccacggggagacagcctttgctgtgtatgacaagttctctgtgggagatgccaagacccgctacaagctgaaggtggagggctacagcggcacagctggggacagcatggcctaccacaacggccgctccttcagcacctttgacaaggacacagacagcgccatcaccaactgtgccctgagctacaagggggccttctggtacagaaactgccaccgggtgaacctgatgggccgctatggagacaacaaccacagccagggcgtgaactggttccactggaagggccacgagcacagcatccagtttgctgagatgaagctgcggcccagcaacttcaggaacctggagggccgcaggaagagggcctag

SEQ ID NO: 172916 - DNA, 4077 bp, Artificial Sequence
  Description of Artificial Sequence: Synthetic coding sequence
atgggcgcagatggagaaacagtggtgctgaagaacatgctgattggcatcaacctgatcctgctgggctccatgatcaagcccagcgagtgccagctggaggtgaccacagagcgggtgcagaggcagagcgtggaggaggagggcggcatcgccaactacaacaccagcagcaaggagcagcctgtggtgttcaaccacgtgtacaacatcaacgtgcccctggacaacctgtgcagcagcggcctggaggccagcgctgagcaggaggtgtctgcagaagatgagaccctggccgagtacatgggccagaccagtgaccacgagagccaggtgaccttcacccaccgcatcaacttccccaagaaggcctgcccctgtgccagcagcgcccaggtgctgcaggagctgctgagcagaattgagatgctggagcgggaggtgtctgtgctgcgggaccagtgcaatgccaactgctgccaggagagcgctgccaccggccagctggactacatcccccactgcagcggccacggcaacttctcctttgagagctgtggctgcatctgcaatgaaggctggtttgggaagaactgcagcgagccctactgccccctgggctgcagcagccggggcgtgtgtgtggatggccagtgcatctgtgacagcgagtacagcggagatgactgcagcgagctgcgctgccccacagactgcagcagccggggcctgtgtgtggatggagaatgtgtgtgtgaggagccctacacaggagaggactgccgggagctgcgctgccctggggactgcagcggcaagggccgctgtgccaacggcacctgcctgtgtgaggagggctacgtgggggaggactgtggccagaggcagtgcctgaatgcctgcagcggccggggccagtgtgaggagggcctgtgtgtgtgtgaggagggctaccagggccctgactgcagcgctgtggcccctcctgaggacctgcgggtggccggcatcagtgacaggagcattgagctggagtgggatggccccatggctgtgacagaatatgtgatctcctaccagcccacagccctgggcggcctgcagctgcagcagagggtgcctggggactggagcggcgtgaccatcacagagctggagcccggcctgacctacaacatctctgtgtatgctgtgatcagcaacatcctgagcctgcccatcacagccaaggtggccacccacctgagcaccccccagggcctgcagttcaagaccatcacagagaccaccgtggaggtgcagtgggagcccttctccttctcctttgatggctgggagatctccttcatccccaagaacaatgaaggaggagtgattgcccaggtgcccagtgatgtgaccagcttcaaccagacaggcctgaagccaggagaggagtacatcgtgaatgtggtggccctgaaggagcaggcccggagcccccccaccagcgcctctgtgtccacagtgattgatggccccacccagatcctggtgagagatgtgtctgacacagtggcctttgtggagtggatccccccccgggccaaggtggacttcatcctgctgaagtatggcctggtgggcggggagggcggccgcaccaccttccggctgcagccccccctgagccagtacagcgtgcaggccctgcggcccggcagccgctatgaggtgtctgtgtctgctgtgcggggcaccaatgaaagtgacagcgccaccacccagttcaccacagaaattgatgcccccaagaacctgcgggtgggcagcaggacagccaccagcctggacctggagtgggacaacagcgaggccgaggtgcaggagtacaaggtggtgtacagcaccctggccggggagcagtaccacgaggtgctggtgccccggggcatcggccccaccacccgggccaccctgacagacctggtgcccggcacagaatatggagtgggcatctctgctgtgatgaacagccagcagagcgtgcctgccaccatgaatgccaggacagagctggacagcccccgggacctgatggtgacagccagcagcgagaccagcatcagcctcatctggaccaaggccagcggccccatcgaccactaccgcatcaccttcacccccagcagcggcatcgccagcgaggtgacagtgcccaaggacaggaccagctacaccctgacagacctggagcccggggctgagtacatcatctctgtgacagctgagcggggccggcagcagagcctggagagcacagtggatgccttcaccggcttccggcccatcagccacctgcacttcagccacgtgaccagcagctctgtgaacatcacctggagcgaccccagccccccagctgacaggctcatcctgaactacagccccagagatgaggaggaggagatgatggaggtgtccctggatgccaccaagagacatgctgtgctgatgggcctgcagcctgccacagagtacatcgtgaacctggtggccgtgcacggcaccgtgaccagcgagcccatcgtgggcagcatcaccaccggcatcgacccccccaaggacatcaccatcagcaatgtgaccaaggacagcgtgatggtgtcctggagcccccctgtggccagctttgactactacagagtgtcctaccggcccacccaggtgggccgcctggacagctctgtggtgcccaacacagtgacagagttcaccatcacccggctgaacccagccacagaatatgagatcagcctgaacagcgtgcggggccgggaggagagcgagcgcatctgcaccctggtgcacacagccatggacaaccctgtggacctgattgccaccaacatcacccccacagaggccctgctgcagtggaaggcccctgtgggggaggtggagaactacgtgattgtgctgacccactttgctgtggccggggagaccatcctggtggatggagtgtctgaggagttccggctggtggacctgctgcccagcacccactacacagccaccatgtatgccaccaacggccccctgaccagcggcaccatcagcaccaacttcagcaccctgctggaccccccagccaacctgacagccagcgaggtgacccggcagagcgccctgatctcctggcagccccccagggctgagattgaaaattatgtgctgacctacaagagcacagatggcagcaggaaggagctgattgtggatgctgaggacacctggatccggctggagggcctgctggagaacacagactacacagtgctgctgcaggccgcccaggacaccacctggagcagcatcaccagcacagccttcaccactggaggccgggtcttcccccacccccaggactgtgcccagcacctgatgaatggagacaccctgtctggagtgtaccccatcttcctgaatggagagctgagccagaagctgcaggtgtactgtgacatgaccacagatggcggcggctggatcgtgttccagaggcggcagaatggccagacagacttcttcaggaagtgggccgactacagagtgggctttggaaatgtggaggatgagttctggctgggcctggacaacatccaccgcatcaccagccagggccgctatgagctgcgggtggacatgagagatggccaggaggccgcctttgccagctatgaccgcttctctgtggaggacagcaggaacctgtacaagctgagaattggcagctacaatggaacagctggggacagcctgagctaccaccagggccggcccttcagcacagaagatcgggacaatgatgtggccgtgaccaactgtgccatgagctacaagggggcctggtggtacaagaactgccacaggaccaacctgaatggcaagtacggggagagccgccacagccagggcatcaactggtaccactggaagggccacgagttcagcatcccctttgtggagatgaagatgaggccctacaaccaccggctgatggccggcaggaagaggcagagcctgcagttctag

SEQ ID NO: 172917 - DNA, 3807 bp, Artificial Sequence
  Description of Artificial Sequence: Synthetic coding sequence
atgggcgcagatggagaaacagtggtgctgaagaacatgctgattggcatcaacctgatcctgctgggctccatgatcaagcccagcgagtgccagctggaggtgaccacagagcgggtgcagaggcagagcgtggaggaggagggcggcatcgccaactacaacaccagcagcaaggagcagcctgtggtgttcaaccacgtgtacaacatcaacgtgcccctggacaacctgtgcagcagcggcctggaggccagcgctgagcaggaggtgtctgcagaagatgagaccctggccgagtacatgggccagaccagtgaccacgagagccaggtgaccttcacccaccgcatcaacttccccaagaaggcctgcccctgtgccagcagcgcccaggtgctgcaggagctgctgagcagaattgagatgctggagcgggaggtgtctgtgctgcgggaccagtgcaatgccaactgctgccaggagagcgctgccaccggccagctggactacatcccccactgcagcggccacggcaacttctcctttgagagctgtggctgcatctgcaatgaaggctggtttgggaagaactgcagcgagccctactgccccctgggctgcagcagccggggcgtgtgtgtggatggccagtgcatctgtgacagcgagtacagcggagatgactgcagcgagctgcgctgccccacagactgcagcagccggggcctgtgtgtggatggagaatgtgtgtgtgaggagccctacacaggagaggactgccgggagctgcgctgccctggggactgcagcggcaagggccgctgtgccaacggcacctgcctgtgtgaggagggctacgtgggggaggactgtggccagaggcagtgcctgaatgcctgcagcggccggggccagtgtgaggagggcctgtgtgtgtgtgaggagggctaccagggccctgactgcagcgctgtggcccctcctgaggacctgcgggtggccggcatcagtgacaggagcattgagctggagtgggatggccccatggctgtgacagaatatgtgatctcctaccagcccacagccctgggcggcctgcagctgcagcagagggtgcctggggactggagcggcgtgaccatcacagagctggagcccggcctgacctacaacatctctgtgtatgctgtgatcagcaacatcctgagcctgcccatcacagccaaggtggccacccacctgagcaccccccagggcctgcagttcaagaccatcacagagaccaccgtggaggtgcagtgggagcccttctccttctcctttgatggctgggagatctccttcatccccaagaacaatgaaggaggagtgattgcccaggtgcccagtgatgtgaccagcttcaaccagacaggcctgaagccaggagaggagtacatcgtgaatgtggtggccctgaaggagcaggcccggagcccccccaccagcgcctctgtgtccacagtgattgatggccccacccagatcctggtgagagatgtgtctgacacagtggcctttgtggagtggatccccccccgggccaaggtggacttcatcctgctgaagtatggcctggtgggcggggagggcggccgcaccaccttccggctgcagccccccctgagccagtacagcgtgcaggccctgcggcccggcagccgctatgaggtgtctgtgtctgctgtgcggggcaccaatgaaagtgacagcgccaccacccagttcaccacagaaattgatgcccccaagaacctgcgggtgggcagcaggacagccaccagcctggacctggagtgggacaacagcgaggccgaggtgcaggagtacaaggtggtgtacagcaccctggccggggagcagtaccacgaggtgctggtgccccggggcatcggccccaccacccgggccaccctgacagacctggtgcccggcacagaatatggagtgggcatctctgctgtgatgaacagccagcagagcgtgcctgccaccatgaatgccaggacagagctggacagcccccgggacctgatggtgacagccagcagcgagaccagcatcagcctcatctggaccaaggccagcggccccatcgaccactaccgcatcaccttcacccccagcagcggcatcgccagcgaggtgacagtgcccaaggacaggaccagctacaccctgacagacctggagcccggggctgagtacatcatctctgtgacagctgagcggggccggcagcagagcctggagagcacagtggatgccttcaccggcatcgacccccccaaggacatcaccatcagcaatgtgaccaaggacagcgtgatggtgtcctggagcccccctgtggccagctttgactactacagagtgtcctaccggcccacccaggtgggccgcctggacagctctgtggtgcccaacacagtgacagagttcaccatcacccggctgaacccagccacagaatatgagatcagcctgaacagcgtgcggggccgggaggagagcgagcgcatctgcaccctggtgcacacagccatggacaaccctgtggacctgattgccaccaacatcacccccacagaggccctgctgcagtggaaggcccctgtgggggaggtggagaactacgtgattgtgctgacccactttgctgtggccggggagaccatcctggtggatggagtgtctgaggagttccggctggtggacctgctgcccagcacccactacacagccaccatgtatgccaccaacggccccctgaccagcggcaccatcagcaccaacttcagcaccctgctggaccccccagccaacctgacagccagcgaggtgacccggcagagcgccctgatctcctggcagccccccagggctgagattgaaaattatgtgctgacctacaagagcacagatggcagcaggaaggagctgattgtggatgctgaggacacctggatccggctggagggcctgctggagaacacagactacacagtgctgctgcaggccgcccaggacaccacctggagcagcatcaccagcacagccttcaccactggaggccgggtcttcccccacccccaggactgtgcccagcacctgatgaatggagacaccctgtctggagtgtaccccatcttcctgaatggagagctgagccagaagctgcaggtgtactgtgacatgaccacagatggcggcggctggatcgtgttccagaggcggcagaatggccagacagacttcttcaggaagtgggccgactacagagtgggctttggaaatgtggaggatgagttctggctgggcctggacaacatccaccgcatcaccagccagggccgctatgagctgcgggtggacatgagagatggccaggaggccgcctttgccagctatgaccgcttctctgtggaggacagcaggaacctgtacaagctgagaattggcagctacaatggaacagctggggacagcctgagctaccaccagggccggcccttcagcacagaagatcgggacaatgatgtggccgtgaccaactgtgccatgagctacaagggggcctggtggtacaagaactgccacaggaccaacctgaatggcaagtacggggagagccgccacagccagggcatcaactggtaccactggaagggccacgagttcagcatcccctttgtggagatgaagatgaggccctacaaccaccggctgatggccggcaggaagaggcagagcctgcagttctag

SEQ ID NO: 172918 - DNA, 4077 bp, Artificial Sequence; identical to SEQ ID NO: 172916
  Description of Artificial Sequence: Synthetic coding sequence

SEQ ID NO: 172919 - DNA, 534 bp, Artificial Sequence
  Description of Artificial Sequence: Synthetic coding sequence
tgaatcaacttccccaagaaggcctgcccctgtgccagcagcgcccaggtgctgcaggagctgctgagcagaattgagatgctggagcgggaggtgtctgtgctgcgggaccagtgcaatgccaactgctgccaggagagcgctgccaccgtggcccccccagaggacctgcgggtggccggcatcagtgacaggagcattgagctggagtgggatggccccatggctgtgacagaatatgtgatctcctaccagcccacagccctgggcggcctgcagctgcagcagagggtgcctggggactggagcggcgtgaccatcacagagctggagcccggcctgacctacaacatctctgtgtatgctgtgatcagcaacatcctgagcctgcccatcacagccaaggtggccacccacctgagcaccccccagggcctgcagttcaagaccatcacagagaccaccgtggaggtgcagtgggagcccttctccttctcctttgatggctgggagatctccttcatccccaagtag

SEQ ID NO: 172920 - DNA, 12669 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacgccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccatggaggccagagggtgggccccatcagcgtcatcggcgtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagaaccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172921 - DNA, 6450 bp, Artificial Sequence
  Description of Artificial Sequence: Synthetic coding sequence
tgagctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggcagaagagtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccatggaggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccacgaggacagagtgaccatcagcggcctggagccagacaacaagtacaagatgaacctgtatggcttccacggcggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggcagaagagtgggccctgtgtccacagtgggcgtgacagccccccaggaggatgtggatgagacccccagccccacagagcctggaacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccggcggctgggccctgtgtctgctgtgggcgtgacagaagatgaagctgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccatggaggccagagggtgggccccatctctgtgactggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggccggcgggtgggccctgtgtccacagtgggcgtgacagtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccatggaggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagattctgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgcttcggcgtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacaccccaggcggccagacccaggagatcctgctgcccggcggcatcaccagccaccagctgctgggcctcttccccagcaccagctacaatgcccggctgcaggccatgtggggccagagcctgctgccccctgtgtccaccagcttcaccaccggcggcctgcgcatccccttcccccgggactgtggggaggagatgcagaatggagctggggccagcaggaccagcaccatcttcctgaatggaaaccgggagcggcccctcatcgtgttctgtgacatggagacagatggcggcggctggctggtgttccagaggaggatggatggccagacagacttctggagggactgggaggactatgcccacggcttcggcaacatcagcggggagttctggctgggcaatgaggccctgcacagcctgacccaggccggggactacagcatgagggtggacctgcgggctggagatgaagctgtgtttgcccagtatgacagcttccacgtggacagcgctgctgagtactaccgcctgcacctggagggctaccacggcacagctggggacagcatgagctaccacagcggctctgtgttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172922 - DNA, 27 bp, Artificial Sequence
  Description of Artificial Sequence: Synthetic coding sequence
atgatgcctgcccagtatgccctgtag

SEQ ID NO: 172923 - DNA, 27 bp, Artificial Sequence
  Description of Artificial Sequence: Synthetic coding sequence
atgatgcctgcccagtatgccctgtag

SEQ ID NO: 172924 - DNA, 9891 bp, Artificial Sequence
  Description of Artificial Sequence: Synthetic coding sequence
tgaagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggccccaggccgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctggccccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccatggaggccagagggtgggccccatcagcgtcatcggcgtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcgggtggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagaaccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172925 - DNA, 12669 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccggctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccatggaggccagagggtgggccccatcagcgtcatcggcgtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagacccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgattgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172926 - DNA, 27 bp, Artificial Sequence
  Description of Artificial Sequence: Synthetic coding sequence
atgatgcctgcccagtatgccctgtag

SEQ ID NO: 172927 - DNA, 1905 bp, Artificial Sequence
  Description of Artificial Sequence: Synthetic coding sequence
tgaagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccggctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacctag

SEQ ID NO: 172928 - DNA, 27 bp, Artificial Sequence
  Description of Artificial Sequence: Synthetic coding sequence
atgatgcctgcccagtatgccctgtag

SEQ ID NO: 172929 - DNA, 12669 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccggctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagcccccccaccctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccatggaggccagagggtgggccccatcagcgtcatcggcgtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggaccatcccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagacccaggagatcctgctgcccggcggcatcaccagccaccagctgctgggcctcttccccagcaccagctacaatgcccggctgcaggccacctggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172930 - DNA, 27 bp, Artificial Sequence
  Description of Artificial Sequence: Synthetic coding sequence
atgatgcctgcccagtatgccctgtag

SEQ ID NO: 172931 - DNA, 6843 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacctag

SEQ ID NO: 172932 - DNA, 2022 bp, Artificial Sequence
  Description of Artificial Sequence: Synthetic coding sequence
atgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgcttcggcgtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacaccccaggcggccagacccaggagatcctgctgcccggcggcatcaccagccaccagctgctgggcctcttccccagcaccagctacaatgcccggctgcaggccatgtggggccagagcctgctgccccctgtgtccaccagcttcaccaccggcggcctgcgcatccccttcccccgggactgtggggaggagatgcagaatggagctggggccagcaggaccagcaccatcttcctgaatggaaaccgggagcggcccctcatcgtgttctgtgacatggagacagatggcggcggctggctggtgttccagaggaggatggatggccagacagacttctggagggactgggaggactatgcccacggcttcggcaacatcagcggggagttctggctgggcaatgaggccctgcacagcctgacccaggccggggactacagcatgagggtggacctgcgggctggagatgaagctgtgtttgcccagtatgacagcttccacgtggacagcgctgctgagtactaccgcctgcacctggagggctaccacggcacagctggggacagcatgagctaccacagcggctctgtgttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172933 - DNA, 654 bp, Artificial Sequence
  Description of Artificial Sequence: Synthetic coding sequence
gcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacctag

SEQ ID NO: 172934 - DNA, 12729 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccggctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagaagatgaggccgagaccacccaggccgtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagcccccaaggatgaggccgagaccacccaggccgtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagacccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgattgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172935 - DNA, 12729 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacgccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagccccccaggcctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagaagatgaggccgagaccacccaggccgtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagcccccaaggatgaggccgagaccacccaggccgtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggacagtgccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagaaccaggagatcctgctgcccggcggcatcaccagccaccagctgctgggcctcttccccagcaccagctacaatgcccggctgcaggccatgtggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172936 - DNA, 843 bp, Artificial Sequence
  Description of Artificial Sequence: Synthetic coding sequence
atggtgacagaaggagaatttgacagctttgagatccagtacacagacagagatggccagctgcagatggtgcgcatcggcggggacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccacggcggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggcagaagagtgggccctgtgtctgctgtgggcgtgacctag

SEQ ID NO: 172937 - DNA, 12729 bp, Artificial Sequence
  Description of Artificial Sequence: Synthetic coding sequence
atgatgcctgcccagtatgccctgaccagcagcctggtgctgctggtgctgctgagcacagcccgggccggccccttcagcagccgcagcaatgtgaccctgcctgccccccggcccccaccccagcccggcggccacacagtgggcgctggggtgggcagccccagcagccagctgtatgagcacacagtggagggcggggagaagcaggtggtgttcacccaccgcatcaacctgccccccagcacaggctgcggctgccccccaggcacagagccccctgtgctggccagcgaggtgcaggccctgcgggtgcggctggagatcctggaggagctggtgaagggcctgaaggagcagtgcaccggcggctgctgcccagccagcgcccaggccggcaccggccagacagatgtgaggaccctgtgcagcctgcacggcgtgtttgacctgagccgctgcacctgcagctgtgagcccggctggggcggccccacctgcagcgaccccacagatgctgagatcccccccagcagcccccccagcgccagcggcagctgcccagatgactgcaatgaccagggccgctgtgtgcggggccgctgtgtgtgcttccctggctacacaggccccagctgtggctggcccagctgccctggggactgccagggccggggccgctgtgtgcagggcgtgtgtgtgtgcagagctggcttcagcggccctgactgcagccagaggagctgcccccggggctgcagccagaggggccgctgtgagggcggccgctgtgtgtgtgaccccggctacacaggagatgactgtggcatgaggagctgcccccggggctgcagccagaggggccgctgtgaaaatggccgctgtgtgtgcaaccctggctacaccggggaggactgtggggtgcgcagctgcccccggggctgcagccagaggggccgctgcaaggatggccgctgtgtgtgtgaccccggctacacaggagaggactgtggcaccaggagctgcccctgggactgtggggagggcggccgctgtgtggatggccgctgtgtgtgctggccaggctacaccggggaggactgcagcaccaggacctgcccccgggactgccggggccggggccgctgtgaagatggagagtgcatctgtgacaccggctacagcggagatgactgtggggtgcgcagctgccctggggactgcaaccagaggggccgctgtgaagatggccgctgtgtgtgctggccaggctacacaggaacagactgtggcagccgggcctgcccccgggactgccggggccggggccgctgtgaaaatggagtgtgtgtgtgcaatgccggctacagcggggaggactgtggggtgcgcagctgccctggggactgccggggccggggccgctgtgagagcggccgctgcatgtgctggccaggctacacaggccgggactgtggcacccgggcctgccctggggactgccggggccggggccgctgtgtggatggccgctgtgtgtgcaaccctggcttcaccggggaggactgtggcagccgccgctgccctggggactgccggggccacggcctgtgtgaagatggagtgtgtgtgtgtgatgctggctacagcggggaggactgcagcaccaggagctgccctgggggctgccggggccggggccagtgcctggatggccgctgtgtgtgtgaagatggctacagcggggaggactgtggggtgcggcagtgccccaatgactgcagccagcacggcgtgtgccaggatggagtgtgcatctgctgggagggctacgtgtctgaggactgcagcatccgcacctgccccagcaactgccacggccggggccgctgtgaggagggccgctgcctgtgtgaccccggctacacaggccccacctgtgccaccaggatgtgcccagctgactgccggggccggggccgctgtgtgcagggcgtgtgcctgtgccacgtgggctatggaggagaggactgtggccaggaggagcccccagccagcgcctgccctgggggctgcggcccccgggagctgtgccgggccggccagtgtgtgtgtgtggagggcttccggggccctgactgtgccatccagacctgccctggggactgccggggccgcggggagtgccatgatggcagctgtgtgtgcaaggatggctatgctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccggctgggcaacctgtgggtgacagaccccaccccagacagcctgcacctgtcctggacagtgcctgagggccagtttgacaccttcatggtgcagtacagagacagagatggccggccccaggtggtgcctgtggagggccctgagaggagctttgtggtgagcagcctggaccctgaccacaagtaccgcttcaccctgtttggcatcgccaacaagaagagatatggccccctgacagcagatggcaccacagcccctgagaggaaggaggagcccccccaccctgagttcctggagcagcccctgctgggggagctgactgtgactggagtgaccccagacagcctgcggctgtcctggacagtggcccagggcccctttgacagcttcatggtgcagtacaaggatgcccagggccagccccaggccgtgcctgtggccggagatgaaaatgaggtgacagtgcccggcctggaccctgacaggaagtacaagatgaacctgtatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggccaagctgcggctgggccagatgacagtgcgggacatcaccagtgacagcctgagcctgtcctggacagtgcctgagggccagtttgaccacttcctggtgcagttcaagaatggagatggccagcccaaggctgtgcgggtgcccggccatgaagatggagtgaccatcagcggcctggagccagaccacaagtacaagatgaacctgtatggcttccacggcggccagagggtgggccctgtgtctgctgtgggcctgacagcccctgggaaggatgaggagatggccccagccagcacagagccccccaccccagagccccccatcaagccccggctggaggagctgactgtgacagatgccaccccagacagcctgagcctgtcctggacagtgcctgagggccagtttgaccacttcctggtgcagtacaagaatggagatggccagcccaaggccaccagggtgcccggccatgaagatagagtgaccatcagcggcctggagccagacaacaagtacaagatgaacctgtatggcttccatggaggccagagggtgggccctgtgtctgccatcggcgtgacagctgctgaggaggagacccccagccccacagagcccagcatggaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtccacagtgggcgtgacagccccccaggaggatgtggatgagacccccagccccacagagcccggcacagaggcccctgagcccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccgccgcctgggccctgtgtctgctgtgggcgtgacagaagatgaggccgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgattggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagaagatgaggccgagaccacccaggccgtgcccaccaccaccccagagccccccaacaagccccggctgggggagctgactgtgacagatgccaccccagacagcctgagcctgtcctggatggtgcctgagggccagtttgaccacttcctggtgcagtacagaaatggagatggccagcccaaggtggtgcgggtgcccggccatgaagatggagtgaccatcagcggcctggagccagaccacaagtacaagatgaacctgtatggcttccacggcggccagagggtgggccccatctctgtgattggagtgacagctgctgaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacagcccccaaggatgaggccgagaccacccaggccgtgcccaccatgaccccagagccccccatcaagccccggctgggggagctgactgtgacagatgccaccccagacagcctgagcctgtcctggatggtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccctgtgtctgccatcggcgtgacagaggaggagacccccagccccacagagcccagcacagaggcccctgaggcccctgaggagcccctgctgggggagctgactgtgacaggcagcagcccagacagcctgagcctgtcctggaccatcccccagggccgctttgacagcttcaccgtgcagtacaaggacagagatggccagccccaggtggtgcgggtgcggggggaggagagcgaggtgacagtgggcggcctggagcccggcaggaagtacaagatgcacctgtatggcctgcacgagggccagagggtgggccctgtgtccacagtgggcatcacagcccccctgcccacccccctgcctgtggagccccggctgggggagctggccgtggccgctgtgaccagtgacagcgtgggcctgtcctggacagtggcccagggcccctttgacagcttcctggtgcagtacagagatgcccagggccagccccaggccgtgcctgtgtctggggacctgcgggctgtggccgtgtctggcctggaccctgccaggaagtacaagttcctgctgtttggcctgcagaatggcaagagacatggccctgtgcctgtggaggccaggacagccccagacaccaagcccagcccccggctgggggagctgactgtgacagatgccaccccagacagcgtgggcctgtcctggacagtgcctgagggggagtttgacagctttgtggtgcagtacaaggacaaggatggccgcctgcaggtggtgcctgtggccgccaaccagcgggaggtgacagtgcagggcctggagcccagcaggaagtaccgcttcctgctgtatggcctgagcggcaggaagaggctgggccccatctctgctgacagcaccacagcccccctggagaaggagctgcccccccacctgggggagctgactgtggccgaggagaccagcagcagcctgcggctgtcctggacagtggcccagggcccctttgacagctttgtggtgcagtacagagacacagatggccagcccagggctgtgcctgtggccgctgaccagaggacagtgacagtggaggacctggagcccgggaagaagtacaagttcctgctgtatggcctgctgggcggcaagaggctgggccctgtgtctgccctgggcatgacagcccctgaggaggacaccccagcccctgagctggcccctgaggcccctgagcccccagaggagccccggctgggcgtgctgactgtgacagacaccaccccagacagcatgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgctttggagtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgacatccaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacacccctgggggccagacccaggagatcctgctgcccggcggcatcaccagccaccagctgctgggcctcttccccagcaccagctacaatgcccggctgcaggccacctggggccagagcctgctgccccctgtgtccaccagcttcaccactggaggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggctttggaaacatctctggagagttctggctgggcaatgaggccctgcacagcctgacccaggccggggactacagcatgagggtggacctgcgggctggagatgaggccgtgtttgcccagtatgacagcttccacgtggacagcgctgctgagtactaccgcctgcacctggagggctaccatggaacagctggggacagcatgagctaccacagcggcagcgtcttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172938 - DNA, 2022 bp, Artificial Sequence
  Description of Artificial Sequence: Synthetic coding sequence
atgaggctgtcctggagcgtggcccagggcccctttgacagctttgtggtgcagtatgaggacaccaacggccagccccaggccctgctggtggatggagaccagagcaagatcctgatcagcggcctggagcccagcaccccctaccgcttcctgctgtatggcctgcacgagggcaagaggctgggccccctgtctgctgagggcaccaccggcctggccccagctggccagaccagcgaggagagccggccccggctgagccagctgtctgtgacagatgtgaccaccagcagcctgcggctgaactgggaggcccctcctggggcctttgacagcttcctgctgcgcttcggcgtgcccagccccagcaccctggagccccacccccggcccctgctgcagcgggagctgatggtgcccggcaccaggcacagcgctgtgctgcgggacctgcggagcggcaccctgtacagcctgaccctgtatggcctgcggggcccccacaaggctgacagcatccagggcacagcccggaccctgagccctgtgctggagagcccccgggacctgcagttcagcgagatccgggagaccagcgccaaggtgaactggatgcccccacccagcagagctgacagcttcaaggtgtcctaccagctggctgatggaggagagccccagagcgtgcaggtggatggccaggcccggacccagaagctgcagggcctcatccctggggcccgctatgaggtgacagtggtgtctgtgcggggctttgaggagagcgagcccctgaccggcttcctgaccaccgtgcctgatggccccacccagctgcgggccctgaacctgacagagggctttgctgtgctgcactggaagccaccccagaaccctgtggacacctatgatgtgcaggtgacagcccctggggccccacccctgcaggccgagaccccaggcagcgctgtggactaccccctgcatgacctggtgctgcacaccaactacacagccaccgtgcggggcctgcggggccccaacctgaccagccctgccagcatcaccttcaccaccggcctggaggccccccgggacctggaggccaaggaggtgacccccaggacagccctgctgacctggacagagccccctgtgcggcctgctggctacctgctgtccttccacaccccaggcggccagaaccaggagatcctgctgcccggcggcatcaccagccaccagctgctgggcctcttccccagcaccagctacaatgcccggctgcaggccatgtggggccagagcctgctgccccctgtgtccaccagcttcaccaccggcggcctgcgcatccccttcccccgggactgtggggaggagatgcagaatggagctggggccagcaggaccagcaccatcttcctgaatggaaaccgggagcggcccctgaatgtgttctgtgacatggagacagatggcggcggctggctggtgttccagaggaggatggatggccagacagacttctggagggactgggaggactatgcccacggcttcggcaacatcagcggggagttctggctgggcaatgaggccctgcacagcctgacccaggccggggactacagcatgagggtggacctgcgggctggagatgaagctgtgtttgcccagtatgacagcttccacgtggacagcgctgctgagtactaccgcctgcacctggagggctaccacggcacagctggggacagcatgagctaccacagcggctctgtgttcagcgcccgggaccgggaccccaacagcctgctgatcagctgtgctgtgtcctacagaggagcctggtggtacagaaactgccactacgccaacctgaatggcctgtatggcagcacagtggaccaccagggcgtgtcctggtaccactggaagggctttgagttctctgtgcccttcacagagatgaagctgcggcccaggaacttccgcagccctgctgggggcggctag

SEQ ID NO: 172939 - DNA, 654 bp, Artificial Sequence; identical to SEQ ID NO: 172933
  Description of Artificial Sequence: Synthetic coding sequence

SEQ ID NO: 172940 - DNA, 942 bp, Artificial Sequence
  Description of Artificial Sequence: Synthetic coding sequence
acagagcctggaacagaggcccctggccccccagaggagcccctgctgggggagctgactgtgacaggcagcagcccagacagcctgagcctgtcctggacagtgccccagggccgctttgacagcttcaccgtgcagtacaaggacagagatggccggccccaggccgtgcgggtgggcggccaggagagcaaggtgacagtgcggggcctggagcccggcaggaagtacaagatgcacctgtatggcctgcacgagggccggcggctgggccctgtgtctgctgtgggcgtgacagaagatgaagctgagaccacccaggccgtgcccaccatgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccatggaggccagagggtgggccccatcagcgtcatcggcgtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggccggcgggtgggccctgtgtccacagtgggcgtgacctag

SEQ ID NO: 172941 - DNA, 942 bp, Artificial Sequence
  Description of Artificial Sequence: Synthetic coding sequence
atgaccccagagccccccatcaagccccggctgggggagctgaccatgacagatgccaccccagacagcctgagcctgtcctggacagtgcctgagggccagtttgaccacttcctggtgcagtacagaaatggagatggccagcccaaggctgtgcgggtgcccggccatgaagatggagtgaccatcagcggcctggagccagaccacaagtacaagatgaacctgtatggcttccacggcggccagagggtgggccccatctctgtgactggagtgacagctgctgaggaggagacccccagccccacagagctgagcacagaggcccctgagcccccagaggagcccctgctgggggagctgactgtgacaggcagcagcccagacagcctgagcctgtcctggaccatcccccagggccactttgacagcttcaccgtgcagtacaaggacagagatggccggccccaggtgatgagggtgcggggggaggagagcgaggtgacagtgggcggcctggagcccggcaggaagtacaagatgcacctgtatggcctgcacgagggcagaagagtgggccctgtgtccacagtgggcgtgacagccccagaagatgaggaggaggagaccccagcccccacagagcccagcacagaggcccctgagcccccagaggagcccctgctgggggagctgactgtgacaggcagcagcccagacagcctgagcctgtcctggaccatcccccagggccgctttgacagcttcaccgtgcagtacaaggacagagatggccggccccaggtggtgcgggtgcggggggaggagagcgaggtgacagtgggcggcctggagcccggctgcaagtacaagatgcacctgtatggcctgcacgagggccagagggtgggccctgtgtctgctgtgggcgtgacctag

SEQ ID NO: 172942 - DNA, 1281 bp, Artificial Sequence
  Description of Artificial Sequence: Synthetic coding sequence
gctggggaggactgtggggaggaggtgcccaccatcgagggcatgaggatgcacctgctggaggagaccaccgtgaggacagagtggaccccagcccctggccctgtggatgcctatgagatccagttcatccccaccacagaaggagccagcccccccttcaccgcccgggtgcccagcagcgccagcgcctatgaccagaggggcctggcccctggccaggagtaccaggtgacagtgcgggccctgcggggcacctcctggggcctgcctgccagcaagaccatcaccaccatgattgatggcccccaggacctgcgggtggtggccgtgacccccaccaccctggagctgggctggctgcggccccaggccgaggtggacagatttgtggtgtcctatgtgtctgctggcaaccagagggtgcggctggaggtgcccccagaggctgatggcaccctgctgacagacctgatgcctggggtggagtatgtggtgacagtgacagctgagcggggccgggctgtgtcctacccagcctctgtgcgggccaacacaggcagcagccccctgggcctgctgggcaccacagatgagcccccaccttctggccccagcaccacccagggcgcccaggcccccctgctgcagcagaggccccaggagctgggggagctgcgggtgctgggcagagatgagaccggccgcctgcgggtggtgtggacagcccagcctgacacctttgcctacttccagctgaggatgagggtgcctgagggccctggggcccacgaggaggtgctgcctggagatgtgcggcaggccctggtgcccccacctcctcctggcaccccctatgagctgagcctgcatggagtgcccccaggcggcaagcccagcgaccccatcatctaccagggcatcatggacaaggatgaggagaagccaggcaagagcagcggccccccccggctgggggagctgactgtgacagacaggaccagtgacagcctgctgctgcgctggacagtgcctgagggggagtttgacagctttgtgatccagtacaaggacagagatggccagccccaggtggtgcctgtggagggcccccagaggtctgctgtgatcaccagcctggaccccggcaggaagtacaagtttgtgctgtatggctttgtgggcaagaagagacatggccccctggtggccgaggccaagatcctgccccagagcgaccccagccctggcaccccaccccacctgggcaacctgtggtag

SEQ ID NO: 172943 - DNA, 2598 bp, Artificial Sequence
  Description of Artificial Sequence: Synthetic coding sequence
ctctatggcctgcggggccggcagagggtgggccctgagagcgtggtggccaagacagccccccaggaggatgtggatgagacccccagccccacagagctgggcacagaggcccctgagagccctgaggagcccctgctgggggagctgactgtgacaggcagcagcccagacagcctgagcctcttctggacagtgccccagggcagctttgacagcttcaccgtgcagtacaaggacagagatggccggcccagggctgtgcgggtgggcggcaaggagagcgaggtgacagtgggcggcctggagcccggccacaagtacaagatgcacctgtatggcctgcacgagggccagagggtgggccctgtgtctgctgtgggcgtgacagccccccagcaggaggagaccccaccagccacagagagccccctggagccccggctgggggagctgactgtgacagatgtgacccccaacagcgtgggcctgtcctggacagtgcctgagggccagtttgacagcttcatcgtgcagtacaaggacaaggatggccagccccaggtggtgcctgtggccgctgaccagcgggaggtgacagtgtacaacctggagcctgagaggaagtacaagatgaacatgtatggcctgcatgatggccagaggatgggccccctgtctgtggtgattgtgacagcccccctgcccccagccccagccacagaggccagcaagccacccctggagccccggctgggggagctgactgtgacagacatcaccccagacagcgtgggcctgtcctggacagtgcctgagggggagtttgacagctttgtggtgcagtacaaggacagagatggccagccccaggtggtgcctgtggccgctgaccagcgggaggtgaccatcccagacctggagcccagcaggaagtacaagttcctgctgtttggcatccaggacggcaagagaagaagccctgtgtctgtggaggccaagacagtggcccggggagatgccagccctggggccccaccccggctgggggagctgtgggtgacagaccccaccccagacagcctgcggctgtcctggacagtgcctgagggccagtttgacagctttgtggtgcagttcaaggacaaggatggcccccaggtggtgcctgtggagggccacgagaggtctgtgacagtgacccccctggatgctggcaggaagtaccgcttcctgctgtatggcctgctgggcaagaagagacatggccccctgacagcagatggcaccacagaggcccggagcgccatggatgacaccggcaccaagaggcctcccaagccccggctgggggaggagctgcaggtgaccaccgtgacccagaacagcgtgggcctgtcctggacagtgcctgagggccagtttgacagctttgtggtgcagtacaaggacagagatggccagccccaggtggtgcctgtggagggcagcctgcgggaggtgtctgtgcccggcctggaccctgcccaccgctacaagctgctgctgtatggcctgcaccacggcaagagggtgggccccatctctgctgtggccatcacagctggccgggaggagacagaaacagagaccacagcccccaccccaccagcccctgagccccacctgggggagctgactgtggaggaggccaccagccacaccctgcacctgtcctggatggtgacagaaggagaatttgacagctttgagatccagtacacagacagagatggccagctgcagatggtgagaattggaggagacagaaatgacatcaccctgagcggcctggagagtgaccaccgctacctggtgaccctgtatggcttcagtgatggcaagcacgtgggccctgtgcacgtggaggccctgactgtgcctgaggaggagaagcccagcgagcccccaacagccaccccagagccccccatcaagccccggctgggggagctgactgtgacagatgccaccccagacagcctgagcctgtcctggacagtgcctgagggccagtttgaccacttcctggtgcagtacagaaatggagatggccagcccaaggctgtgcgggtgcccggccacgaggagggcgtgaccatcagcggcctggagccagaccacaagtacaagatgaacctgtatggcttccatggaggccagaggatgggccctgtgtctgtggtgggcgtgacagctgctgaggaggagacccccagccccacagagcccagcatggaggcccctgagcctgctgaggagcccctgctgggggagctgactgtgacaggcagcagcccagacagcctgagcctgtcctggacagtgccccagggccgctttgacagcttcaccgtgcagtacaaggacagagatggccggccccaggtggtgcgggtgggcggggaggagagcgaggtgacagtgggcggcctggagcccggcaggaagtacaagatgcacctgtatggcctgcacgagggccggcgggtgggccctgtgtctgctgtgggcgtgacagcccctgaggaggagagcccagatgcccccctggcctag

SEQ ID NO: 172944 - DNA, 5208 bp, Artificial Sequence
  Description of Artificial Sequence: Synthetic coding sequence
atgtctgtgtccaggaccatggaggacagctgtgagctggacctggtgtatgtgacagagcgcatcatcgctgtgtccttccccagcacagccaatgaggagaacttccgcagcaacctgcgggaggtggcccagatgctgaagagcaagcatggaggcaactacctgctcttcaacctgtctgaaagaagaccagacatcaccaagctgcacgccaaggtgctggagtttggctggccagacctgcacaccccagccctggagaagatctgcagcatctgcaaggccatggacacctggctgaatgctgacccccacaacgtggtggtgctgcacaacaagggcaacagaggccgcatcggcgtggtgattgctgcctacatgcactacagcaacatcagcgccagcgctgaccaggccctggacagatttgccatgaagcgcttctatgaggacaagatcgtgcccatcggccagcccagccagaggagatatgtgcactacttcagcggcctgctgagcggcagcatcaagatgaacaacaagcccctcttcctgcaccacgtgatcatgcacggcatccccaactttgagagcaagggcggctgccggcccttcctgcgcatctaccaggccatgcagcctgtgtacaccagcggcatctacaacatccctggggacagccagacctctgtgtgcatcaccatcgagcccggcctgctgctgaagggggacatcctgctgaagtgctaccacaagaagttccgcagccctgccagagatgtgatcttccgggtgcagttccacacctgtgccatccatgacctgggcgtggtgtttgggaaggaggacctggatgatgccttcaaggatgaccgcttcccagaatatggcaaggtggagtttgtgttctcctatggccctgagaagatccagggcatggagcacctggagaatggccccagcgtgtctgtggactacaacaccagtgaccccctcatccgctgggacagctatgacaacttcagcggccacagagatgatggcatggaggaggtggtgggccacacccagggccccctggatggcagcctgtatgccaaggtgaagaagaaggacagcctgcacggcagcactggagctgtgaatgccacccggcccaccctgagcgccacccccaaccacgtggagcacaccctgtctgtgtccagtgacagcggcaacagcacagccagcaccaagacagacaagacagatgagcctgtgcctggggccagcagcgccacagctgccctgagcccccaggagaagcgggagctggaccggctgctgagcggcttcggcctggagcgggagaagcagggcgccatgtaccacacccagcacctgcggagcaggcctgctgggggcagcgctgtgcccagcagcggcagacatgtggtgcctgcccaggtgcacgtgaatggaggagccctggccagcgagcgggagacagacatcctggatgatgagctgcccaaccaggacggccacagcgctggctccatgggcaccctgagcagcctggatggagtgaccaacaccagcgagggcggctacccagaggccctgagccccctgaccaacggcctggacaagagctaccccatggagcccatggtgaatggaggcggctacccctatgaaagtgccagcagagctggccctgcccacgccggccacacagcccccatgaggcccagctacagcgcccaggagggcctggccggctaccagcgggagggcccccacccagcctggccccagcctgtgaccaccagccactacgcccatgaccccagcggcatgttccgcagccagagcttcagcgaggccgagccccagctgcccccagcccctgtgcggggcggcagcagccgggaggccgtgcagaggggcctgaacagctggcagcagcagcagcagcagcagcagcagccccggcccccaccccggcagcaggagcgggcccacctggagagcctggtggccagccggcccagcccccagcccctggccgagacccccatccccagcctgcctgagttccccagggctgccagccagcaggagattgagcagagcattgagaccctgaacatgctgatgctggacctggagcccgccagcgctgctgcccccctgcacaagagccagagcgtgcctggggcctggccaggggccagccccctgagcagccagcccctgagcggcagcagccggcagagccaccccctgacccagagccgcagcggctacatccccagcggccacagcctgggcaccccagagcccgccccccgggccagcctggagagcgtgcccccaggccgcagctacagcccctatgactaccagccctgcctggccggccccaaccaggacttccacagcaagagccctgccagcagcagcctgcctgccttcctgcccaccacccacagccccccaggcccccagcagcccccagccagcctgcccggcctgacagcccagcccctgctgagccccaaggaggccaccagtgaccccagcaggaccccagaggaggagcccctgaacctggagggcctggtggcccaccgggtggccggcgtgcaggcccgggagaagcagcctgctgagcccccagcccccctgcggaggagagctgccagtgatggccagtatgagaaccagagccctgaggccaccagccccaggagccctggggtgcgcagccctgtgcagtgtgtgtccccagagctggccctgaccatcgccctgaaccctgggggccggcccaaggagccccacctgcacagctacaaggaggcctttgaggagatggagggcaccagccccagcagccccccaccttctggagtgcgcagccccccaggcctggccaagacccccctgagcgccctgggcctgaagccccacaacccagctgacatcctgctgcaccccaccggggtgacccggcggcgcatccagccagaagaagatgagggcaaggtggtggtgcggctgtctgaggagcccaggagctatgtggagagcgtggccaggacagctgtggccggcccccgggcccaggacagcgagcccaagagcttcagcgccccagccacccaggcctacggccacgagatccccctgagaaatggcaccctgggcggcagctttgtgagccccagccccctgagcaccagcagccccatcctgtctgctgacagcacctctgtgggcagcttccccagcggggagagcagtgaccagggccccaggacccccacccagcccctgctggagagcggcttccgcagcggcagcctgggccagcccagccccagcgcccagaggaactaccagagcagcagccccctgcccaccgtgggcagcagctacagcagcccagactacagcctgcagcacttcagcagcagccctgagagccaggcccgggcccagttctctgtggccggcgtgcacacagtgcccggcagcccccaggcccggcacaggacagtgggcaccaacaccccacccagccctggcttcggctggagggccatcaaccccagcatggccgcccccagcagccccagcctgagccaccaccagatgatgggccccccaggcaccggcttccacggcagcacagtgagcagcccccagagcagcgctgccaccaccccaggcagccccagcctgtgccgccaccctgctggggtgtaccaggtgtctggcctgcacaacaaggtggccaccaccccaggcagccccagcctgggccgccaccctggggcccaccagggcaacctggccagcggcctgcacagcaatgccatcgccagccctggcagccccagcctgggccgccacctgggcggcagcggctctgtggtgcccggcagcccctgcctggacagacatgtggcctatggaggctacagcaccccagaggaccggcggcccaccctgagccggcagagcagcgccagcggctaccaggcccccagcacccccagcttccctgtgtccccagcctactacccaggcctgagcagccctgccaccagccccagcccagacagcgctgccttccggcagggcagccccaccccagccctgcctgagaagaggaggatgtctgtgggggaccgggccggcagcctgcccaactatgccaccatcaacgggaaggtgagcagccctgtggccagcggcatgagcagccccagcggcggcagcacagtgtccttcagccacaccctgcctgacttcagcaagtacagcatgccagacaacagccctgagacccgggccaaggtgaagtttgtgcaggacaccagcaagtactggtacaagccagagatcagccgggagcaggccatcgccctgctgaaggaccaggagcccggggccttcatcatccgggacagccacagcttccggggggcctacggcctggccatgaaggtgagcagccccccacccaccatcatgcagcagaacaagaagggggacatgacccatgagctggtgcgccacttcctgattgaaacaggcccccggggcgtgaagctgaagggctgccccaatgagcccaactttggcagcctgagcgccctggtgtaccagcacagcatcatccccctggccctgccctgcaagctggtgatccccaacagagaccccacagatgagagcaaggacagcagcggccctgccaacagcacagctgacctgctgaagcagggcgccgcctgcaatgtgctgtttgtgaacagcgtggacatggagagcctgaccggcccccaggccatcagcaaggccaccagcgagaccctggccgctgaccccaccccagctgccaccatcgtgcacttcaaggtgtctgcccagggcatcaccctgacagacaaccagaggaagctgttcttccgccgccactaccccctgaacacagtgaccttctgtgacctggacccccaggagaggaagtggatgaagacagaaggaggagccccagccaagctgtttggatttgtggccaggaagcagggcagcaccacagacaatgcctgccacctgtttgctgagctggaccccaaccagcctgccagcgccatcgtgaactttgtgtccaaggtgatgctgaatgccggccagaagaggtag

SEQ ID NO: 172945 - DNA, 1251 bp, Artificial Sequence
  Description of Artificial Sequence: Synthetic coding sequence
atggtgcccttccagcagaggaaggactgtgtgctggagggcagcaccagggtgaccccatctgtgcagccccacctgcagcccatccggaacatgtctgtgtccaggaccatggaggacagctgtgagctggacctggtgtatgtgacagagcgcatcatcgctgtgtccttccccagcacagccaatgaggagaacttccgcagcaacctgcgggaggtggcccagatgctgaagagcaagcacggcggcaactacctgctcttcaacctgtctgagcggcggccagacatcaccaagctgcacgccaaggtgctggagtttggctggccagacctgcacaccccagccctggagaagatctgcagcatctgcaaggccatggacacctggctgaatgctgacccccacaacgtggtggtgctgcacaacaagggcaacagaggaagaattggagtggtgattgctgcctacatgcactacagcaacatcagcgccagcgctgaccaggccctggacagatttgccatgaagcgcttctatgaggacaagatcgtgcccatcggccagcccagccagaggcgctacgtgcactacttcagcggcctgctgagcggcagcatcaagatgaacaacaagcccctcttcctgcaccacgtgatcatgcacggcatccccaactttgagagcaaaggaggctgccggcccttcctgcgcatctaccaggccatgcagcctgtgtacaccagcggcatctacaacatccctggggacagccagacctctgtgtgcatcaccatcgagcccggcctgctgctgaagggggacatcctgctgaagtgctaccacaagaagttccgcagccctgccagagatgtgatcttccgggtgcagttccacacctgtgccatccatgacctgggcgtggtgtttgggaaggaggacctggatgatgccttcaaggatgaccgcttcccagaatatggcaaggtggagtttgtgttctcctatggccctgagaagatccagggcatggagcacctggagaatggccccagcgtgtctgtggactacaacaccagtgaccccctcatccgctgggacagctatgacaacttcagcggccacagagatgatggcatggaggatggcaacaagcagaacaccaacagccagagcatcggcagcatcagcggcggcctggaggaccagtacacctggccagacacccactggcccagccagagctag

SEQ ID NO: 172946 - DNA, 312 bp, Artificial Sequence
  Description of Artificial Sequence: Synthetic coding sequence
atgtctgtgtccaggaccatggaggacagctgtgagctggacctggtgtatgtgacagagcgcatcatcgctgtgtccttccccagcacagccaatgaggagaacttccgcagcaacctgcgggaggtggcccagatgctgaagagcaagcatggaggcaactacctgctcttcaacctgtctgaaagaagaccagacatcaccaagctgcacgccaaggtgctggagtttggctggccagacctgcacaccccagccctggagaagatctgcagcatctgcaaggccatggacacctggctgaatgcctag

SEQ ID NO: 172947 - DNA, 5145 bp, Artificial Sequence
  Description of Artificial Sequence: Synthetic coding sequence
atgtctgtgtccaggaccatggaggacagctgtgagctggacctggtgtatgtgacagagcgcatcatcgctgtgtccttccccagcacagccaatgaggagaacttccgcagcaacctgcgggaggtggcccagatgctgaagagcaagcatggaggcaactacctgctcttcaacctgtctgaaagaagaccagacatcaccaagctgcacgccaaggtgctggagtttggctggccagacctgcacaccccagccctggagaagatctgcagcatctgcaaggccatggacacctggctgaatgctgacccccacaacgtggtggtgctgcacaacaagggcaacagaggccgcatcggcgtggtgattgctgcctacatgcactacagcaacatcagcgccagcgctgaccaggccctggacagatttgccatgaagcgcttctatgaggacaagatcgtgcccatcggccagcccagccagaggagatatgtgcactacttcagcggcctgctgagcggcagcatcaagatgaacaacaagcccctcttcctgcaccacgtgatcatgcacggcatccccaactttgagagcaagggcggctgccggcccttcctgcgcatctaccaggccatgcagcctgtgtacaccagcggcatctacaacatccctggggacagccagacctctgtgtgcatcaccatcgagcccggcctgctgctgaagggggacatcctgctgaagtgctaccacaagaagttccgcagccctgccagagatgtgatcttccgggtgcagttccacacctgtgccatccatgacctgggcgtggtgtttgggaaggaggacctggatgatgccttcaaggatgaccgcttcccagaatatggcaaggtggagtttgtgttctcctatggccctgagaagatccagggcatggagcacctggagaatggccccagcgtgtctgtggactacaacaccagtgaccccctcatccgctgggacagctatgacaacttcagcggccacagagatgatggcatggaggaggtggtgggccacacccagggccccctggatggcagcctgtatgccaaggtgaagaagaaggacagcctgcacggcagcactggagctgtgaatgccacccggcccaccctgagcgccacccccaaccacgtggagcacaccctgtctgtgtccagtgacagcggcaacagcacagccagcaccaagacagacaagacagatgagcctgtgcctggggccagcagcgccacagctgccctgagcccccaggagaagcgggagctggaccggctgctgagcggcttcggcctggagcgggagaagcagggcgccatgtaccacacccagcacctgcggagcaggcctgctgggggcagcgctgtgcccagcagcggcagacatgtggtgcctgcccaggtgcacgtgaatggaggagccctggccagcgagcgggagacagacatcctggatgatgagctgcccaaccaggacggccacagcgctggctccatgggcaccctgagcagcctggatggagtgaccaacaccagcgagggcggctacccagaggccctgagccccctgaccaacggcctggacaagagctaccccatggagcccatggtgaatggaggcggctacccctatgaaagtgccagcagagctggccctgcccacgccggccacacagcccccatgaggcccagctacagcgcccaggagggcctggccggctaccagcgggagggcccccacccagcctggccccagcctgtgaccaccagccactacgcccatgaccccagcggcatgttccgcagccagagcttcagcgaggccgagccccagctgcccccagcccctgtgcggggcggcagcagccgggaggccgtgcagaggggcctgaacagctggcagcagcagcagcagcagcagcagcagccccggcccccaccccggcagcaggagcgggcccacctggagagcctggtggccagccggcccagcccccagcccctggccgagacccccatccccagcctgcctgagttccccagggctgccagccagcaggagattgagcagagcattgagaccctgaacatgctgatgctggacctggagcccgccagcgctgctgcccccctgcacaagagccagagcgtgcctggggcctggccaggggccagccccctgagcagccagcccctgagcggcagcagccggcagagccaccccctgacccagagccgcagcggctacatccccagcggccacagcctgggcaccccagagcccgccccccgggccagcctggagagcgtgcccccaggccgcagctacagcccctatgactaccagccctgcctggccggccccaaccaggacttccacagcaagagccctgccagcagcagcctgcctgccttcctgcccaccacccacagccccccaggcccccagcagcccccagccagcctgcccggcctgacagcccagcccctgctgagccccaaggaggccaccagtgaccccagcaggaccccagaggaggagcccctgaacctggagggcctggtggcccaccgggtggccggcgtgcaggcccgggagaagcagcctgctgagcccccagcccccctgcggaggagagctgccagtgatggccagtatgagaaccagagccctgaggccaccagccccaggagccctggggtgcgcagccctgtgcagtgtgtgtccccagagctggccctgaccatcgccctgaaccctgggggccggcccaaggagccccacctgcacagctacaaggaggcctttgaggagatggagggcaccagccccagcagccccccaccttctggagtgcgcagccccccaggcctggccaagacccccctgagcgccctgggcctgaagccccacaacccagctgacatcctgctgcaccccaccggggagcccaggagctatgtggagagcgtggccaggacagctgtggccggcccccgggcccaggacagcgagcccaagagcttcagcgccccagccacccaggcctacggccacgagatccccctgagaaatggcaccctgggcggcagctttgtgagccccagccccctgagcaccagcagccccatcctgtctgctgacagcacctctgtgggcagcttccccagcggggagagcagtgaccagggccccaggacccccacccagcccctgctggagagcggcttccgcagcggcagcctgggccagcccagccccagcgcccagaggaactaccagagcagcagccccctgcccaccgtgggcagcagctacagcagcccagactacagcctgcagcacttcagcagcagccctgagagccaggcccgggcccagttctctgtggccggcgtgcacacagtgcccggcagcccccaggcccggcacaggacagtgggcaccaacaccccacccagccctggcttcggctggagggccatcaaccccagcatggccgcccccagcagccccagcctgagccaccaccagatgatgggccccccaggcaccggcttccacggcagcacagtgagcagcccccagagcagcgctgccaccaccccaggcagccccagcctgtgccgccaccctgctggggtgtaccaggtgtctggcctgcacaacaaggtggccaccaccccaggcagccccagcctgggccgccaccctggggcccaccagggcaacctggccagcggcctgcacagcaatgccatcgccagccctggcagccccagcctgggccgccacctgggcggcagcggctctgtggtgcccggcagcccctgcctggacagacatgtggcctacggcggctacagcaccccagaagatagaagacccaccctgagccggcagagcagcgccagcggctaccaggcccccagcacccccagcttccctgtgtccccagcctactacccaggcctgagcagccctgccaccagccccagcccagattctgctgccttccggcagggcagccccaccccagccctgcctgagaagaggaggatgtctgtgggggacagagctggcagcctgcccaactatgccaccatcaatggcaaggtgagcagccctgtggccagcggcatgagcagccccagcggcggcagcacagtgtccttcagccacaccctgcctgacttcagcaagtacagcatgccagacaacagccctgagacccgggccaaggtgaagtttgtgcaggacaccagcaagtactggtacaagccagagatcagccgggagcaggccatcgccctgctgaaggaccaggagcccggggccttcatcatccgggacagccacagcttccggggggcctacggcctggccatgaaggtgagcagccccccacccaccatcatgcagcagaacaagaagggggacatgacccatgagctggtgcgccacttcctgattgagaccggcccccggggcgtgaagctgaagggctgccccaatgagcccaactttggcagcctgagcgccctggtgtaccagcacagcatcatccccctggccctgccctgcaagctggtgatccccaacagagaccccacagatgagagcaaggacagcagcggccctgccaacagcacagctgacctgctgaagcagggcgccgcctgcaatgtgctgtttgtgaacagcgtggacatggagagcctgaccggcccccaggccatcagcaaggccaccagcgagaccctggccgctgaccccaccccagctgccaccatcgtgcacttcaaggtgtctgcccagggcatcaccctgacagacaaccagaggaagctgttcttcagaagacactaccccctgaacacagtgaccttctgtgacctggacccccaggagaggaagtggatgaagacagagggcggggccccagccaagctgtttggatttgtggccaggaagcagggcagcaccacagacaatgcctgccacctgtttgctgagctggaccccaaccagcctgccagcgccatcgtgaactttgtgtccaaggtgatgctgaatgccggccagaagaggtag

SEQ ID NO: 172948 - DNA, 186 bp, Artificial Sequence
  Description of Artificial Sequence: Synthetic coding sequence
atgtctgtgtccaggaccatggaggacagctgtgagctggacctggtgtatgtgacagagcgcatcatcgctgtgtccttccccagcacagccaatgaggagaacttccgcagcaacctgcgggaggtggcccagatgctgaagagcaagcatggaggcaactacctgctcttcaacctgtcctag

SEQ ID NO: 172949 - DNA, 75 bp, Artificial Sequence
  Description of Artificial Sequence: Synthetic coding sequence
atgtctgtgtccaggaccatggaggacagctgtgagctggacctggtgtatgtgacagagcgcatcatcgcctag

SEQ ID NO: 172950 - DNA, 4338 bp, Artificial Sequence
  Description of Artificial Sequence: Synthetic coding sequence
atggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgccggggcggcaagggccgcatcggcgtggtgatcagcagctacatgcacttcaccaacgtgtctgccagcgctgaccaggccctggacagatttgccatgaagaagttctatgatgacaaggtgtctgccctgatgcagcccagccagaagagatatgtgcagttcctgagcggcctgctgagcggctctgtgaagatgaatgccagccccctcttcctgcacttcgtcatcctgcacggcacccccaactttgacacaggaggagtgtgccggcccttcctgaagctgtaccaggccatgcagcctgtgtacaccagcggcatctacaacgtgggccctgagaaccccagccgcatctgcatcgtcatcgagcccgcccagctgctgaagggagatgtgatggtgaagtgctaccacaagaagtacagaagtgccaccagagatgtgatcttccggctgcagttccacactggagctgtgcagggctacggcctggtgtttgggaaggaggacctggacaatgccagcaaggatgaccgcttcccagactatggcaaggtggagctggtgttttctgccaccccagagaagatccagggcagcgagcacctgtacaatgaccatggagtcatcgtggactacaacaccacagaccccctcatccgctgggacagctatgagaacctgtctgcagatggagaggtgctgcacacccagggccctgtggatggcagcctgtatgccaaggtgaggaagaagagcagcagtgaccccggcatccctgggggcccccaggccatcccagccaccaacagcccagaccacagcgaccacaccctgtctgtgtccagtgacagcggccacagcacagccagcgccaggacagacaagacagaggagcggctggcccctggcacccggcggggcctgagcgcccaggagaaggccgagctggaccagctgctgagcggcttcggcctggaggaccccggcagcagcctgaaggagatgacagatgcccggagcaagtacagcggcaccaggcatgtggtgcctgcccaggtgcacgtgaatggagatgctgccctgaaggaccgggagacagacatcctggatgatgagatgccccaccacgacctgcacagcgtggacagcctgggcaccctgagcagcagcgagggcccccagagcgcccacctgggccccttcacctgccacaagagcagccagaacagcctgctgagtgatggcttcggcagcaatgtgggggaggacccccagggcaccctggtgcctgacctgggcctgggcatggatggcccctatgagcgggagaggaccttcggcagccgggagcccaagcagccccagcccctgctgaggaagcccagcgtgtctgcccagatgcaggcctacggccagagcagctacagcacccagacctgggtgcggcagcagcagatggtggtggcccaccagtacagctttgccccagatggagaggcccggctggtgagccgctgcccagctgacaaccctggcctggtgcaggcccagccccgggtgcccctgacccccacccggggcaccagcagccgggtggccgtgcagaggggcgtgggcagcggcccccaccccccagacacccagcagcccagccccagcaaggccttcaagccccgcttccctggggaccaggtggtgaatggagctggccctgagctgagcacaggccccagccctggcagccccaccctggacatcgaccagagcattgagcagctgaacagactcatcctggagctggaccccacctttgagcccatccccacccacatgaatgccctgggcagccaggccaacggctctgtgtccccagattctgtgggcggcggcctgcgggccagcagccggctgcctgacacaggagagggccccagccgggccaccggccggcagggcagcagcgctgagcagcccctgggcggccgcctgaggaagctgagcctgggccagtatgacaatgatgctgggggccagctgcccttcagcaaatgtgcctggggcaaggccggcgtggactatgcccccaacctgccccccttccccagccctgcagatgtgaaggagaccatgaccccaggctacccccaggacctggacatcattgatggccgcatcctgagcagcaaggagagcatgtgcagcaccccagccttccctgtgtccccagagaccccctacgtgaagacagccctgcggcacccccccttcagccccccagagccccccctgagcagccctgccagccagcacaagggcggccgggagcccaggagctgcccagagaccctgacccatgctgtgggcatgtctgagagccccatcggccccaagagcaccatgctgcgggcagatgccagcagcacccccagcttccagcaggcctttgccagcagctgcaccatcagcagcaatggacctggccagaggcgggagagcagcagcagcgctgagcggcagtgggtggagagcagccccaagcccatggtgtccctgctgggcagcggccggcccaccggcagccccctgtctgctgagttcagcggcaccaggaaggacagccctgtgctgagctgcttccccccatctgagctgcaggcccccttccacagccatgagctgagcctggccgagcccccagacagcctggccccacccagcagccaggccttcctgggcttcggcacagcccctgtgggcagcggcctgcccccagaggaggacctgggcgccctgctggccaacagccatggagccagccccacccccagcatccccctgacagccaccggggctgctgacaatggcttcctgagccacaacttcctgactgtggcccctggccacagcagccaccacagccctggcctgcagggccagggcgtgaccctgcccggccagccccccctgcctgagaagaagagggccagcgagggggacaggagcctgggctctgtgagccccagcagcagcggcttcagcagcccccacagcggcagcaccatcagcatccccttccccaacgtgctgcctgacttcagcaaggccagcgaggccgccagccccctgcctgacagccctggggacaagctggtgattgtgaagtttgtgcaggacaccagcaagttctggtacaaggctgacatcagccgggagcaggccatcgccatgctgaaggacaaggagcccggcagcttcatcgtgcgggacagccacagcttccggggggcctacggcctggccatgaaggtggccaccccaccacccagcgtgctgcagctgaacaagaaggccggggacctggccaatgagctggtgcgccacttcctgattgagtgcacccccaagggcgtgcggctgaagggctgcagcaatgagccctacttcggcagcctgacagccctggtgtgccagcacagcatcacccccctggccctgccctgcaagctgctgatccctgagcgggaccccctggaggagattgctgagagcagcccccagacagctgccaacagcgctgctgagctgctgaagcagggcgccgcctgcaatgtgtggtacctgaacagcgtggagatggagagcctgaccggccaccaggccatccagaaggccctgagcatcaccctggtgcaggagcccccacctgtgtccacagtggtgcacttcaaggtgtctgcccagggcatcaccctgacagacaaccagaggaagctgttcttccgccgccactaccctgtgaacagcgtcatcttctgtgccctggacccccaggacaggaagtggatcaaggatggccccagcagcaaggtgtttggatttgtggccaggaagcagggcagcgccacagacaacgtgtgccacctgtttgctgagcatgaccctgagcagcctgccagcgccatcgtgaactttgtgtccaaggtgatgattggcagccccaagaaggtgtag

SEQ ID NO: 172951 - DNA, 3618 bp, Artificial Sequence
  Description of Artificial Sequence: Synthetic coding sequence
atggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgccggggcggcaagggccgcatcggcgtggtgatcagcagctacatgcacttcaccaacgtgtctgccagcgctgaccaggccctggacagatttgccatgaagaagttctatgatgacaaggtgtctgccctgatgcagcccagccagaagagatatgtgcagttcctgagcggcctgctgagcggctctgtgaagatgaatgccagccccctcttcctgcacttcgtcatcctgcacggcacccccaactttgacacaggaggagtgtgccggcccttcctgaagctgtaccaggccatgcagcctgtgtacaccagcggcatctacaacgtgggccctgagaaccccagccgcatctgcatcgtcatcgagcccgcccagctgctgaagggagatgtgatgatgccccaccacgacctgcacagcgtggacagcctgggcaccctgagcagcagcgagggcccccagagcgcccacctgggccccttcacctgccacaagagcagccagaacagcctgctgagtgatggcttcggcagcaatgtgggggaggacccccagggcaccctggtgcctgacctgggcctgggcatggatggcccctatgagcgggagaggaccttcggcagccgggagcccaagcagccccagcccctgctgaggaagcccagcgtgtctgcccagatgcaggcctacggccagagcagctacagcacccagacctgggtgcggcagcagcagatggtggtggcccaccagtacagctttgccccagatggagaggcccggctggtgagccgctgcccagctgacaaccctggcctggtgcaggcccagccccgggtgcccctgacccccacccggggcaccagcagccgggtggccgtgcagaggggcgtgggcagcggcccccaccccccagacacccagcagcccagccccagcaaggccttcaagccccgcttccctggggaccaggtggtgaatggagctggccctgagctgagcacaggccccagccctggcagccccaccctggacatcgaccagagcattgagcagctgaacagactcatcctggagctggaccccacctttgagcccatccccacccacatgaatgccctgggcagccaggccaacggctctgtgtccccagattctgtgggcggcggcctgcgggccagcagccggctgcctgacacaggagagggccccagccgggccaccggccggcagggcagcagcgctgagcagcccctgggcggccgcctgaggaagctgagcctgggccagtatgacaatgatgctgggggccagctgcccttcagcaaatgtgcctggggcaaggccggcgtggactatgcccccaacctgccccccttccccagccctgcagatgtgaaggagaccatgaccccaggctacccccaggacctggacatcattgatggccgcatcctgagcagcaaggagagcatgtgcagcaccccagccttccctgtgtccccagagaccccctacgtgaagacagccctgcggcacccccccttcagccccccagagccccccctgagcagccctgccagccagcacaagggcggccgggagcccaggagctgcccagagaccctgacccatgctgtgggcatgtctgagagccccatcggccccaagagcaccatgctgcgggcagatgccagcagcacccccagcttccagcaggcctttgccagcagctgcaccatcagcagcaatggacctggccagaggcgggagagcagcagcagcgctgagcggcagtgggtggagagcagccccaagcccatggtgtccctgctgggcagcggccggcccaccggcagccccctgtctgctgagttcagcggcaccaggaaggacagccctgtgctgagctgcttccccccatctgagctgcaggcccccttccacagccatgagctgagcctggccgagcccccagacagcctggccccacccagcagccaggccttcctgggcttcggcacagcccctgtgggcagcggcctgcccccagaggaggacctgggcgccctgctggccaacagccatggagccagccccacccccagcatccccctgacagccaccggggctgctgacaatggcttcctgagccacaacttcctgactgtggcccctggccacagcagccaccacagccctggcctgcagggccagggcgtgaccctgcccggccagccccccctgcctgagaagaagagggccagcgagggggacaggagcctgggctctgtgagccccagcagcagcggcttcagcagcccccacagcggcagcaccatcagcatccccttccccaacgtgctgcctgacttcagcaaggccagcgaggccgccagccccctgcctgacagccctggggacaagctggtgattgtgaagtttgtgcaggacaccagcaagttctggtacaaggctgacatcagccgggagcaggccatcgccatgctgaaggacaaggagcccggcagcttcatcgtgcgggacagccacagcttccggggggcctacggcctggccatgaaggtggccaccccaccacccagcgtgctgcagctgaacaagaaggccggggacctggccaatgagctggtgcgccacttcctgattgagtgcacccccaagggcgtgcggctgaagggctgcagcaatgagccctacttcggcagcctgacagccctggtgtgccagcacagcatcacccccctggccctgccctgcaagctgctgatccctgagcgggaccccctggaggagattgctgagagcagcccccagacagctgccaacagcgctgctgagctgctgaagcagggcgccgcctgcaatgtgtggtacctgaacagcgtggagatggagagcctgaccggccaccaggccatccagaaggccctgagcatcaccctggtgcaggagcccccacctgtgtccacagtggtgcacttcaaggtgtctgcccagggcatcaccctgacagacaaccagaggaagctgttcttccgccgccactaccctgtgaacagcgtcatcttctgtgccctggacccccaggacaggaagtggatcaaggatggccccagcagcaaggtgtttggatttgtggccaggaagcagggcagcgccacagacaacgtgtgccacctgtttgctgagcatgaccctgagcagcctgccagcgccatcgtgaactttgtgtccaaggtgatgattggcagccccaagaaggtgtag

SEQ ID NO: 172952 - DNA, 4338 bp, Artificial Sequence; identical to SEQ ID NO: 172950
  Description of Artificial Sequence: Synthetic coding sequence

SEQ ID NO: 172953 - DNA, 327 bp, Artificial Sequence
  Description of Artificial Sequence: Synthetic coding sequence
atggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgcaggtag

SEQ ID NO: 172954 - DNA, 417 bp, Artificial Sequence
  Description of Artificial Sequence: Synthetic coding sequence
atggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgccggggcggcaagggccgcatcggcgtggtgatcagcagctacatgcacttcaccaacgtgtctgccagcgctgaccaggccctggaccgcttctag

SEQ ID NO: 172955 - DNA, 753 bp, Artificial Sequence
  Description of Artificial Sequence: Synthetic coding sequence
atggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgccggggcggcaagggccgcatcggcgtggtgatcagcagctacatgcacttcaccaacgtgtctgccagcgctgaccaggccctggacagatttgccatgaagaagttctatgatgacaaggtgtctgccctgatgcagcccagccagaagagatatgtgcagttcctgagcggcctgctgagcggctctgtgaagatgaatgccagccccctcttcctgcacttcgtcatcctgcacggcacccccaactttgacacaggaggagtgtgccggcccttcctgaagctgtaccaggccatgcagcctgtgtacaccagcggcatctacaacgtgggccctgagaaccccagccgcatctgcatcgtcatcgagcccgcccagctgctgaagggagatgtgatggtgatgaactacaacatcgccaacatctag

SEQ ID NO: 172956 - DNA, 753 bp, Artificial Sequence; identical to SEQ ID NO: 172955
  Description of Artificial Sequence: Synthetic coding sequence

SEQ ID NO: 172957 - DNA, 3816 bp, Artificial Sequence
  Description of Artificial Sequence: Synthetic coding sequence
agccaggccctgaatgaaagaatgaactggctgtgcaggaaccaggaccccaaccccccaccccagcctgaggagctgaccagcagcctgcacgccttcaagaacaaggccttcaagaagagcaaggtgtgtggggtgtgcaagcagatcattgatggccagggcatcagctgccgggcctgcaagtacagctgccacaagaagtgtgaggccaaggtggtgatcccctgtggggtgcaggtgcggctggagcaggcccctggcagcagcaccctgagcagcagcctgtgccgggacaagcccctgcggcctgtgatcctgagccccaccatggaggagggccacggcctggacctgacctacatcacagagcgcatcatcgctgtgtccttccctgctggctgcagcgaggagagctacctgcacaacctgcaggaggtgaccaggatgctgaagagcaagcatggagacaactacctggtgctgaacctgtctgagaagagatatgacctgaccaagctgaaccccaagatcatggatgtgggctggccagagctgcacgccccacccctggacaagatgtgcaccatctgcaaggcccaggagagctggctgaacagcaacctgcagcacgtggtggtgatccactgccggggcggcaagggccgcatcggcgtggtgatcagcagctacatgcacttcaccaacgtgtctgccagcgctgaccaggccctggacagatttgccatgaagaagttctatgatgacaaggtgtctgccctgatgcagcccagccagaagagatatgtgcagttcctgagcggcctgctgagcggctctgtgaagatgaatgccagccccctcttcctgcacttcgtcatcctgcacggcacccccaactttgacacaggaggagtgtgccggcccttcctgaagctgtaccaggccatgcagcctgtgtacaccagcggcatctacaacgtgggccctgagaaccccagccgcatctgcatcgtcatcgagcccgcccagctgctgaagggagatgtgatggtgaagtgctaccacaagaagtacagaagtgccaccagagatgtgatcttccggctgcagttccacactggagctgtgcagggctacggcctggtgtttgggaaggaggacctggacaatgccagcaaggatgaccgcttcccagactatggcaaggtggagctggtgttttctgccaccccagagaagatccagggcagcgagcacctgtacaatgaccatggagtcatcgtggactacaacaccacagaccccctcatccgctgggacagctatgagaacctgtctgcagatggagaggtgctgcacacccagggccctgtggatggcagcctgtatgccaaggtgaggaagaagagcagcagtgaccccggcatccctgggggcccccaggccatcccagccaccaacagcccagaccacagcgaccacaccctgtctgtgtccagtgacagcggccacagcacagccagcgccaggacagacaagacagaggagcggctggcccctggcacccggcggggcctgagcgcccaggagaaggccgagctggaccagctgctgagcggcttcggcctggaggaccccggcagcagcctgaaggagatgacagatgcccggagcaagtacagcggcaccaggcatgtggtgcctgcccaggtgcacgtgaatggagatgctgccctgaaggaccgggagacagacatcctggatgatgagatgccccaccacgacctgcacagcgtggacagcctgggcaccctgagcagcagcgagggcccccagagcgcccacctgggccccttcacctgccacaagagcagccagaacagcctgctgagtgatggcttcggcagcaatgtgggggaggacccccagggcaccctggtgcctgacctgggcctgggcatggatggcccctatgagcgggagaggaccttcggcagccgggagcccaagcagccccagcccctgctgaggaagcccagcgtgtctgcccagatgcaggcctacggccagagcagctacagcacccagacctgggtgcggcagcagcagatggtggtggcccaccagtacagctttgccccagatggagaggcccggctggtgagccgctgcccagctgacaaccctggcctggtgcaggcccagccccgggtgcccctgacccccacccggggcaccagcagccgggtggccgtgcagaggggcgtgggcagcggcccccaccccccagacacccagcagcccagccccagcaaggccttcaagccccgcttccctggggaccaggtggtgaatggagctggccctgagctgagcacaggccccagccctggcagccccaccctggacatcgaccagagcattgagcagctgaacagactcatcctggagctggaccccacctttgagcccatccccacccacatgaatgccctgggcagccaggccaacggctctgtgtccccagattctgtgggcggcggcctgcgggccagcagccggctgcctgacacaggagagggccccagccgggccaccggccggcagggcagcagcgctgagcagcccctgggcggccgcctgaggaagctgagcctgggccagtatgacaatgatgctgggggccagctgcccttcagcaaatgtgcctggggcaaggccggcgtggactatgcccccaacctgccccccttccccagccctgcagatgtgaaggagaccatgaccccaggctacccccaggacctggacatcattgatggccgcatcctgagcagcaaggagagcatgtgcagcaccccagccttccctgtgtccccagagaccccctacgtgaagacagccctgcggcacccccccttcagccccccagagccccccctgagcagccctgccagccagcacaagggcggccgggagcccaggagctgcccagagaccctgacccatgctgtgggcatgtctgagagccccatcggccccaagagcaccatgctgcgggcagatgccagcagcacccccagcttccagcaggcctttgccagcagctgcaccatcagcagcaatggacctggccagaggcgggagagcagcagcagcgctgagcggcagtgggtggagagcagccccaagcccatggtgtccctgctgggcagcggccggcccaccggcagccccctgtctgctgagttcagcggcaccaggaaggacagccctgtgctgagctgcttccccccatctgagctgcaggcccccttccacagccatgagctgagcctggccgagcccccagacagcctggccccacccagcagccaggccttcctgggcttcggcacagcccctgtgggcagcggcctgcccccagaggaggacctgggcgccctgctggccaacagccatggagccagccccacccccagcatccccctgacagccaccggggctgctgacaatggcttcctgagccacaacttcctgactgtggcccctggccacagcagccaccacagccctggcctgcagggccagggcgtgaccctgcccggccagccccccctgcctgagaagaagagggccagcgagggggacaggagcctgggctctgtgagccccagcagcagcggcttcagcagcccccacagcggcagcaccatcagcatccccttccccaacgtgctgcctgacttcagcaaggccagcgaggcccccaccttctaccagaccagcaagccagacatccctggcccctag

SEQ ID NO: 172958 - DNA, 2760 bp, Artificial Sequence
  Description of Artificial Sequence: Synthetic coding sequence
atggatggcccctatgagcgggagaggaccttcggcagccgggagcccaagcagccccagcccctgctgaggaagcccagcgtgtctgcccagatgcaggcctacggccagagcagctacagcacccagacctgggtgcggcagcagcagatggtggtggcccaccagtacagctttgccccagatggagaggcccggctggtgagccgctgcccagctgacaaccctggcctggtgcaggcccagccccgggtgcccctgacccccacccggggcaccagcagccgggtggccgtgcagaggggcgtgggcagcggcccccaccccccagacacccagcagcccagccccagcaaggccttcaagccccgcttccctggggaccaggtggtgaatggagctggccctgagctgagcacaggccccagccctggcagccccaccctggacatcgaccagagcattgagcagctgaacagactcatcctggagctggaccccacctttgagcccatccccacccacatgaatgccctgggcagccaggccaacggctctgtgtccccagattctgtgggcggcggcctgcgggccagcagccggctgcctgacacaggagagggccccagccgggccaccggccggcagggcagcagcgctgagcagcccctgggcggccgcctgaggaagctgagcctgggccagtatgacaatgatgctgggggccagctgcccttcagcaaatgtgcctggggcaaggccggcgtggactatgcccccaacctgccccccttccccagccctgcagatgtgaaggagaccatgaccccaggctacccccaggacctggacatcattgatggccgcatcctgagcagcaaggagagcatgtgcagcaccccagccttccctgtgtccccagagaccccctacgtgaagacagccctgcggcacccccccttcagccccccagagccccccctgagcagccctgccagccagcacaagggcggccgggagcccaggagctgcccagagaccctgacccatgctgtgggcatgtctgagagccccatcggccccaagagcaccatgctgcgggcagatgccagcagcacccccagcttccagcaggcctttgccagcagctgcaccatcagcagcaatggacctggccagaggcgggagagcagcagcagcgctgagcggcagtgggtggagagcagccccaagcccatggtgtccctgctgggcagcggccggcccaccggcagccccctgtctgctgagttcagcggcaccaggaaggacagccctgtgctgagctgcttccccccatctgagctgcaggcccccttccacagccatgagctgagcctggccgagcccccagacagcctggccccacccagcagccaggccttcctgggcttcggcacagcccctgtgggcagcggcctgcccccagaggaggacctgggcgccctgctggccaacagccatggagccagccccacccccagcatccccctgacagccaccggggctgctgacaatggcttcctgagccacaacttcctgactgtggcccctggccacagcagccaccacagccctggcctgcagggccagggcgtgaccctgcccggccagccccccctgcctgagaagaagagggccagcgagggggacaggagcctgggctctgtgagccccagcagcagcggcttcagcagcccccacagcggcagcaccatcagcatccccttccccaacgtgctgcctgacttcagcaaggccagcgaggccgccagccccctgcctgacagccctggggacaagctggtgattgtgaagtttgtgcaggacaccagcaagttctggtacaaggctgacatcagccgggagcaggccatcgccatgctgaaggacaaggagcccggcagcttcatcgtgcgggacagccacagcttccggggggcctacggcctggccatgaaggtggccaccccaccacccagcgtgctgcagctgaacaagaaggccggggacctggccaatgagctggtgcgccacttcctgattgagtgcacccccaagggcgtgcggctgaagggctgcagcaatgagccctacttcggcagcctgacagccctggtgtgccagcacagcatcacccccctggccctgccctgcaagctgctgatccctgagcgggaccccctggaggagattgctgagagcagcccccagacagctgccaacagcgctgctgagctgctgaagcagggcgccgcctgcaatgtgtggtacctgaacagcgtggagatggagagcctgaccggccaccaggccatccagaaggccctgagcatcaccctggtgcaggagcccccacctgtgtccacagtggtgcacttcaaggtgtctgcccagggcatcaccctgacagacaaccagaggaagctgttcttccgccgccactaccctgtgaacagcgtcatcttctgtgccctggacccccaggacaggaagtggatcaaggatggccccagcagcaaggtgtttggatttgtggccaggaagcagggcagcgccacagacaacgtgtgccacctgtttgctgagcatgaccctgagcagcctgcccgggagagccagaggcacagaggagccagagatggcccccatgaggccatgccccggcggcacagcggcagccctgccaacgtgctgtttgagctgattggccaggtgtag

SEQ ID NO: 172959 - DNA, 2148 bp, Artificial Sequence
  Description of Artificial Sequence: Synthetic coding sequence
atgagccaggtgatgagcagccccctgctggccggcggccatgctgtgtccctggccccctgtgatgagcccaggaggaccctgcacccagcccccagccccagcctgcccccccagtgcagctactacaccacagagggctggggcgcccaggccctgatggcccctgtgccctgcatgggccccccaggccgcctgcagcaggccccccaggtggaggccaaggccacctgcttcctgcccagccctggagagaaggccctgggcaccccagaggacctggacagctacatcgacttcagcctggagagcctgaaccagatgatcctggagctggaccccaccttccagctgctgcccccaggcactggaggcagccaggccgagctggcccagagcaccatgtccatgaggaagaaggaggagagcgaggccctggacatcaagtacatcgaggtgaccagcgcccggagccgctgccatgatggcccccagcactgcagcagccccagcgtgaccccacccttcggcagcctgcggagcggcggcctgctgctgagcagagatgtgccccgggagaccaggagcagcagcgagagcctcatcttcagcggcaaccagggccggggccaccagaggcccctgccccccagcgagggcctgagccccaggcctcccaacagccccagcatcagcatcccctgcatgggcagcaaggccagcagcccccacggcctgggcagccccctggtggccagcccccggctggagaagaggctgggcggcctggccccccagaggggcagccgcatctctgtgctgagcgccagccctgtgtctgatgtgtcctacatgtttggcagcagccagagcctgctgcacagcagcaacagcagccaccagagcagcagccgcagcctggagagccctgccaacagcagcagcagcctgcacagcctgggctctgtgtccctgtgcacccggcccagcgacttccaggcccccaggaaccccaccctgaccatgggccagcccaggaccccccacagcccccccctggccaaggagcacgccagcagctgcccccccagcatcaccaacagcatggtggacatccccatcgtgctgatcaatggctgcccagagcccggcagcagccccccccagaggaccccaggccaccagaacagcgtgcagcccggggccgccagccccagcaacccctgcccagccaccaggagcaacagccagaccctgagtgatgcccccttcaccacctgcccagagggccctgcccgggacatgcagcccaccatgaagtttgtgatggacaccagcaagtactggttcaagcccaacatcacccgggagcaggccatcgagctgctgaggaaggaggagcccggggcctttgtgatccgggacagcagcagctaccggggcagctttggcctggccctgaaggtgcaggaggtgcctgccagcgcccagagcaggcctggagaggacagcaatgacctgatccgccacttcctgattgagagcagcgccaagggcgtgcacctgaagggagcagatgaggagccctacttcggcagcctgagcgcctttgtgtgccagcacagcatcatggccctggccctgccctgcaagctgaccatcccccagcgggagctgggcggcgcagatggagccagtgacagcacagacagccctgccagctgccagaagaagtctgctggctgccacaccctgtacctgagctctgtgtctgtggagaccctgaccggggccctggccgtgcagaaggccatcagcaccacctttgagcgggacatcctgcccacccccaccgtggtgcacttcaaggtgacagagcagggcatcaccctgacagatgtgcagaggaaggtgttcttcagaagacactaccccctgaccaccctgcgcttctgtggcatggaccctgagcagaggaagtggcagaagtactgcaagcccagctggatctttggatttgtggccaagagccagacagagccccaggagaatgtgtgccacctgtttgctgaatatgacatggtgcagcctgccagccaggtgattggcctggtgacagccctgctgcaggatgctgagaggatgtag

SEQ ID NO: 172960 - DNA, 2148 bp, Artificial Sequence; identical to SEQ ID NO: 172959
  Description of Artificial Sequence: Synthetic coding sequence

SEQ ID NO: 172961 - DNA, 387 bp, Artificial Sequence
  Description of Artificial Sequence: Synthetic coding sequence
atgaggcctgtgcctgtgcggggcgtgcacagcctgcacccccggccctttggaggccctgtgtccctgccctggctgaggacaggccgctgccgctggggcctgggcctgtaccggcagcccagcctgctgcctgaggagatctgtggggtcttcttccgccgccactaccccctgaccaccctgcgcttctgtggcatggaccctgagcagaggaagtggcagaagtactgcaagcccagctggatcttcggctttgtggccaagagccagacagagccccaggagaatgtgtgccacctgtttgctgaatatgacatggtgcagcctgccagccaggtgattggcctggtgacagccctgctgcaggatgctgagaggatgtag

SEQ ID NO: 172962 - DNA, 4230 bp, Artificial Sequence
  Description of Artificial Sequence: Synthetic coding sequence
atgaagagcagcggccctgtggagcggctgctgcgggccctgggccggcgggacagcagccgggccgccagccggcccaggaaggccgagccccacagcttccgggagaaggtgttcaggaagaagccccctgtgtgtgctgtgtgcaaggtgaccattgatggcaccggggtgtcctgccgggtgtgcaaggtggccacccacaggaaatgtgaggccaaggtgaccagcgcctgccaggccctgccccctgtggagctgcggaggaacacagcccctgtgagaagaattgagcacctgggcagcaccaagagcctgaaccacagcaagcagaggagcaccctgcccaggagcttcagcctggaccccctgatggagcggcgctgggacctggacctgacctacgtgacagagcgcatcctggccgccgccttccctgcccggccagatgagcagaggcaccggggccacctgcgggagctggcccacgtgctgcagagcaagcaccgggacaagtacctgctcttcaacctgtctgagaagagacatgacctgacccggctgaaccccaaggtgcaggactttggctggccagagctgcacgccccacccctggacaagctgtgcagcatctgcaaggccatggagacctggctgtctgctgacccccagcacgtggtggtgctgtactgcaagggcaacaagggcaagctgggcgtgattgtgtctgcctacatgcactacagcaagatctctgctggagctgaccaggccctggccaccctgaccatgaggaagttctgtgaggacaaggtggccacagagctgcagcccagccagaggcgctacatctcctacttcagcggcctgctgagcggcagcatccgcatgaacagcagccccctcttcctgcactacgtgctgatccccatgctgcctgcctttgagcccggcaccggcttccagcccttcctgaagatctaccagagcatgcagctggtgtacaccagcggcgtgtaccacatcgccggccctggcccccagcagctgtgcatcagcctggagcccgccctgctgctgaagggagatgtgatggtgacctgctaccacaagggcggccggggcacagacaggaccctggtgttccgggtgcagttccacacctgcaccatccacggcccccagctgaccttccccaaggaccagctggatgaggcctggacagatgagcgcttccccttccaggcctctgtggagtttgtgttcagcagcagccctgagaagatcaagggcagcaccccaagaaatgaccccagcgtgtctgtggactacaacaccacagagcctgctgtgcgctgggacagctatgagaacttcaaccagcaccacgaggacagcgtggatggcagcctgacccacacccggggccccctggatggcagcccctatgcccaggtgcagaggcctccccggcagaccccaccagcccccagccctgagcccccacctccacccatgctgtctgtgtccagtgacagcggccacagcagcaccctgaccacagagcctgctgctgagagccctggccggcccccacccacagctgctgagcggcaggagctggaccggctgctgggcggctgcggcgtggccagcggcggcagaggagctggccgggagacagccatcctggatgatgaggagcagcccaccgtgggcggcggcccccacctgggcgtgtacccaggccaccggcccggcctgagccgccactgcagctgccggcagggctaccgggagccctgtggggtgcccaacggcggctactacagacctgagggcaccctggagcggcggcggctggcctatggaggctatgagggcagcccccagggctacgccgaggcctccatggagaagaggcggctgtgccgcagcctgtctgagggcctgtacccctacccacctgagatgggcaagccagccactggagactttggctaccgggcccctggctaccgggaggtggtgatcctggaggaccccggcctgcctgccctgtacccctgcccagcctgtgaggagaagctggccctgcccacagctgccctgtatggcctgcggctggagcgggaggccggggagggctgggccagcgaggccggcaagcccctgctgcaccctgtgcggcccggccaccccctgcccctgctgctgcctgcctgtggccaccaccacgcccccatgccagactacagctgcctgaagccacccaaggccggggaggagggccacgagggctgcagctacaccatgtgcccagagggccgctatggccaccctggctacccagccctggtgacctacagctatggaggagctgtgcccagctactgcccagcctacggccgggtgccccacagctgtggcagccctggagagggccggggctaccccagccctggggcccacagcccccgggccggcagcatcagccctggcagccccccctacccccagagcaggaagctgtcctatgagatccccacagaggagggcggggaccgctaccccctgcccggccacctggccagcgctggccccctggccagcgctgagagcctggagcctgtgtcctggagggagggccccagcggccacagcaccctgcccaggagccccagagatgccccctgcagcgccagcagcgagctgagcggccccagcacccccctgcacaccagcagccctgtgcagggcaaggagagcacccggcggcaggacaccaggagccccaccagcgcccccacccagaggctgagccctggagaggccctgccccctgtgtcccaggccggcaccgggaaggcccctgagctgcccagcggcagcggccctgagcccctggcccccagccctgtgagccccaccttcccccccagcagccccagcgactggccccaggagaggagccctgggggccacagtgatggagccagccccaggagccctgtgcccaccaccctgcccggcctgcggcatgccccctggcagggcccccggggccccccagacagcccagatggcagccccctgacccctgtgcccagccagatgccctggctggtggccagccctgagcccccccagagcagccccaccccagccttccccctggccgccagctatgacaccaacggcctgagccagccccccctgcctgagaagaggcacctgcccggccctggccagcagcccggcccctggggccctgagcaggccagcagccctgcccggggcatcagccaccacgtgacctttgcccccctgctgagtgacaacgtgccccagaccccagagccccccacccaggagagccagagcaatgtgaagtttgtgcaggacaccagcaagttctggtacaagccccacctgagccgggaccaggccatcgccctgctgaaggacaaggaccccggggccttcctgatccgggacagccacagcttccagggcgcctacggcctggccctgaaggtggccaccccaccacccagcgcccagccctggaagggggaccctgtggagcagctggtgcgccacttcctgattgagaccggccccaagggcgtgaagatcaagggctgccccagcgagccctacttcggcagcctgagcgccctggtgtcccagcacagcatcagccccatcagcctgccctgctgcctgcgcatccccagcaaggaccccctggaggagaccccagaggcccctgtgcccaccaacatgagcacagctgctgacctgctgcggcagggcgccgcctgcagcgtgctgtacctgacctctgtggagacagagagcctgaccggcccccaggccgtggcccgggccagcagcgctgccctgagctgcagcccccggcccaccccagctgtggtgcacttcaaggtgtctgcccagggcatcaccctgacagacaaccagaggaagctgttcttcagaagacactaccctgtgaacagcatcaccttcagcagcacagacccccaggaccggcgctggaccaacccagatggcaccaccagcaagatcttcggctttgtggccaagaagccaggcagcccctgggagaatgtgtgccacctgtttgctgagctggaccctgaccagcctgctggggccatcgtgaccttcatcaccaaggtgctgctgggccagaggaagtag

SEQ ID NO: 172963 - DNA, 4260 bp, Artificial Sequence
  Description of Artificial Sequence: Synthetic coding sequence
atggatggcggcggcgtgtgtgtgggccgcggggacctgctgagcagcccccaggccctgggccagctgctgaggaaggagagccggccccggcgggccatgaagcccaggaaggccgagccccacagcttccgggagaaggtgttcaggaagaagccccctgtgtgtgctgtgtgcaaggtgaccattgatggcaccggggtgtcctgccgggtgtgcaaggtggccacccacaggaaatgtgaggccaaggtgaccagcgcctgccaggccctgccccctgtggagctgcggaggaacacagcccctgtgagaagaattgagcacctgggcagcaccaagagcctgaaccacagcaagcagaggagcaccctgcccaggagcttcagcctggaccccctgatggagcggcgctgggacctggacctgacctacgtgacagagcgcatcctggccgccgccttccctgcccggccagatgagcagaggcaccggggccacctgcgggagctggcccacgtgctgcagagcaagcaccgggacaagtacctgctcttcaacctgtctgagaagagacatgacctgacccggctgaaccccaaggtgcaggactttggctggccagagctgcacgccccacccctggacaagctgtgcagcatctgcaaggccatggagacctggctgtctgctgacccccagcacgtggtggtgctgtactgcaagggcaacaagggcaagctgggcgtgattgtgtctgcctacatgcactacagcaagatctctgctggagctgaccaggccctggccaccctgaccatgaggaagttctgtgaggacaaggtggccacagagctgcagcccagccagaggcgctacatctcctacttcagcggcctgctgagcggcagcatccgcatgaacagcagccccctcttcctgcactacgtgctgatccccatgctgcctgcctttgagcccggcaccggcttccagcccttcctgaagatctaccagagcatgcagctggtgtacaccagcggcgtgtaccacatcgccggccctggcccccagcagctgtgcatcagcctggagcccgccctgctgctgaagggagatgtgatggtgacctgctaccacaagggcggccggggcacagacaggaccctggtgttccgggtgcagttccacacctgcaccatccacggcccccagctgaccttccccaaggaccagctggatgaggcctggacagatgagcgcttccccttccaggcctctgtggagtttgtgttcagcagcagccctgagaagatcaagggcagcaccccaagaaatgaccccagcgtgtctgtggactacaacaccacagagcctgctgtgcgctgggacagctatgagaacttcaaccagcaccacgaggacagcgtggatggcagcctgacccacacccggggccccctggatggcagcccctatgcccaggtgcagaggcctccccggcagaccccaccagcccccagccctgagcccccacctccacccatgctgtctgtgtccagtgacagcggccacagcagcaccctgaccacagagcctgctgctgagagccctggccggcccccacccacagctgctgagcggcaggagctggaccggctgctgggcggctgcggcgtggccagcggcggcagaggagctggccgggagacagccatcctggatgatgaggagcagcccaccgtgggcggcggcccccacctgggcgtgtacccaggccaccggcccggcctgagccgccactgcagctgccggcagggctaccgggagccctgtggggtgcccaacggcggctactacagacctgagggcaccctggagcggcggcggctggcctatggaggctatgagggcagcccccagggctacgccgaggcctccatggagaagaggcggctgtgccgcagcctgtctgagggcctgtacccctacccacctgagatgggcaagccagccactggagactttggctaccgggcccctggctaccgggaggtggtgatcctggaggaccccggcctgcctgccctgtacccctgcccagcctgtgaggagaagctggccctgcccacagctgccctgtatggcctgcggctggagcgggaggccggggagggctgggccagcgaggccggcaagcccctgctgcaccctgtgcggcccggccaccccctgcccctgctgctgcctgcctgtggccaccaccacgcccccatgccagactacagctgcctgaagccacccaaggccggggaggagggccacgagggctgcagctacaccatgtgcccagagggccgctatggccaccctggctacccagccctggtgacctacagctatggaggagctgtgcccagctactgcccagcctacggccgggtgccccacagctgtggcagccctggagagggccggggctaccccagccctggggcccacagcccccgggccggcagcatcagccctggcagccccccctacccccagagcaggaagctgtcctatgagatccccacagaggagggcggggaccgctaccccctgcccggccacctggccagcgctggccccctggccagcgctgagagcctggagcctgtgtcctggagggagggccccagcggccacagcaccctgcccaggagccccagagatgccccctgcagcgccagcagcgagctgagcggccccagcacccccctgcacaccagcagccctgtgcagggcaaggagagcacccggcggcaggacaccaggagccccaccagcgcccccacccagaggctgagccctggagaggccctgccccctgtgtcccaggccggcaccgggaaggcccctgagctgcccagcggcagcggccctgagcccctggcccccagccctgtgagccccaccttcccccccagcagccccagcgactggccccaggagaggagccctgggggccacagtgatggagccagccccaggagccctgtgcccaccaccctgcccggcctgcggcatgccccctggcagggcccccggggccccccagacagcccagatggcagccccctgacccctgtgcccagccagatgccctggctggtggccagccctgagcccccccagagcagccccaccccagccttccccctggccgccagctatgacaccaacggcctgagccagccccccctgcctgagaagaggcacctgcccggccctggccagcagcccggcccctggggccctgagcaggccagcagccctgcccggggcatcagccaccacgtgacctttgcccccctgctgagtgacaacgtgccccagaccccagagccccccacccaggagagccagagcaatgtgaagtttgtgcaggacaccagcaagttctggtacaagccccacctgagccgggaccaggccatcgccctgctgaaggacaaggaccccggggccttcctgatccgggacagccacagcttccagggcgcctacggcctggccctgaaggtggccaccccaccacccagcgcccagccctggaagggggaccctgtggagcagctggtgcgccacttcctgattgagaccggccccaagggcgtgaagatcaagggctgccccagcgagccctacttcggcagcctgagcgccctggtgtcccagcacagcatcagccccatcagcctgccctgctgcctgcgcatccccagcaaggaccccctggaggagaccccagaggcccctgtgcccaccaacatgagcacagctgctgacctgctgcggcagggcgccgcctgcagcgtgctgtacctgacctctgtggagacagagagcctgaccggcccccaggccgtggcccgggccagcagcgctgccctgagctgcagcccccggcccaccccagctgtggtgcacttcaaggtgtctgcccagggcatcaccctgacagacaaccagaggaagctgttcttcagaagacactaccctgtgaacagcatcaccttcagcagcacagacccccaggaccggcgctggaccaacccagatggcaccaccagcaagatcttcggctttgtggccaagaagccaggcagcccctgggagaatgtgtgccacctgtttgctgagctggaccctgaccagcctgctggggccatcgtgaccttcatcaccaaggtgctgctgggccagaggaagtag

SEQ ID NO: 172964 - DNA, 3858 bp, Artificial Sequence
  Description of Artificial Sequence: Synthetic coding sequence
atggagcggcgctgggacctggacctgacctacgtgacagagcgcatcctggccgccgccttccctgcccggccagatgagcagaggcaccggggccacctgcgggagctggcccacgtgctgcagagcaagcaccgggacaagtacctgctcttcaacctgtctgagaagagacatgacctgacccggctgaaccccaaggtgcaggactttggctggccagagctgcacgccccacccctggacaagctgtgcagcatctgcaaggccatggagacctggctgtctgctgacccccagcacgtggtggtgctgtactgcaagggcaacaagggcaagctgggcgtgattgtgtctgcctacatgcactacagcaagatctctgctggagctgaccaggccctggccaccctgaccatgaggaagttctgtgaggacaaggtggccacagagctgcagcccagccagaggcgctacatctcctacttcagcggcctgctgagcggcagcatccgcatgaacagcagccccctcttcctgcactacgtgctgatccccatgctgcctgcctttgagcccggcaccggcttccagcccttcctgaagatctaccagagcatgcagctggtgtacaccagcggcgtgtaccacatcgccggccctggcccccagcagctgtgcatcagcctggagcccgccctgctgctgaagggagatgtgatggtgacctgctaccacaagggcggccggggcacagacaggaccctggtgttccgggtgcagttccacacctgcaccatccacggcccccagctgaccttccccaaggaccagctggatgaggcctggacagatgagcgcttccccttccaggcctctgtggagtttgtgttcagcagcagccctgagaagatcaagggcagcaccccaagaaatgaccccagcgtgtctgtggactacaacaccacagagcctgctgtgcgctgggacagctatgagaacttcaaccagcaccacgaggacagcgtggatggcagcctgacccacacccggggccccctggatggcagcccctatgcccaggtgcagaggcctccccggcagaccccaccagcccccagccctgagcccccacctccacccatgctgtctgtgtccagtgacagcggccacagcagcaccctgaccacagagcctgctgctgagagccctggccggcccccacccacagctgctgagcggcaggagctggaccggctgctgggcggctgcggcgtggccagcggcggcagaggagctggccgggagacagccatcctggatgatgaggagcagcccaccgtgggcggcggcccccacctgggcgtgtacccaggccaccggcccggcctgagccgccactgcagctgccggcagggctaccgggagccctgtggggtgcccaacggcggctactacagacctgagggcaccctggagcggcggcggctggcctatggaggctatgagggcagcccccagggctacgccgaggcctccatggagaagaggcggctgtgccgcagcctgtctgagggcctgtacccctacccacctgagatgggcaagccagccactggagactttggctaccgggcccctggctaccgggaggtggtgatcctggaggaccccggcctgcctgccctgtacccctgcccagcctgtgaggagaagctggccctgcccacagctgccctgtatggcctgcggctggagcgggaggccggggagggctgggccagcgaggccggcaagcccctgctgcaccctgtgcggcccggccaccccctgcccctgctgctgcctgcctgtggccaccaccacgcccccatgccagactacagctgcctgaagccacccaaggccggggaggagggccacgagggctgcagctacaccatgtgcccagagggccgctatggccaccctggctacccagccctggtgacctacagctatggaggagctgtgcccagctactgcccagcctacggccgggtgccccacagctgtggcagccctggagagggccggggctaccccagccctggggcccacagcccccgggccggcagcatcagccctggcagccccccctacccccagagcaggaagctgtcctatgagatccccacagaggagggcggggaccgctaccccctgcccggccacctggccagcgctggccccctggccagcgctgagagcctggagcctgtgtcctggagggagggccccagcggccacagcaccctgcccaggagccccagagatgccccctgcagcgccagcagcgagctgagcggccccagcacccccctgcacaccagcagccctgtgcagggcaaggagagcacccggcggcaggacaccaggagccccaccagcgcccccacccagaggctgagccctggagaggccctgccccctgtgtcccaggccggcaccgggaaggcccctgagctgcccagcggcagcggccctgagcccctggcccccagccctgtgagccccaccttcccccccagcagccccagcgactggccccaggagaggagccctgggggccacagtgatggagccagccccaggagccctgtgcccaccaccctgcccggcctgcggcatgccccctggcagggcccccggggccccccagacagcccagatggcagccccctgacccctgtgcccagccagatgccctggctggtggccagccctgagcccccccagagcagccccaccccagccttccccctggccgccagctatgacaccaacggcctgagccagccccccctgcctgagaagaggcacctgcccggccctggccagcagcccggcccctggggccctgagcaggccagcagccctgcccggggcatcagccaccacgtgacctttgcccccctgctgagtgacaacgtgccccagaccccagagccccccacccaggagagccagagcaatgtgaagtttgtgcaggacaccagcaagttctggtacaagccccacctgagccgggaccaggccatcgccctgctgaaggacaaggaccccggggccttcctgatccgggacagccacagcttccagggcgcctacggcctggccctgaaggtggccaccccaccacccagcgcccagccctggaagggggaccctgtggagcagctggtgcgccacttcctgattgagaccggccccaagggcgtgaagatcaagggctgccccagcgagccctacttcggcagcctgagcgccctggtgtcccagcacagcatcagccccatcagcctgccctgctgcctgcgcatccccagcaaggaccccctggaggagaccccagaggcccctgtgcccaccaacatgagcacagctgctgacctgctgcggcagggcgccgcctgcagcgtgctgtacctgacctctgtggagacagagagcctgaccggcccccaggccgtggcccgggccagcagcgctgccctgagctgcagcccccggcccaccccagctgtggtgcacttcaaggtgtctgcccagggcatcaccctgacagacaaccagaggaagctgttcttcagaagacactaccctgtgaacagcatcaccttcagcagcacagacccccaggaccggcgctggaccaacccagatggcaccaccagcaagatcttcggctttgtggccaagaagccaggcagcccctgggagaatgtgtgccacctgtttgctgagctggaccctgaccagcctgctggggccatcgtgaccttcatcaccaaggtgctgctgggccagaggaagtag

SEQ ID NO: 172965 - DNA, 2346 bp, Artificial Sequence
  Description of Artificial Sequence: Synthetic coding sequence
atgaagagcagcggccctgtggagcggctgctgcgggccctgggccggcgggacagcagccgggccgccagccggcccaggaaggccgagccccacagcttccgggagaaggtgttcaggaagaagccccctgtgtgtgctgtgtgcaaggtgaccattgatggcaccggggtgtcctgccgggtgtgcaaggtggccacccacaggaaatgtgaggccaaggtgaccagcgcctgccaggccctgccccctgtggagctgcggaggaacacagcccctgtgagaagaattgagcacctgggcagcaccaagagcctgaaccacagcaagcagaggagcaccctgcccaggagcttcagcctggaccccctgatggagcggcgctgggacctggacctgacctacgtgacagagcgcatcctggccgccgccttccctgcccggccagatgagcagaggcaccggggccacctgcgggagctggcccacgtgctgcagagcaagcaccgggacaagtacctgctcttcaacctgtctgagaagagacatgacctgacccggctgaaccccaaggtgcaggactttggctggccagagctgcacgccccacccctggacaagctgtgcagcatctgcaaggccatggagacctggctgtctgctgacccccagcacgtggtggtgctgtactgcaagggcaacaagggcaagctgggcgtgattgtgtctgcctacatgcactacagcaagatctctgctggagctgaccaggccctggccaccctgaccatgaggaagttctgtgaggacaaggtggccacagagctgcagcccagccagaggcgctacatctcctacttcagcggcctgctgagcggcagcatccgcatgaacagcagccccctcttcctgcactacgtgctgatccccatgctgcctgcctttgagcccggcaccggcttccagcccttcctgaagatctaccagagcatgcagctggtgtacaccagcggcgtgtaccacatcgccggccctggcccccagcagctgtgcatcagcctggagcccgccctgctgctgaagggagatgtgatggtgacctgctaccacaagggcggccggggcacagacaggaccctggtgttccgggtgcagttccacacctgcaccatccacggcccccagctgaccttccccaaggaccagctggatgaggcctggacagatgagcgcttccccttccaggcctctgtggagtttgtgttcagcagcagccctgagaagatcaagggcagcaccccaagaaatgaccccagcgtgtctgtggactacaacaccacagagcctgctgtgcgctgggacagctatgagaacttcaaccagcaccacgaggacagcgtggatggcagcctgacccacacccggggccccctggatggcagcccctatgcccaggtgcagaggcctccccggcagaccccaccagcccccagccctgagcccccacctccacccatgctgtctgtgtccagtgacagcggccacagcagcaccctgaccacagagcctgctgctgagagccctggccggcccccacccacagctgctgagcggcaggagctggaccggctgctgggcggctgcggcgtggccagcggcggcagaggagctggccgggagacagccatcctggatgatgaggagcagcccaccgtgggcggcggcccccacctgggcgtgtacccaggccaccggcccggcctgagccgccactgcagctgccggcagggctaccgggagccctgtggggtgcccaacggcggctactacagacctgagggcaccctggagcggcggcggctggcctatggaggctatgagggcagcccccagggctacgccgaggcctccatggagaagaggcggctgtgccgcagcctgtctgagggcctgtacccctacccacctgagatgggcaagccagccactggagactttggctaccgggccagcagcgctgccctgagctgcagcccccggcccaccccagctgtggtgcacttcaaggtgtctgcccagggcatcaccctgacagacaaccagaggaagctgttcttcagaagacactaccctgtgaacagcatcaccttcagcagcacagacccccaggaccggcgctggaccaacccagatggcaccaccagcaagatcttcggctttgtggccaagaagccaggcagcccctgggagaatgtgtgccacctgtttgctgagctggaccctgaccagcctgctggggccatcgtgaccttcatcaccaaggtgctgctgggccagaggaagtag

SEQ ID NO: 172966 - DNA, 4200 bp, Artificial Sequence
  Description of Artificial Sequence: Synthetic coding sequence
atgaagagcagcggccctgtggagcggctgctgcgggccctgggccggcgggacagcagccgggccgccagccggcccaggaaggccgagccccacagcttccgggagaaggtgttcaggaagaagccccctgtgtgtgctgtgtgcaaggtgaccattgatggcaccggggtgtcctgccgggtgtgcaaggtggccacccacaggaaatgtgaggccaaggtgaccagcgcctgccaggccctgccccctgtggagctgcggaggaacacagcccctgtgagaagaattgagcacctgggcagcaccaagagcctgaaccacagcaagcagaggagcaccctgcccaggagcttcagcctggaccccctgatggagcggcgctgggacctggacctgacctacgtgacagagcgcatcctggccgccgccttccctgcccggccagatgagcagaggcaccggggccacctgcgggagctggcccacgtgctgcagagcaagcaccgggacaagtacctgctcttcaacctgtctgagaagagacatgacctgacccggctgaaccccaaggtgcaggactttggctggccagagctgcacgccccacccctggacaagctgtgcagcatctgcaaggccatggagacctggctgtctgctgacccccagcacgtggtggtgctgtactgcaagggcaacaagggcaagctgggcgtgattgtgtctgcctacatgcactacagcaagatctctgctggagctgaccaggccctggccaccctgaccatgaggaagttctgtgaggacaaggtggccacagagctgcagcccagccagaggcgctacatctcctacttcagcggcctgctgagcggcagcatccgcatgaacagcagccccctcttcctgcactacgtgctgatccccatgctgcctgcctttgagcccggcaccggcttccagcccttcctgaagatctaccagagcatgcagctggtgtacaccagcggcgtgtaccacatcgccggccctggcccccagcagctgtgcatcagcctggagcccgccctgctgctgaagggagatgtgatggtgacctgctaccacaagggcggccggggcacagacaggaccctggtgttccgggtgcagttccacacctgcaccatccacggcccccagctgaccttccccaaggaccagctggatgaggcctggacagatgagcgcttccccttccaggcctctgtggagtttgtgttcagcagcagccctgagaagatcaagggcagcaccccaagaaatgaccccagcgtgtctgtggactacaacaccacagagcctgctgtgcgctgggacagctatgagaacttcaaccagcaccacgaggacagcgtggatggcagcctgacccacacccggggccccctggatggcagcccctatgcccaggtgcagaggcctccccggcagaccccaccagcccccagccctgagcccccacctccacccatgctgtctgtgtccagtgacagcggccacagcagcaccctgaccacagagcctgctgctgagagccctggccggcccccacccacagctgctgagcggcaggagctggaccggctgctgggcggctgcggcgtggccagcggcggcagaggagctggccgggagacagccatcctggatgatgaggagcagcccaccgtgggcggcggcccccacctgggcgtgtacccaggccaccggcccggcctgagccgccactgcagctgccggcagggctaccgggagccctgtggggtgcccaacggcggctactacagacctgagggcaccctggagcggcggcggctggcctatggaggctatgagggcagcccccagggctacgccgaggcctccatggagaagaggcggctgtgccgcagcctgtctgagggcctgtacccctacccacctgagatgggcaagccagccactggagactttggctaccgggcccctggctaccgggaggtggtgatcctggaggaccccggcctgcctgccctgtacccctgcccagccagcctgtatggcctgcggctggagcgggaggccggggagggctgggccagcgaggccggcaagcccctgctgcaccctgtgcggcccggccaccccctgcccctgctgctgcctgcctgtggccaccaccacgcccccatgccagactacagctgcctgaagccacccaaggccggggaggagggccacgagggctgcagctacaccatgtgcccagagggccgctatggccaccctggctacccagccctggtgacctacagctatggaggagctgtgcccagctactgcccagcctacggccgggtgccccacagctgtggcagccctggagagggccggggctaccccagccctggggcccacagcccccgggccggcagcatcagccctggcagccccccctacccccagagcaggaagctgtcctatgagatccccacagaggagggcggggaccgctaccccctgcccggccacctggccagcgctggccccctggccagcgctgagagcctggagcctgtgtcctggagggagggccccagcggccacagcaccctgcccaggagccccagagatgccccctgcagcgccagcagcgagctgagcggccccagcacccccctgcacaccagcagccctgtgcagggcaaggagagcacccggcggcaggacaccaggagccccaccagcgcccccacccagaggctgagccctggagaggccctgccccctgtgtcccaggccggcaccgggaaggcccctgagctgcccagcggcagcggccctgagcccctggcccccagccctgtgagccccaccttcccccccagcagccccagcgactggccccaggagaggagccctgggggccacagtgatggagccagccccaggagccctgtgcccaccaccctgcccggcctgcggcatgccccctggcagggcccccggggccccccagacagcccagatggcagccccctgacccctgtgcccagccagatgccctggctggtggccagccctgagcccccccagagcagccccaccccagccttccccctggccgccagctatgacaccaacggcctgagccagccccccctgcctgagaagaggcacctgcccggccctggccagcagcccggcccctggggccctgagcaggccagcagccctgcccggggcatcagccaccacgtgacctttgcccccctgctgagtgacaacgtgccccagaccccagagccccccacccaggagagccagagcaatgtgaagtttgtgcaggacaccagcaagttctggtacaagccccacctgagccgggaccaggccatcgccctgctgaaggacaaggaccccggggccttcctgatccgggacagccacagcttccagggcgcctacggcctggccctgaaggtggccaccccaccacccagcgcccagccctggaagggggaccctgtggagcagctggtgcgccacttcctgattgagaccggccccaagggcgtgaagatcaagggctgccccagcgagccctacttcggcagcctgagcgccctggtgtcccagcacagcatcagccccatcagcctgccctgctgcctgcgcatccccagcaaggaccccctggaggagaccccagaggcccctgtgcccaccaacatgagcacagctgctgacctgctgcggcagggcgccgcctgcagcgtgctgtacctgacctctgtggagacagagagcctgaccggcccccaggccgtggcccgggccagcagcgctgccctgagctgcagcccccggcccaccccagctgtggtgcacttcaaggtgtctgcccagggcatcaccctgacagacaaccagaggaagctgttcttcagaagacactaccctgtgaacagcatcaccttcagcagcacagacccccaggaccggcgctggaccaacccagatggcaccaccagcaagatcttcggctttgtggccaagaagccaggcagcccctgggagaatgtgtgccacctgtttgctgagctggaccctgaccagcctgctggggccatcgtgaccttcatcaccaaggtgctgctgggccagaggaagtag

SEQ ID NO: 172967 - DNA, 567 bp, Artificial Sequence
  Description of Artificial Sequence: Synthetic coding sequence
atggactgcaggaagatggcccgcttctcctacagcgtcatctggatcatggccatcagcaaggtgtttgagctgggcctggtggccggcctgggccaccaggagtttgcccggcccagccggggctacctggccttcagagatgacagcatctggccccaggaggagcccgccatccggcccaggagcagccagagggtgccccccatgggcatccagcacagcaaggagctgaacagaacctgctgcctgaatggaggcacctgcatgctgggcagcttctgtgcctgcccccccagcttctacggcaggaactgtgaacatgatgtgaggaaagaaaactgtggctctgtgccccatgacacctggctgcccaagaagtgcagcctgtgcaagtgctggcacggccagctgcgctgcttcccccaggccttcctgcccggctgtgatggcctggtgatggatgagcacctggtggccagcaggaccccagagctgcccccatctgcccggaccaccaccttcatgctggtgggcatctgcctgagcatccagagctactactag

SEQ ID NO: 172968 - DNA, 519 bp, Artificial Sequence
  Description of Artificial Sequence: Synthetic coding sequence
atggccatcagcaaggtgtttgagctgggcctggtggccggcctgggccaccaggagtttgcccggcccagccggggctacctggccttcagagatgacagcatctggccccaggaggagcccgccatccggcccaggagcagccagagggtgccccccatgggcatccagcacagcaaggagctgaacagaacctgctgcctgaatggaggcacctgcatgctgggcagcttctgtgcctgcccccccagcttctacggcaggaactgtgaacatgatgtgaggaaagaaaactgtggctctgtgccccatgacacctggctgcccaagaagtgcagcctgtgcaagtgctggcacggccagctgcgctgcttcccccaggccttcctgcccggctgtgatggcctggtgatggatgagcacctggtggccagcaggaccccagagctgcccccatctgcccggaccaccaccttcatgctggtgggcatctgcctgagcatccagagctactactag

SEQ ID NO: 172969 - DNA, 645 bp, Artificial Sequence
  Description of Artificial Sequence: Synthetic coding sequence
atgggcgccgcccacagcgccagcgaggaggtgcgggagctggagggcaagacaggcttcagcagtgaccagatcgagcagctgcaccggcgcttcaagcagctgagcggggaccagcccaccatcagaaaagaaaacttcaacaacgtgcctgacctggagctgaaccccatccgcagcaagatcgtgcgggccttctttgacaacagaaacctgaggaagggccccagcggcctggctgatgagatcaactttgaggacttcctgaccatcatgagctacttccggcccatcgacaccaccatggatgaggagcaggtggagctgagcaggaaggagaagctgcgcttcctgttccacatgtatgacagcgacagtgatggccgcatcaccctggaggagtacagaaatgtggtggaggagctgctgagcggcaacccccacatcgagaaggagagcgcccggagcattgctgatggagccatgatggaggccgcctctgtgtgcatgggccagatggagccagaccaggtgtatgagggcatcacctttgaggacttcctgaagatctggcagggcatcgacatcgagaccaagatgcacgtgcgcttcctgaacatggagaccatggccctgtgccactag

SEQ ID NO: 172970 - DNA, 804 bp, Artificial Sequence
  Description of Artificial Sequence: Synthetic coding sequence
atgaggcccaggagcggccccaccaggaacccccggctgcgggcctttgctggggtgcccacccggggccgcacccggggccagagccgccgctgtgccgctgaggccagcgctggccctgagagagatgcccggcctggggccccagctgctggcaccatgggcgccgcccacagcgccagcgaggaggtgcgggagctggagggcaagacaggcttcagcagtgaccagatcgagcagctgcaccggcgcttcaagcagctgagcggggaccagcccaccatcaggaaggagaacttcaacaacgtgcctgacctggagctgaaccccatccgcagcaagatcgtgcgggccttctttgacaacagaaacctgaggaagggccccagcggcctggctgatgagatcaactttgaggacttcctgaccatcatgagctacttccggcccatcgacaccaccatggatgaggagcaggtggagctgagcaggaaggagaagctgcgcttcctgttccacatgtatgacagcgacagtgatggccgcatcaccctggaggagtacagaaatgtggtggaggagctgctgagcggcaacccccacatcgagaaggagagcgcccggagcattgctgatggagccatgatggaggccgcctctgtgtgcatgggccagatggagccagaccaggtgtatgagggcatcacctttgaggacttcctgaagatctggcagggcattgatattgagaccaagatgcacgtgcgcttcctgaacatggagaccatggccctgtgccactag

SEQ ID NO: 172971 - DNA, 564 bp, Artificial Sequence
  Description of Artificial Sequence: Synthetic coding sequence
atgggcgccgcccacagcgccagcgaggaggtgcgggagctggagggcaagacaggcttcagcagtgaccagatcgagcagctgcaccggcgcttcaagcagctgagcggggaccagcccaccatccggaacctgaggaagggccccagcggcctggctgatgagatcaactttgaggacttcctgaccatcatgagctacttccggcccatcgacaccaccatggatgaggagcaggtggagctgagcaggaaggagaagctgcgcttcctgttccacatgtatgacagcgacagtgatggccgcatcaccctggaggagtacagaaatgtggtggaggagctgctgagcggcaacccccacatcgagaaggagagcgcccggagcattgctgatggagccatgatggaggccgcctctgtgtgcatgggccagatggagccagaccaggtgtatgagggcatcacctttgaggacttcctgaagatctggcagggcattgatattgagaccaagatgcacgtgcgcttcctgaacatggagaccatggccctgtgccactag

SEQ ID NO: 172972 - DNA, 1266 bp, Artificial Sequence
  Description of Artificial Sequence: Synthetic coding sequence
ctcaacctggaggtgaagttcaagaagatgggcctgggccacgagcagggctttggagccccctgcctgaagtgcaaggagaagtgtgagggctttgagctgcacttctggaggaagatctgcaggaactgcaagtgtggccaggaggagcatgatgtgctgctgagcaatgaggaggacaggaaggtgggcaagctgtttgaggacaccaagtacaccaccctcatcgccaagctgaagagtgatggcatccccatgtacaagagaaatgtgatgatcctgaccaaccctgtggccgccaagaagaatgtgtccatcaacacagtgacctatgagtgggcccctcctgtgcagaaccaggccctggcccggcagtacatgcagatgctgcccaaggagaagcagcctgtggccggcagcgagggcgcccagtacaggaagaagcagctggccaagcagctgcctgcccatgaccaggaccccagcaaatgtcatgagctgagcccccgggaggtgaaggagatggagcagtttgtgaagaagtacaagtctgaggccctgggcgtgggagatgtgaagctgccctgtgagatggatgcccagggccccaagcagatgaacatccctggaggagacaggagcaccccagctgctgtgggcgccatggaggacaagtctgctgagcacaagaggacccagtacagctgctactgctgcaagctgtccatgaaggagggggaccctgccatctatgcagagagagctggctatgacaagctgtggcacccagcctgctttgtgtgcagcacctgccacgagctgctggtggacatgatctacttctggaagaatgagaagctgtactgcggccgccactactgtgacagcgagaagccccgctgtgccggctgtgatgagctgatcttcagcaatgagtacacccaggccgagaaccagaactggcacctgaagcacttctgctgctttgactgtgacagcatcctggccggggagatctacgtgatggtgaatgacaagcctgtgtgcaagccctgctacgtgaagaaccacgctgtggtgtgccagggctgccacaatgccatcgaccctgaggtgcagagggtgacctacaacaacttctcctggcacgccagcacagagtgcttcctgtgcagctgctgcagcaagtgcctgattggccagaagttcatgcctgtggagggcatggtgttctgcagcgtggagtgcaagaagaggatgtcctag

SEQ ID NO: 172973 - DNA, 1266 bp, Artificial Sequence
  Description of Artificial Sequence: Synthetic coding sequence
atggacctggagaacaaggtgaagaagatgggcctgggccacgagcagggctttggagccccctgcctgaagtgcaaggagaagtgtgagggctttgagctgcacttctggaggaagatctgcaggaactgcaagtgtggccaggaggagcatgatgtgctgctgagcaatgaggaggacaggaaggtgggcaagctgtttgaggacaccaagtacaccaccctcatcgccaagctgaagagtgatggcatccccatgtacaagagaaatgtgatgatcctgaccaaccctgtggccgccaagaagaatgtgtccatcaacacagtgacctatgagtgggcccctcctgtgcagaaccaggccctggcccggcagtacatgcagatgctgcccaaggagaagcagcctgtggccggcagcgagggcgcccagtacaggaagaagcagctggccaagcagctgcctgcccatgaccaggaccccagcaaatgtcatgagctgagcccccgggaggtgaaggagatggagcagtttgtgaagaagtacaagtctgaggccctgggcgtgggagatgtgaagctgccctgtgagatggatgcccagggccccaagcagatgaacatccctggaggagacaggagcaccccagctgctgtgggcgccatggaggacaagtctgctgagcacaagaggacccagtacagctgctactgctgcaagctgtccatgaaggagggggaccctgccatctatgcagagagagctggctatgacaagctgtggcacccagcctgctttgtgtgcagcacctgccacgagctgctggtggacatgatctacttctggaagaatgagaagctgtactgcggccgccactactgtgacagcgagaagccccgctgtgccggctgtgatgagctgatcttcagcaatgagtacacccaggccgagaaccagaactggcacctgaagcacttctgctgctttgactgtgacagcatcctggccggggagatctacgtgatggtgaatgacaagcctgtgtgcaagccctgctacgtgaagaaccacgctgtggtgtgccagggctgccacaatgccatcgaccctgaggtgcagagggtgacctacaacaacttctcctggcacgccagcacagagtgcttcctgtgcagctgctgcagcaagtgcctgattggccagaagttcatgcctgtggagggcatggtgttctgcagcgtggagtgcaagaagaggatgtcctag

SEQ ID NO: 172974 - DNA, 1239 bp, Artificial Sequence
  Description of Artificial Sequence: Synthetic coding sequence
atgggcctgggccacgagcagggctttggagccccctgcctgaagtgcaaggagaagtgtgagggctttgagctgcacttctggaggaagatctgcaggaactgcaagtgtggccaggaggagcatgatgtgctgctgagcaatgaggaggacaggaaggtgggcaagctgtttgaggacaccaagtacaccaccctgattgccaagctgaagagtgatggcatccccatgtacaagagaaatgtgatgatcctgaccaaccctgtggccgccaagaagaatgtgtccatcaacacagtgacctatgagtgggcccctcctgtgcagaaccaggccctggcccggcagtacatgcagatgctgcccaaggagaagcagcctgtggccggcagcgagggcgcccagtacaggaagaagcagctggccaagcagctgcctgcccatgaccaggaccccagcaagtgccacgagctgagcccccgggaggtgaaggagatggagcagtttgtgaagaagtacaagtctgaggccctgggcgtgggagatgtgaagctgccctgtgagatggatgcccagggccccaagcagatgaacatccctggaggagacaggagcaccccagctgctgtgggcgccatggaggacaagtctgctgagcacaagaggacccagtacagctgctactgctgcaagctgtccatgaaggagggggaccctgccatctatgcagagcgggccggctatgacaagctgtggcacccagcctgctttgtgtgcagcacctgccacgagctgctggtggacatgatctacttctggaagaatgagaagctgtactgcggccgccactactgtgacagcgagaagccccgctgtgccggctgtgatgagctgatcttcagcaatgagtacacccaggccgagaaccagaactggcacctgaagcacttctgctgctttgactgtgacagcatcctggccggggagatctacgtgatggtgaatgacaagcctgtgtgcaagccctgctacgtgaagaaccacgctgtggtgtgccagggctgccacaatgccattgatcctgaggtgcagagggtgacctacaacaacttctcctggcacgccagcacagagtgcttcctgtgcagctgctgcagcaaatgtctcatcggccagaagttcatgcctgtggagggcatggtgttctgcagcgtggagtgcaagaagaggatgtcctag

SEQ ID NO: 172975 - DNA, 540 bp, Artificial Sequence
  Description of Artificial Sequence: Synthetic coding sequence
atgaaggagggggaccctgccatctatgcagagagagctggctatgacaagctgtggcacccagcctgctttgtgtgcagcacctgccacgagctgctggtggacatgatctacttctggaagaatgagaagctgtactgcggccgccactactgtgacagcgagaagccccgctgtgccggctgtgatgagctgatcttcagcaatgagtacacccaggccgagaaccagaactggcacctgaagcacttctgctgctttgactgtgacagcatcctggccggggagatctacgtgatggtgaatgacaagcctgtgtgcaagccctgctacgtgaagaaccacgctgtggtgtgccagggctgccacaatgccatcgaccctgaggtgcagagggtgacctacaacaacttctcctggcacgccagcacagagtgcttcctgtgcagctgctgcagcaagtgcctgattggccagaagttcatgcctgtggagggcatggtgttctgcagcgtggagtgcaagaagaggatgtcctag

SEQ ID NO: 172976 - DNA, 804 bp, Artificial Sequence
  Description of Artificial Sequence: Synthetic coding sequence
atgggcgcccggcagatccagaccagcagcagccagaccagccctgaggaggccatgggcaccccccgcatccagcacctgctgatcctgctggtgctgggcgccagcctgctgaccagcggcctggagctgtactgccagaagggcctgtccatgacagtggaggccgaccctgccaacatgttcaactggaccacagaggaggtggagacctgtgacaagggggccctgtgccaggagaccatcctgatcatcaaggccggcacagaaacagccatcctggccaccaagggctgcatccctgagggggaggaggccatcaccatcgtgcagcacagcagccccccaggcctgattgtgaccagctacagcaactactgtgaggacagcttctgcaatgacaaggacagcctgagccagttctgggagttcagcgagaccacagccagcacagtgtccaccaccctgcactgccccacctgtgtggccctgggcacctgcttcagcgcccccagcctgccctgccccaacggcaccacccgctgctaccagggcaagctggagatcaccggcggcggcatcgagagctctgtggaggtgaagggctgcacagccatgattggctgccgcctgatgagcggcatcctggccgtgggccccatgtttgtgcgggaggcctgcccccaccagctgctgacccagcccaggaagacagaaaatggagccacctgcctgcccatccctgtgtggggcctgcagctgctgctgcccctgctgctgcccagcttcatccacttctcctag

SEQ ID NO: 172977 - DNA, 789 bp, Artificial Sequence
  Description of Artificial Sequence: Synthetic coding sequence
atccagaccagcagcagccagaccagccctgaggaggccatgggcaccccccgcatccagcacctgctgatcctgctggtgctgggcgccagcctgctgaccagcggcctggagctgtactgccagaagggcctgtccatgacagtggaggccgaccctgccaacatgttcaactggaccacagaggaggtggagacctgtgacaagggggccctgtgccaggagaccatcctgatcatcaaggccggcacagaaacagccatcctggccaccaagggctgcatccctgagggggaggaggccatcaccatcgtgcagcacagcagccccccaggcctcatcgtgaccagctacagcaactactgtgaagattccttctgcaatgacaaggacagcctgagccagttctgggagttcagcgagaccacagccagcacagtgtccaccaccctgcactgccccacctgtgtggccctgggcacctgcttcagcgcccccagcctgccctgccccaacggcaccacccgctgctaccagggcaagctggagatcactggaggcggcatcgagagctctgtggaggtgaagggctgcacagccatgattggctgccgcctgatgagcggcatcctggccgtgggccccatgtttgtgcgggaggcctgcccccaccagctgctgacccagcccaggaagacagaaaatggagccacctgcctgcccatccctgtgtggggcctgcagctgctgctgcccctgctgctgcccagcttcatccacttctcctag

SEQ ID NO: 172978 - DNA, 750 bp, Artificial Sequence
  Description of Artificial Sequence: Synthetic coding sequence
atgggcaccccccgcatccagcacctgctgatcctgctggtgctgggcgccagcctgctgaccagcggcctggagctgtactgccagaagggcctgtccatgacagtggaggccgaccctgccaacatgttcaactggaccacagaggaggtggagacctgtgacaagggggccctgtgccaggagaccatcctgatcatcaaggccggcacagaaacagccatcctggccaccaagggctgcatccctgagggggaggaggccatcaccatcgtgcagcacagcagccccccaggcctgattgtgaccagctacagcaactactgtgaggacagcttctgcaatgacaaggacagcctgagccagttctgggagttcagcgagaccacagccagcacagtgtccaccaccctgcactgccccacctgtgtggccctgggcacctgcttcagcgcccccagcctgccctgccccaacggcaccacccgctgctaccagggcaagctggagatcaccggcggcggcatcgagagctctgtggaggtgaagggctgcacagccatgattggctgccgcctgatgagcggcatcctggccgtgggccccatgtttgtgcgggaggcctgcccccaccagctgctgacccagcccaggaagacagaaaatggagccacctgcctgcccatccctgtgtggggcctgcagctgctgctgcccctgctgctgcccagcttcatccacttctcctag

SEQ ID NO: 172979 - DNA, 804 bp, Artificial Sequence; identical to SEQ ID NO: 172976
  Description of Artificial Sequence: Synthetic coding sequence

SEQ ID NO: 172980 - DNA, 2823 bp, Artificial Sequence
  Description of Artificial Sequence: Synthetic coding sequence
atgatcagcgcccactgcaacctgcggctgctgtgcagcagtgacagcagcgccagcgccagccaggtggccggcaccacagaggtggtggagaacctggtgaccaatgacaacagccccaacatccctgaggccatcgacaggctcttcagtgacatcgccaacatcaaccgggagagcatggccgagatcacagacatccagatcgaggagatggctgtgaacctgtggaactgggccctgaccatcggcggcggctggctggtgaatgaggagcagaagatccggctgcactacgtggcctgcaagctgctgtccatgtgtgaggccagctttgccagcgagcagagcatccagaggctcatcatgatgaacatgagaattggcaaggagtggctggatgctggcaacttcctgattgctgatgagtgcttccaggccgctgtggccagcctggagcagctgtatgtgaagctgatccagaggagcagccctgaggccgacctgaccatggagaagatcaccgtggagagtgaccacttccgggtgctgagctaccaggccgagagcgctgtggcccagggcgacttccagagggcctccatgtgtgtgctgcagtgcaaggacatgctgatgaggctgccccagatgaccagcagcctgcaccacctgtgctacaactttggagtggagacccagaagaacaacaagtatgaggagagcagcttctggctgagccagagctatgacatcggcaagatggacaagaagagcactggacctgagatgctggccaaggtgctgcggctgctggccaccaactacctggactgggatgacaccaagtactatgacaaggccctgaatgctgtgaacctggccaacaaggagcacctgagcagccctggcctcttcctgaagatgaagatcctgctgaagggggagaccagcaatgaggagctgctggaggccgtgatggagatcctgcacctggacatgcccctggacttctgcctgaacatcgccaagctgctgatggaccacgagcgggagagcgtgggcttccacttcctgaccatcatccacgagcgcttcaagagcagtgaaaatattggcaaggtgctgatcctgcacacagacatgctgctgcagaggaaggaggagctgctggccaaggagaagattgaggagatcttcctggcccaccagacaggccggcagctgacagctgagagcatgaactggctgcacaacatcctgtggaggcaggccgccagcagctttgaggtgcagaactacacagatgccctgcagtggtactactacagcctgcgcttctacagcacagatgagatggacctggacttcaccaagctgcagaggaacatggcctgctgctacctgaacctgcagcagctggacaaggccaaggaggccgtggccgaggccgagagacatgaccccagaaatgtgttcacccagttctacatcttcaagattgctgtgattgagggcaacagcgagcgggccctgcaggccatcatcaccctggagaacatcctgacagatgaggagagtgaagataatgacctggtggccgagcggggcagccccaccatgctgctgagcctggccgcccagtttgccctggagaatggccagcagatcgtggccgagaaggccctggagtacctggcccagcacagcgaggaccaggagcaggtgctgacagctgtgaagtgcctgctgcgcttcctgctgcccaagattgctgagatgcctgagagcgaggacaagaagaaggagatggaccggctgctgacctgcctgaacagagcctttgtgaagctgagccagccctttggagaggaggccctgagcctggagagccgggccaatgaggcccagtggttcaggaagacagcctggaacctggccgtgcagtgtgacaaggaccctgtgatgatgagggagttcttcatcctgagctacaagatgagccagttctgccccagcgaccaggtgatcctgattgccaggaagacctgcctgctgatggctgtggccgtggacctggagcagggcaggaaggccagcacagcctttgagcagaccatgttcctgagccgggccctggaggagatccagacctgcaatgacatccacaacttcctgaagcagacaggcaccttcagcaatgacagctgtgagaagctgctgctgctgtatgaatttgaggtgcgggccaagctgaatgaccccctgctggagagcttcctggagagcgtgtgggagctgccccacctggagaccaagacctttgagaccatcgccatcatcgccatggagaagccagcccactaccccctgattgccctgaaggccctgaagaaggccctgctgctgtacaagaaggaggagcccatcgacatcagccagtacagcaagtgcatgcacaacctggtgaacctgtctgtgcctgatggagccagcaatgtggagctgtgccccctggaggaggtgtggggctactttgaagatgccctgagccacatcagcaggaccaaggactacccagagatggagatcctgtggctgatggtgaagtcctggaacacaggagtgctgatgttcagccgcagcaaatatgccagcgctgagaagtggtgtggcctggccctgcgcttcctgaaccacctgaccagcttcaaggagagctatgagacccagatgaacatgctgtacagccagctggtggaggccctgagcaacaacaagggccctgtgttccatgaacatggctactggagcaagagtgactag

SEQ ID NO: 172981 - DNA, 1848 bp, Artificial Sequence
  Description of Artificial Sequence: Synthetic coding sequence
atggagatcctgcacctggacatgcccctggacttctgcctgaacatcgccaagctgctgatggaccacgagcgggagagcgtgggcttccacttcctgaccatcatccacgagcgcttcaagagcagcgagaacatcggcaaggtgctgatcctgcacacagacatgctgctgcagaggaaggaggagctgctggccaaggagaagattgaggagatcttcctggcccaccagacaggccggcagctgacagctgagagcatgaactggctgcacaacatcctgtggaggcaggccgccagcagctttgaggtgcagaactacacagatgccctgcagtggtactactacagcctgcgcttctacagcacagatgagatggacctggacttcaccaagctgcagaggaacatggcctgctgctacctgaacctgcagcagctggacaaggccaaggaggccgtggccgaggccgagagacatgaccccagaaatgtgttcacccagttctacatcttcaagattgctgtgattgagggcaacagcgagcgggccctgcaggccatcatcaccctggagaacatcctgacagatgaggagagcgaggacaatgacctggtggccgagcggggcagccccaccatgctgctgagcctggccgcccagtttgccctggagaatggccagcagatcgtggccgagaaggccctggagtacctggcccagcacagcgaggaccaggagcaggtgctgacagctgtgaagtgcctgctgcgcttcctgctgcccaagattgctgagatgcctgagagcgaggacaagaagaaggagatggaccggctgctgacctgcctgaacagagcctttgtgaagctgagccagccctttggagaggaggccctgagcctggagagccgggccaatgaggcccagtggttcaggaagacagcctggaacctggccgtgcagtgtgacaaggaccctgtgatgatgagggagttcttcatcctgagctacaagatgagccagttctgccccagcgaccaggtgatcctgattgccaggaagacctgcctgctgatggctgtggccgtggacctggagcagggcaggaaggccagcacagcctttgagcagaccatgttcctgagccgggccctggaggagatccagacctgcaatgacatccacaacttcctgaagcagacaggcaccttcagcaatgacagctgtgagaagctgctgctgctgtatgaatttgaggtgcgggccaagctgaatgaccccctgctggagagcttcctggagagcgtgtgggagctgccccacctggagaccaagacctttgagaccatcgccatcatcgccatggagaagccagcccactaccccctcatcgccctgaaggccctgaagaaggccctgctgctgtacaagaaggaggagcccatcgacatcagccagtacagcaagtgcatgcacaacctggtgaacctgtctgtgcctgatggagccagcaatgtggagctgtgccccctggaggaggtgtggggctactttgaagatgccctgagccacatcagcaggaccaaggactacccagagatggagatcctgtggctgatggtgaagtcctggaacacaggagtgctgatgttcagccgcagcaaatatgccagcgctgagaagtggtgtggcctggccctgcgcttcctgaaccacctgaccagcttcaaggagagctatgagacccagatgaacatgctgtacagccagctggtggaggccctgagcaacaacaagggccctgtgttccacgagcacggctactggagcaagagtgactag

SEQ ID NO: 172982 - DNA, 2778 bp, Artificial Sequence
  Description of Artificial Sequence: Synthetic coding sequence
atggacaatgatgacttcttctccatggacttcaaggaggtggtggagaacctggtgaccaatgacaacagccccaacatccctgaggccatcgacaggctcttcagtgacatcgccaacatcaaccgggagagcatggccgagatcacagacatccagatcgaggagatggctgtgaacctgtggaactgggccctgaccatcggcggcggctggctggtgaatgaggagcagaagatccggctgcactacgtggcctgcaagctgctgtccatgtgtgaggccagctttgccagcgagcagagcatccagaggctcatcatgatgaacatgagaattggcaaggagtggctggatgctggcaacttcctgattgctgatgagtgcttccaggccgctgtggccagcctggagcagctgtatgtgaagctgatccagaggagcagccctgaggccgacctgaccatggagaagatcaccgtggagagtgaccacttccgggtgctgagctaccaggccgagagcgctgtggcccagggcgacttccagagggcctccatgtgtgtgctgcagtgcaaggacatgctgatgaggctgccccagatgaccagcagcctgcaccacctgtgctacaactttggagtggagacccagaagaacaacaagtatgaggagagcagcttctggctgagccagagctatgacatcggcaagatggacaagaagagcacaggccctgagatgctggccaaggtgctgcggctgctggccaccaactacctggactgggatgacaccaagtactatgacaaggccctgaatgctgtgaacctggccaacaaggagcacctgagcagccctggcctcttcctgaagatgaagatcctgctgaagggggagaccagcaatgaggagctgctggaggccgtgatggagatcctgcacctggacatgcccctggacttctgcctgaacatcgccaagctgctgatggaccacgagcgggagagcgtgggcttccacttcctgaccatcatccacgagcgcttcaagagcagcgagaacatcggcaaggtgctgatcctgcacacagacatgctgctgcagaggaaggaggagctgctggccaaggagaagattgaggagatcttcctggcccaccagacaggccggcagctgacagctgagagcatgaactggctgcacaacatcctgtggaggcaggccgccagcagctttgaggtgcagaactacacagatgccctgcagtggtactactacagcctgcgcttctacagcacagatgagatggacctggacttcaccaagctgcagaggaacatggcctgctgctacctgaacctgcagcagctggacaaggccaaggaggccgtggccgaggccgagagacatgaccccagaaatgtgttcacccagttctacatcttcaagattgctgtgattgagggcaacagcgagcgggccctgcaggccatcatcaccctggagaacatcctgacagatgaggagagcgaggacaatgacctggtggccgagcggggcagccccaccatgctgctgagcctggccgcccagtttgccctggagaatggccagcagatcgtggccgagaaggccctggagtacctggcccagcacagcgaggaccaggagcaggtgctgacagctgtgaagtgcctgctgcgcttcctgctgcccaagattgctgagatgcctgagagcgaggacaagaagaaggagatggaccggctgctgacctgcctgaacagagcctttgtgaagctgagccagccctttggagaggaggccctgagcctggagagccgggccaatgaggcccagtggttcaggaagacagcctggaacctggccgtgcagtgtgacaaggaccctgtgatgatgagggagttcttcatcctgagctacaagatgagccagttctgccccagcgaccaggtgatcctgattgccaggaagacctgcctgctgatggctgtggccgtggacctggagcagggcaggaaggccagcacagcctttgagcagaccatgttcctgagccgggccctggaggagatccagacctgcaatgacatccacaacttcctgaagcagacaggcaccttcagcaatgacagctgtgagaagctgctgctgctgtatgaatttgaggtgcgggccaagctgaatgaccccctgctggagagcttcctggagagcgtgtgggagctgccccacctggagaccaagacctttgagaccatcgccatcatcgccatggagaagccagcccactaccccctcatcgccctgaaggccctgaagaaggccctgctgctgtacaagaaggaggagcccatcgacatcagccagtacagcaagtgcatgcacaacctggtgaacctgtctgtgcctgatggagccagcaatgtggagctgtgccccctggaggaggtgtggggctactttgaagatgccctgagccacatcagcaggaccaaggactacccagagatggagatcctgtggctgatggtgaagtcctggaacacaggagtgctgatgttcagccgcagcaaatatgccagcgctgagaagtggtgtggcctggccctgcgcttcctgaaccacctgaccagcttcaaggagagctatgagacccagatgaacatgctgtacagccagctggtggaggccctgagcaacaacaagggccctgtgttccacgagcacggctactggagcaagagtgactag

SEQ ID NO: 172983 - DNA, 2823 bp, Artificial Sequence; identical to SEQ ID NO: 172980
  Description of Artificial Sequence: Synthetic coding sequence

SEQ ID NO: 172984 - DNA, 372 bp, Artificial Sequence
  Description of Artificial Sequence: Synthetic coding sequence
atgatggccaaccacctggtgaagccagacaacagaaactgcaagaggccccgggagctggagagccctgtgcctgacagcccccagctgagcagcctgggcaagagtgacagcagcttcagcgagatcagcggcctcttctacaaggatgaggccctggagaaggacctgaatgatgtgtccaaggagatcaacctgatgctgagcacctacgccaagctgctgtctgaaagagctgctgtggatgccagctacattgatgaaattgatgagctgttcaaggaggccaatgccatcgagaacttcctgatccagaagcgggagttcctgcggcagcgcttcaccgtgattgccaacaccctgcacaggtag

SEQ ID NO: 172985 - DNA, 372 bp, Artificial Sequence; identical to SEQ ID NO: 172984
  Description of Artificial Sequence: Synthetic coding sequence

SEQ ID NO: 172986 - DNA, 1059 bp, Artificial Sequence
  Description of Artificial Sequence: Synthetic coding sequence
atggccctgcggcctgaggaccccagcagcggcttccgccacagcaatgtggtggccttcatcaatgagaagatggcccggcacaccaagggccctgagttctacctggagaacatcagcctgtcctgggagaaggtggaggacaagctgcgggccatcctggaggacagcgaggtgcccagcgaggtgaaggaggcctgcacctggggcagcctggccctgggcgtgcgctttgcccaccggcaggcccagctgcagaggcaccgggtgcgctggctgcacggctttgccaagctgcacaagtctgctgcccaggccctggccagtgacctgaagaagctgcgggagcagcaggagacagagaggaaggaggccgccagccggctgaggatggcccagaccagcctggtggaggtgcagaaggagcgggacaaggagctggtgagcccccatgagtgggagcagggcgccggctggccaggcctggccacagctggaggagtgtgcacagagggcgctgctgaggaggaggaggaggccgctgtggccgctgctggagctgctgggggcaaaggagctgaggaggagcagaggggctgctggaggctgtggctgcccctgtggaggccctggctgcccctgtggaggctgggcctgcccccctggaggcccagcagccccacctggaggcctggcctgcccccctggaggccccagaggtcctggagggagagcagctgcagcagcctggagatgctgatcaggaagagcacccccatcggcggcagaagaagagagatcagcggccgcagcaagcagccccacctgatcagcctggagcccaggaccccaggccctgagccccaccagaacctcttcctgagcagcagcctgccccacacccacacccacacccaggccctcttcccccccagccagacctaccccctgtaccccctgcacaagcagcagagccagcaccagttccggctgagctgcctgcccaccggccggcccctcatcctggcctgtggcctgatgggcggccccacagaatag

SEQ ID NO: 172987 - DNA, 1059 bp, Artificial Sequence; identical to SEQ ID NO: 172986
  Description of Artificial Sequence: Synthetic coding sequence

SEQ ID NO: 172988 - DNA, 1230 bp, Artificial Sequence
  Description of Artificial Sequence: Synthetic coding sequence
atggccctgcggcctgaggaccccagcagcggcttccgccacagcaatgtggtggccttcatcaatgagaagatggcccggcacaccaagggccctgagttctacctggagaacatcagcctgtcctgggagaaggtggaggacaagctgcgggccatcctggaggacagcgaggtgcccagcgaggtgaaggaggcctgcacctggggcagcctggccctgggcgtgcgctttgcccaccggcaggcccagctgcagaggcaccgggtgcgctggctgcacggctttgccaagctgcacaagtctgctgcccaggccctggccagtgacctgaagaagctgcgggagcagcaggagacagagaggaaggaggccgccagccggctgaggatggcccagaccagcctggtggaggtgcagaaggagcgggacaaggagctggtgagcccccatgagtgggagcagggcgccggctggccaggcctggccacagctggaggagtgtgcacagagggcgctgctgaggaggaggaggaggccgctgtggccgctgctggagctgctgggggcaaaggagctgaggaggagcagagagatgtggaggtggtggccgcccctgtggaggccatggcccctcctgtggaggccggggccgcccccatggagacccagttcccccacgtggaggcccgggccgcctccatggagaccacagagaagctggagcgcatcctgctgcagctgctgggagatgctgaccaggagaagtacacctactggggccagaaggagggggacctgcggtctgtggagacagccaccagctacttcagcggcaccaccaacccctggagccgggccagcagcgagcccctgcctgtgcagctgcctgccagctacagctacagctacagcagccccttcagcagcttcagtgacatccccaccatcagccccccccaggccaccgtgacagcccctgtgcccccccagctgcccagcgactgggaggcctttgacaccagcctgtggagcgatggcggcccccacagaattgaccaccaggagcacccccgggaccggcgctacagcgagccccaccagcagaggcctcctgtgtacagaagacctggggactgggactgcccctggtgcaatgctgtgaacttcagccggcgggacacctgctttgactgtgggaagggcatctggctgcagaagccccactag

SEQ ID NO: 172989 - DNA, 939 bp, Artificial Sequence
  Description of Artificial Sequence: Synthetic coding sequence
atggccctgcggcctgaggaccccagcagcggcttccgccacggcaatgtggtggccttcatcatcgagaagatggcccggcacaccaagggccctgagttctactttgagaacatcagcctgtcctgggaggaggtggaggacaagctgcgggccatcctggaggacagcgaggtgcccagcgaggtgaaggaggcctgcacctggggcagcctggccctgggcgtgcgctttgcccaccggcagggccagctgcagaacagaagagtgcagtggctgcagggctttgccaagctgcacaggtctgctgccctggtgctggccagcaacctgacagagctgaaggagcagcaggagatggagtgcaatgaggccaccttccagctgcagctgacagagaccagcctggccgaggtgcagcgggagcgggacatgctgcgctggaagctgttccacgccgagctggccccaccccagggccagggccaggccaccgtcttccctggcctggccacagctggaggagactggacagagggcgctggggagcaggagaaggaggccgtggccgccgccggggctgctgggggcaagggggaggagagatatgcagaggccggccctgccccagctgaggtgctgcagggcctgggcggcggcttccggcagcccctgggcgccatcgtggccggcaagctgcacctgtgtggggctgagggggagaggagccaggtgtccaccaacagccacgtgtgcctgctgtgggcctgggtgcacagcctgaccggggccagcagctgcccagccccctacctgatccacatcctgatccccatgccctttgtgcggctgctgagccacacccagtacacccccttcaccagcaagggccacaggacaggcagcaacagtgatgccttccagctgggcggcctgtag

SEQ ID NO: 172990 - DNA, 4494 bp, Artificial Sequence
  Description of Artificial Sequence: Synthetic coding sequence
atgagcagagctgtgcggctgcctgtgccctgccctgtgcagctgggcaccctgagaaatgacagcctggaggcccagctgcacgagtatgtgaagcagggcaactacgtgaaggtgaagaagatcctgaagaagggcatctacgtggatgctgtgaacagcctgggccagacagccctgtttgtggccgccctgctgggcctgaggaagtttgtggatgtgctggtggactatggcagtgaccccaaccaccgctgctttgatggcagcacccctgtgcatgctgctgccttcagcggcaaccagtggatcctgagcaagctgctggatgctggaggagacctgcggctgcatgatgagcggggccagaaccccaagacctgggccctgacagctgggaaggagaggagcacccagatcgtggagttcatgcagagatgtgccagccacatgcaggccatcatccagggcttctcctatgacctgctgaagaagattgacagcccccagaggctggtgtacagccccagctggtgtggcggcctggtgcagggcaaccccaacggcagccccaaccggctgctgaaggccggggtcatcagcgcccagaacatctacagctttggatttgggaaggccatgccctggttccagttctacctgaccggggccacccagatggcctacctgggcagcctgcccgtcatcggggagaaggaggtgatccaggctgatgatgagcccaccttctccttcttcagcggcccctacatggtgatgaccaacctggtgtggaatggcagccgggtgacagtgaaggagctgaacctgcccacccacccccactgcagccggctgcggctggccgacctgctgattgctgagcaggagcacagcagcaagctgcggcacccctacctgctgcagctgatggctgtgtgcctgagccaggacctggagaagacccggctggtgtatgaaagaatcaccatcggcaccctcttctctgtgctgcatgaaagaagaagccagtttcctgtgctgcacatggaggtgattgtgcacctgctgctgcagatcagtgatgccctgcgctacctgcacttccagggcttcatccacaggagcctgagcagctatgctgtgcacatcatcagccctggagaggcccggctgaccaacctggagtacatgctggagagcgaggacagaggagtgcagagggacctgaccagggtgcccctgcccacccagctgtacaactgggccgcccctgaggtgatcctgcagaaggccgccaccgtgaagagtgacatctacagcttctccatgatcatgcaggagatcctgacagatgacatcccctggaagggcctggatggctctgtggtgaagaaggctgtggtgtctggcaactacctggaggctgatgtgcggctgcccaagccctactatgacatcgtgaagagcggcatccacgtgaagcagaaggacaggaccatgaacctgcaggacatccgctacatcctgaagaatgacctgaaggacttcaccggggcccagaggacccagcccacagagagcccccgggtgcagagatatggcctgcacccagatgtgaatgtgtacctgggcctgaccagcgagcacccccgggagaccccagacatggagatcatcgagctgaaggagatgggcagccagccccacagcccccgggtgcacagcctcttcacagagggcaccctggacccccaggccccagacccctgcctgatggcccgggagacccagaaccaggatgccccctgcccagcccccttcatggccgaggaggccagcagccccagcacaggccagcccagcctgtgcagctttgagatcaatgagatctacagcggctgcctgatcctggaggatgacatcgaggagcccccaggggccgccagcagcctggaggctgatggccccaaccaggtggatgagctgaagtccatggaggaggagctggacaagatggagcgggaggcctgctgcttcggctctgaagatgagagcagcagcaaggccgagacagagtacagctttgatgactgggactggcagaatggcagcctgagcagcctgagcctgcctgagagcacccgggaggccaagagcaacctgaacaacatgagcaccacagaggagtacctgatcagcaaatgtgtgctggacctgaagatcatgcagaccatcatgcatgaaaatgatgaccggctgagaaatattgagcagatcctggatgaggtggagatgaagcagaaggagcaggaggagaggatgagcctgtgggccaccagccgggagttcaccaatgcctacaagctgcccctggccgtgggcccccccagcctgaactacatcccccctgtgctgcagctgagcggcggccagaagccagacaccagcggcaactaccccaccctgccccgcttccccaggatgctgcccaccctgtgtgaccccgggaagcagaacacagatgagcagttccagtgcacccagggcgccaaggacagcctggagaccagccgcatccagaacaccagcagccagggccggccccgggagagcacagcccaggccaaggccacccagttcaacagcgccctcttcaccctgagcagccaccggcagggccccagcgccagccccagctgccactgggacagcaccaggatgtctgtggagcctgtgtcctctgagatctacaatgctgagagcaggaacaaggatgatggcaaggtgcacctgaagtggaagatggaggtgaaggagatggccaagaaggccgccaccggccagctgactgtgcccccctggcacccccagagcagcctgaccctggagagcgaggccgagaatgaaccagatgccctgctgcagccccccatccgcagcccagaaaatacagactggcagagggtgattgagtaccaccgggagaatgatgagcccagaggaaatggcaagtttgacaagacaggcaacaatgactgtgacagcgaccagcacggccggcagccccggctgggcagcttcaccagcatccgccaccccagcccccggcagaaggagcagcctgagcacagcgaggccttccaggccagcagtgacaccctggtggccgtggagaagagctacagccaccagagcatgcagagcacctgcagccctgagagcagcgaggacatcacagatgagttcctgaccccagatggagagtacttctacagcagcacagcccaggagaacctggccctggagaccagcagccccatcgaggaggactttgagggcatccagggcgcctttgcccagccccaggtgtctggagaggagaagttccagatgaggaagatcctgggcaagaatgctgagatcctgcccaggagccagttccagcctgtgcgcagcacagaagatgagcaggaggagaccagcaaggagagccccaaggagctgaaggagaaggacatcagcctgacagacatccaggacctgagcagcatctcctatgagccagacagcagcttcaaggaggccagctgcaagacccccaagatcaaccacgcccccacctctgtgtccacccccctgagccctggctctgtgtcctctgctgccagccagtacaaggactgcctggagagcatcaccttccaggtgaagacagaatttgccagctgctggaacagccaggagttcatccagaccctgagtgatgacttcatctctgtgcgggagcgggccaagaagctggacagcctgctgaccagcagcgagaccccacccagccggctgaccggcctgaagaggctgagcagcttcatcggggccggcagccccagcctggtgaaggcctgtgacagcagcccccctcatgccacccagaggaggagcctgcccaaggtggaggccttcagccagcaccacattgatgagctgcccccacccagccaggagctgctggatgacatcgagctgctgaagcagcagcagggcagcagcacagtgctgcacgagaacacagccagtgatggcggcggcacagccaatgaccagaggcacctggaggagcaggagacagacagcaagaaggaggacagctccatgctgctgagcaaggagacagaggacctgggggaggacacagagcgggcccacagcaccctggatgaggacctggagcgctggctgcagcccccagaggagagcgtggagctgcaggacctgcccaagggcagcgagcgggagaccaacatcaaggaccagaaggtgggggaggagaagaggaagagagaagattccatcaccccagagaggaggaagtcagaaggagtgctgggcaccagcgaggaggatgagctgaagagctgcttctggaagaggctgggctggagcgagagcagccgcatcatcgtgctggaccagagcgacctgagtgactag

SEQ ID NO: 172991 - DNA, 4356 bp, Artificial Sequence
  Description of Artificial Sequence: Synthetic coding sequence
atgagcagagctgtgcggctgcctgtgccctgccctgtgcagctgggcaccctgagaaatgacagcctggaggcccagctgcacgagtatgtgaagcagggcaactacgtgaaggtgaagaagatcctgaagaagggcatctacgtggatgctgtgaacagcctgggccagacagccctgtttgtggccgccctgctgggcctgaggaagtttgtggatgtgctggtggactatggcagtgaccccaaccaccgctgctttgatggcagcacccctgtgcatgctgctgccttcagcggcaaccagtggatcctgagcaagctgctggatgctggaggagacctgcggctgcatgatgagcggggccagaaccccaagacctgggccctgacagctgggaaggagaggagcacccagatcgtggagttcatgcagagatgtgccagccacatgcaggccatcatccagggcttctcctatgacctgctgaagaagattgacagcccccagaggctggtgtacagccccagctggtgtggcggcctggtgcagggcaaccccaacggcagccccaaccggctgctgaaggccggggtcatcagcgcccagaacatctacagctttggatttgggaagttctacctgaccggggccacccagatggcctacctgggcagcctgcccgtcatcggggagaaggaggtgatccaggctgatgatgagcccaccttctccttcttcagcggcccctacatggtgatgaccaacctggtgtggaatggcagccgggtgacagtgaaggagctgaacctgcccacccacccccactgcagccggctgcggctggccgacctgctgattgctgagcaggagcacagcagcaagctgcggcacccctacctgctgcagctgatggctgtgtgcctgagccaggacctggagaagacccggctggtgtatgaaagaatcaccatcggcaccctcttctctgtgctgcatgaaagaagaagccagtttcctgtgctgcacatggaggtgattgtgcacctgctgctgcagatcagtgatgccctgcgctacctgcacttccagggcttcatccacaggagcctgagcagctatgctgtgcacatcatcagccctggagaggcccggctgaccaacctggagtacatgctggagagcgaggacagaggagtgcagagggacctgaccagggtgcccctgcccacccagctgtacaactgggccgcccctgaggtgatcctgcagaaggccgccaccgtgaagagtgacatctacagcttctccatgatcatgcaggagatcctgacagatgacatcccctggaagggcctggatggctctgtggtgaagaaggctgtggtgtctggcaactacctggaggctgatgtgcggctgcccaagccctactatgacatcgtgaagagcggcatccacgtgaagcagaaggacaggaccatgaacctgcaggacatccgctacatcctgaagaatgacctgaaggacttcaccggggcccagaggacccagcccacagagagcccccgggtgcagagatatggcctgcacccagatgtgaatgtgtacctgggcctgaccagcgagcacccccgggagaccccagacatggagatcatcgagctgaaggagatgggcagccagccccacagcccccgggtgcacagcctcttcacagagggcaccctggacccccaggccccagacccctgcctgatggcccgggagacccagaaccaggatgccccctgcccagcccccttcatggccgaggaggccagcagccccagcacaggccagcccagcctgtgcagctttgagatcaatgagatctacagcggctgcctgatcctggaggatgacatcgaggagcccccaggggccgccagcagcctggaggctgatggccccaaccaggtggatgagctgaagtccatggaggaggagctggacaagatggagcgggaggcctgctgcttcggctctgaagatgagagcagcagcaaggccgagacagagtacagctttgatgactgggactggcagaatggcagcctgagcagcctgagcctgcctgagagcacccgggaggccaagagcaacctgaacaacatgagcaccacagaggagtacctgatcagcaaatgtgtgctggacctgaagatcatgcagaccatcatgcatgaaaatgatgaccggctgagaaatattgagcagatcctggatgaggtggagatgaagcagaaggagcaggaggagaggatgagcctgtgggccaccagccgggagttcaccaatgcctacaagctgcccctggccgtgggcccccccagcctgaactacatcccccctgtgctgcagctgagcggcggccagaagccagacaccagcggcaactaccccaccctgccccgcttccccaggatgctgcccaccctgtgtgaccccgggaagcagaacacagatgagcagttccagtgcacccagggcgccaaggacagcctggagaccagccgcatccagaacaccagcagccagggccggccccgggagagcacagcccaggccaaggccacccagttcaacagcgccctcttcaccctgagcagccaccggcagggccccagcgccagccccagctgccactgggacagcaccaggatgtctgtggagcctgtgtcctctgagatctacaatgctgagagcaggaacaaggatgatggcaaggtgcacctgaagtggaagatggaggtgaaggagatggccaagaaggccgccaccggccagctgactgtgcccccctggcacccccagagcagcctgaccctggagagcgaggccgagaatgaaccagatgccctgctgcagccccccatccgcagcccagaaaatacagactggcagagggtgattgagtaccaccgggagaatgatgagcccagaggaaatggcaagtttgacaagacaggcaacaatgactgtgacagcgaccagcacggccggcagccccggctgggcagcttcaccagcatccgccaccccagcccccggcagaaggagcagcctgagcacagcgaggccttccaggccagcagtgacaccctggtggccgtggagaagagctacagcaccagcagccccatcgaggaggactttgagggcatccagggcgcctttgcccagccccaggtgtctggagaggagaagttccagatgaggaagatcctgggcaagaatgctgagatcctgcccaggagccagttccagcctgtgcgcagcacagaagatgagcaggaggagaccagcaaggagagccccaaggagctgaaggagaaggacatcagcctgacagacatccaggacctgagcagcatctcctatgagccagacagcagcttcaaggaggccagctgcaagacccccaagatcaaccacgcccccacctctgtgtccacccccctgagccctggctctgtgtcctctgctgccagccagtacaaggactgcctggagagcatcaccttccaggtgaagacagaatttgccagctgctggaacagccaggagttcatccagaccctgagtgatgacttcatctctgtgcgggagcgggccaagaagctggacagcctgctgaccagcagcgagaccccacccagccggctgaccggcctgaagaggctgagcagcttcatcggggccggcagccccagcctggtgaaggcctgtgacagcagcccccctcatgccacccagaggaggagcctgcccaaggtggaggccttcagccagcaccacattgatgagctgcccccacccagccaggagctgctggatgacatcgagctgctgaagcagcagcagggcagcagcacagtgctgcacgagaacacagccagtgatggcggcggcacagccaatgaccagaggcacctggaggagcaggagacagacagcaagaaggaggacagctccatgctgctgagcaaggagacagaggacctgggggaggacacagagcgggcccacagcaccctggatgaggacctggagcgctggctgcagcccccagaggagagcgtggagctgcaggacctgcccaagggcagcgagcgggagaccaacatcaaggaccagaaggtgggggaggagaagaggaagagagaagattccatcaccccagagaggaggaagtcagaaggagtgctgggcaccagcgaggaggatgagctgaagagctgcttctggaagaggctgggctggagcgagagcagccgcatcatcgtgctggaccagagcgacctgagtgactag

SEQ ID NO: 172992 - DNA, 4476 bp, Artificial Sequence
  Description of Artificial Sequence: Synthetic coding sequence
atgagcagagctgtgcggctgcctgtgccctgccctgtgcagctgggcaccctgagaaatgacagcctggaggcccagctgcacgagtatgtgaagcagggcaactacgtgaaggtgaagaagatcctgaagaagggcatctacgtggatgctgtgaacagcctgggccagacagccctgtttgtggccgccctgctgggcctgaggaagtttgtggatgtgctggtggactatggcagtgaccccaaccaccgctgctttgatggcagcacccctgtgcatgctgctgccttcagcggcaaccagtggatcctgagcaagctgctggatgctggaggagacctgcggctgcatgatgagcggggccagaaccccaagacctgggccctgacagctgggaaggagaggagcacccagatcgtggagttcatgcagagatgtgccagccacatgcaggccatcatccagggcttctcctatgacctgctgaagaagattgacagcccccagaggctggtgtacagccccagctggtgtggcggcctggtgcagggcaaccccaacggcagccccaaccggctgctgaaggccggggtcatcagcgcccagaacatctacagctttggatttgggaagttctacctgaccggggccacccagatggcctacctgggcagcctgcccgtcatcggggagaaggaggtgatccaggctgatgatgagcccaccttctccttcttcagcggcccctacatggtgatgaccaacctggtgtggaatggcagccgggtgacagtgaaggagctgaacctgcccacccacccccactgcagccggctgcggctggccgacctgctgattgctgagcaggagcacagcagcaagctgcggcacccctacctgctgcagctgatggctgtgtgcctgagccaggacctggagaagacccggctggtgtatgaaagaatcaccatcggcaccctcttctctgtgctgcatgaaagaagaagccagtttcctgtgctgcacatggaggtgattgtgcacctgctgctgcagatcagtgatgccctgcgctacctgcacttccagggcttcatccacaggagcctgagcagctatgctgtgcacatcatcagccctggagaggcccggctgaccaacctggagtacatgctggagagcgaggacagaggagtgcagagggacctgaccagggtgcccctgcccacccagctgtacaactgggccgcccctgaggtgatcctgcagaaggccgccaccgtgaagagtgacatctacagcttctccatgatcatgcaggagatcctgacagatgacatcccctggaagggcctggatggctctgtggtgaagaaggctgtggtgtctggcaactacctggaggctgatgtgcggctgcccaagccctactatgacatcgtgaagagcggcatccacgtgaagcagaaggacaggaccatgaacctgcaggacatccgctacatcctgaagaatgacctgaaggacttcaccggggcccagaggacccagcccacagagagcccccgggtgcagagatatggcctgcacccagatgtgaatgtgtacctgggcctgaccagcgagcacccccgggagaccccagacatggagatcatcgagctgaaggagatgggcagccagccccacagcccccgggtgcacagcctcttcacagagggcaccctggacccccaggccccagacccctgcctgatggcccgggagacccagaaccaggatgccccctgcccagcccccttcatggccgaggaggccagcagccccagcacaggccagcccagcctgtgcagctttgagatcaatgagatctacagcggctgcctgatcctggaggatgacatcgaggagcccccaggggccgccagcagcctggaggctgatggccccaaccaggtggatgagctgaagtccatggaggaggagctggacaagatggagcgggaggcctgctgcttcggctctgaagatgagagcagcagcaaggccgagacagagtacagctttgatgactgggactggcagaatggcagcctgagcagcctgagcctgcctgagagcacccgggaggccaagagcaacctgaacaacatgagcaccacagaggagtacctgatcagcaaatgtgtgctggacctgaagatcatgcagaccatcatgcatgaaaatgatgaccggctgagaaatattgagcagatcctggatgaggtggagatgaagcagaaggagcaggaggagaggatgagcctgtgggccaccagccgggagttcaccaatgcctacaagctgcccctggccgtgggcccccccagcctgaactacatcccccctgtgctgcagctgagcggcggccagaagccagacaccagcggcaactaccccaccctgccccgcttccccaggatgctgcccaccctgtgtgaccccgggaagcagaacacagatgagcagttccagtgcacccagggcgccaaggacagcctggagaccagccgcatccagaacaccagcagccagggccggccccgggagagcacagcccaggccaaggccacccagttcaacagcgccctcttcaccctgagcagccaccggcagggccccagcgccagccccagctgccactgggacagcaccaggatgtctgtggagcctgtgtcctctgagatctacaatgctgagagcaggaacaaggatgatggcaaggtgcacctgaagtggaagatggaggtgaaggagatggccaagaaggccgccaccggccagctgactgtgcccccctggcacccccagagcagcctgaccctggagagcgaggccgagaatgaaccagatgccctgctgcagccccccatccgcagcccagaaaatacagactggcagagggtgattgagtaccaccgggagaatgatgagcccagaggaaatggcaagtttgacaagacaggcaacaatgactgtgacagcgaccagcacggccggcagccccggctgggcagcttcaccagcatccgccaccccagcccccggcagaaggagcagcctgagcacagcgaggccttccaggccagcagtgacaccctggtggccgtggagaagagctacagccaccagagcatgcagagcacctgcagccctgagagcagcgaggacatcacagatgagttcctgaccccagatggagagtacttctacagcagcacagcccaggagaacctggccctggagaccagcagccccatcgaggaggactttgagggcatccagggcgcctttgcccagccccaggtgtctggagaggagaagttccagatgaggaagatcctgggcaagaatgctgagatcctgcccaggagccagttccagcctgtgcgcagcacagaagatgagcaggaggagaccagcaaggagagccccaaggagctgaaggagaaggacatcagcctgacagacatccaggacctgagcagcatctcctatgagccagacagcagcttcaaggaggccagctgcaagacccccaagatcaaccacgcccccacctctgtgtccacccccctgagccctggctctgtgtcctctgctgccagccagtacaaggactgcctggagagcatcaccttccaggtgaagacagaatttgccagctgctggaacagccaggagttcatccagaccctgagtgatgacttcatctctgtgcgggagcgggccaagaagctggacagcctgctgaccagcagcgagaccccacccagccggctgaccggcctgaagaggctgagcagcttcatcggggccggcagccccagcctggtgaaggcctgtgacagcagcccccctcatgccacccagaggaggagcctgcccaaggtggaggccttcagccagcaccacattgatgagctgcccccacccagccaggagctgctggatgacatcgagctgctgaagcagcagcagggcagcagcacagtgctgcacgagaacacagccagtgatggcggcggcacagccaatgaccagaggcacctggaggagcaggagacagacagcaagaaggaggacagctccatgctgctgagcaaggagacagaggacctgggggaggacacagagcgggcccacagcaccctggatgaggacctggagcgctggctgcagcccccagaggagagcgtggagctgcaggacctgcccaagggcagcgagcgggagaccaacatcaaggaccagaaggtgggggaggagaagaggaagagagaagattccatcaccccagagaggaggaagtcagaaggagtgctgggcaccagcgaggaggatgagctgaagagctgcttctggaagaggctgggctggagcgagagcagccgcatcatcgtgctggaccagagcgacctgagtgactag

SEQ ID NO: 172993 - DNA, 8370 bp, Artificial Sequence
  Description of Artificial Sequence: Synthetic coding sequence
atgcccagtgatgccaaggacagcgtgaatggagacctgctgctgaactggaccagcctgaagaacatcctgagcggcctgaatgccagcttccccctgcacaacaacacaggcagcagcacagtgaccaccagcaagagcatcaaggacccccggctgatgagaagagaggagagcatgggagagcagagcagcacagctggcctgaatgaggtgctgcagtttgagaagagcagtgacaacgtgaacagcgagatcaagagcacccccagcaacagcgccagcagcagcgaggtggtgcctggggactgtgctgtgctgaccaacggcctggacaccccctgcttcaagacctctgtgaatgacagccagagctgggcccacaacatgggctctgaagattatgactgcatcccccccaacaaggtgaccatggccggccagtgcaaggaccagggcaacttctccttccccatctctgtgtccaatgtggtgtctgaggtggagaaccagaaccacagcgaggagaaggcccagagggcccagcaggagagcggaaatgcctacaccaaggagtacagcagccacatcttccaggacagccagagcagtgacctgaagaccatctaccagacaggctgccagaccagcaccgtcttccccctgaagaagaaggtgtccattgatgagtacctgcagaacacaggcaagatgaagaactttgctgacctggaggacagcagcaagcatgaggagaagcagacctcctggaaggagattgacaatgacttcaccaatgagaccaagatcagccccatcgacaactacatcgtgctgcaccaggagtacaaggagagcgagagccacaacagctttgggaagagctgtgacaagatcctgatcacccaggagctggagatcaccaagagcagcaccagcaccatcaaggacaaggatgagctggaccacctggccctggagtggcagatcacccccagctttgagagcctgagccagaagcacccccagcacagcgtggagtatgagggcaacatccacaccagcctggccatcgcccagaagctgatggagctgaagctgggcaagatcaaccagaactatgccagcatcatcacagaggccttccccaagcccaaggacatcccccaggccaaggagatgttcatcgacaccgtcatcagcagctacaacattgaaacagcccatgacagcagcaactgcagcatcacccgggagcacatctgtgtgcacaggaagaatgaaaatgaacctgtgtccctggagaacatccagagggactacaaggagacagcctacgtggaggaccggggccaggaccacaacctcttctgcaacagccagctgagcaatgacatctggctgaatgtgaacttcaagaagcagacagaccgggagaaccagaatgaggccaaggagaacagcgccagctgtgtggagaacaacatcgagaacatctacggggacaagaagcaggacagccacaccaatgaaaacttcagcaacattgatgagaaggaggacaagaactaccacaacatcgagatcctgagcagcgaggagttcagcaccaagttcaacctgatctgcagagaagataatgctgtgtctgctgccacagccctgctggagagcgaggaggacaccatctctgctgtgaagcagaaggacacagagaacacaggccgctctgtggagcacctggccagcaccaccttccccaagacagccagcagctctgtgtgtgtggccagcaatgctgccatccagatcgccagcgccaccatgcctgccctgagcctgaacaatgatgaccaccagatctaccagttcaaggagacctgcagcagcgagagcccagactttggcctgctggtgaagcaccgggtgtctgactgtgaaattgacacagacaagaacaagagccaggagagcttccaccagagcatcaatgaaaacctggtgctgcagagcattgagctggagagcgagattgaaattgagctggaggactgtgatgatgccttcatcttccagcaggacacccacagccatgagaacatgctgtgtgaggagtttgtgaccagctacaaggccctgaagagccgcatctcctgggagggcctgctggccctggacaatggagagatggaggtgctggagagcaccaccggccgggagaacagcgaccagcactacagcaaggagagcaactacttctacagcagcacccagaacaatgaaacagagctgaccagccccatcctgctgcctgacctgcagatcaagatcaccaacatcttccggcccggcttcagccccacagctgacagcctggccctgaaggacagcttctgcacccacgtgacagaggccaccaagccagagatcaacaaggaggatggagagatcctgggctttgacatctacagccagccctttggagaaaatgctgactacccctgtgaggacaaggtggacaacatccggcaggagagcggccctgtgagcaacagcgagatcagcctgagctttgacctgagcaggaacacagatgtgaaccacaccagcgagaaccagaacagcgagagcctcttcacagagcccagcaatgtgaccaccattgatgatggcagccgctgcttcttcaccaagagcaagacagactacaatgacaccaagaacaagaaggaggtggagagccgcatcagcaagaggaagctgcacatcagcagccgggaccagaacatcccccacaaggacctgcggcggcacaagatctacggcaggaagaggcggctgaccagccaggacagcagcgagtgcttcagcagcctgagccagggccgcatcaagaccttcagccagagcgagaagcacatcaagtctgtgctgaacatcctgagtgatgaggccagcctgtgcaagagcaagtgcctgagcaggaagctggacaaggctgtggtgcacctgaagaaggcccacagaagagtgcacaccagcctgcagctgatcaccaaggtgggggaggagaggaagggccccctgcccaagagctatgccatcatctgcaacaacttctgggagagctgtgacctgcagggctacagctctgtgtcccagaggaagtactacagcaccaagcacttcagcagcaagaggaaatatgacaagaggaggaagaagagggcccccaaggctgacatcagcaagagcctgacccacgtgtccaagcacaagagctacaagaccagcggggagaagaagtgcctgagcaggaagtccatggccagctctgtgtccaagagccaccccaccaccagccacatgggagagttctgcaaccaggagcaccctgagagccagctgcctgtgagcagcaccagccagagcaccagccagagcgtgtactacaacagctctgtgagcaaccccagcctgtctgaggagcaccagcccttcagcggcaagacagcctacctgttctccccagaccacagtgatgagaagctgattgagaaggagaaccagattgacacagccttcctgagcagcaccagcaaatatgagaagctggagaagcacagcgccaaccacaacgtgaaggatgccaccaaggagaacagctgtgatgccaatgaggtgatcaatgaaagcaacagcgtgtccctgagctgcatcaaggagaacatcaacagcagcactggaaatgactgtgatgccacctgcatcggccacaccaaggccaagacagatgtgctgatctctgtgctggacagcaatgtgaagcacttcctgaatgacctgtaccagcagggcaacctgatcctgagtgactgcaagaggaacctggaggtgaagtggacagaccccatcgagcggcccaagcagaacatcatcaccggcaacttcctgatgggccccctgaacctgaccctgattgccagcaagaagtacagcatcccccagctgtctgctgctgctgtgacagattctgagggggagagcagcaagagctacctggacaagcagaggatcctgactgtggacagctttgctgccagcagcacagtgccccactgtgagcagagctgccgggagaaggagctgctgaagacagagcagtgcagcagcggcaactgcctgcacacagatggaaatgagaccaacgtgacagagaactatgagctggatgtggccagcggcacagaggaggacaagagctatggagagaacatcgtggagctgagcagcagtgacagcagcctgctgctgaaggacaacgtgaagggcagcagcagcgagacctgcatcgtgaagaaggacacagaagatcgcatcacctggaaggtgaagcaggccgagaaggccaaggacagcgtgtacaagaggtccatgacagagggcagcacagtgaacacagagtacaagaaccagaagaaccagatcagcgaggagagctgcctgaatgagaagatcatcaccaccaacctgattgacagccacctgagcaccaagaacaccaccacagaatctgtgcccctgaagaacacagtgagcaaccccctgaacaagcgggagaagaagggggagatcaaggtgtccaaggacagccagagcgacctgaccctgcacagcgagatcgcctacatcagcaagccaggcatcctgggcgtgaaccacacccccatcctgcctgcccacagcgagacctgcaaggtgcccaccctgctgaagaagccagccagctatgtgtctgacttcaaggagaagcactgcagcgccaaccacacagccctgattgccaacctgagccagatcctgcagagagcagatgaggccagcagcctgcagatcctgcaggaggagaccaaggtgtgcctgaacatcctgcccctgtttgtggaggcctttgagaggaagcaggagtgcagcgtggagcagatcctgatcagccgggagctgctggtggaccagaacctgtggaacaactgcaagcacaccctgaagccctgtgctgtggacaccctggtggagctgcagatgatgatggagaccatccagttcatcgagaacaagaagaggcacctggagggggagcccaccctgcggagcctgctgtggtatgatgagaccctgtatgcagagctgctgggcaagccccggggcttccagcagcagagcaacttctacccaggcttccagggccgcctgaagtacaatgccttctgtgagctgcagacctaccatgaccagctggtggagctgctggaggagaccaagcgggagaagaacagctactacgtgttcctgaagtacaagaggcaggtgaatgaatgtgaggccatcatggagcactgcagcgactgctttgacttcagcctgtctgtgcccttcacctgtggggtgaactttggagacagcctggaggacctggagatcctgaggaagagcaccctgaagctgatcaacgtgtgtggggacagccccaaggtgcacagctacccaggcaagcaggaccacctgtggatcatcatcgagatgatcagcagcaaggtgaacttcatcaagaacaatgaggccgtgcgggtgaagatcagcctgtatggcctggagcacatcttctttgatgctgccaagaacctggtgtggaaggagaggacccagagcttcagcaagaagtacagccagaagaaggatgaggagcggctgctgcgggtgaacaagtgtgccttcagcaagctgcagaagatctatgacaccctgagcaaggacctgaacaatgagcccatcagccccatcggcctggaggaggacaccatcatcgccagcaggaagagtgaccaccccatcaatgaggccaccatcagcattgagaacagcaagttcaacagcaacctgctggcccacccagacatctgctgcatcagcgagatcctggaccaggccgagtttgctgacctgaagaagctgcaggacctgaccctgcgctgcacagaccacctggagatcctgaagaagtacttccagatgctgcaggacaacaacatggacaacatcttcatcacagaggagaatgtgctggatgtggtgatcaaccacagccatgaggccatcatcctgaagccagaggccatcgagatgtacattgaaattgtgatggtgtctgagaccatccacttcctgaagaacagcatcgccaagaagctggacaagcagcgcttccggggcatgctgtggtttgacctgagcctgctgcctgagctggtgcagtgccaggagaagatggccagcttctccttcctgaaggacaacagcacagatgtgtgcctgtggaaggtgattgaaacagctgtgtctgagctgaagaaggacctggacatcatctgcaagtacaatgaggccgtgaactgcagctatgccatccacctgctgagccgggagctgcaggagctgtctgagatcaagaagctgctgaagaagagcaagtacttcatcagcacctacatcgactttgtgccctacatcgccagcatcaactacggcagcacagtgacagagctggagtacaactacaaccagttcagcaccctgctgaagaatgtgatgtctgcccccaggaaggacctgggcaagatggcccacatcaggaaggtgatgaagaccatcgagcacatgaagatgatctgcaccaagaatgctgagctgaccatctccttcttcctgtgccagatgctgtacaacagaaggaagatcctgcagctgaagaggaaggagaagatgaacatccacatcgtgaagccaggagagaacaacaacaagttcagcatcagcaccatgctgccccctgtgtctgagtgcatcaacaagaacatcagcaacagcagcaagaagaggcccagcacagtggacaagtgtgaggacagccaggagcagcagcaggacaccaccgtgagcagctgcaagaagctgaaggtggacatgaaggatgtgaccaagatcaaccgggagaaggccaccttcaagcaccccaggaccaccggcagccaccccaagtctgagaacaagatcgtgcccagcagctgtgacagcctgaagaggaaccacctgacccccaagaaggtggagatgcagaggagcctgcccggcagcctgctgcccctggagaaccccaaggacacctgtgccagcaagtctgagagcaagattgacctgactgtgtccagtgaccacttcagcggccagcaggagaacctgaacagcatgaagaagagaaatgtgaacttctctgctgctgagaccaagagtgacaagaaggactgtgccgcctttgccatctgtgaccagaagtctgtgcacggcaccttctccccagaccacggcaccctgctgcagaagttcctgaagaacagcccagaccccacccagaagagctgcctgagtgacatcaaccctgagacagatgtgtccctggtgcctgatgcctctgtgctgagcaagcccatcttctgctttgtgaaggatgtgcacccagacctggagatgaatgacacagtgtttgagctgcaggacaatgacatcgtgaacagcagcatcaagaacagcagctgcatgaccagccctgagcccatctgcatccagaacaagatccccaccctgcagatcaacaagctgcagcccacagaaacagaaagtgaggacaagtacatgaaggacaccctgaaccccaacacagtgcacacctttggagccagcggccacatcaccctgaatgtgaaccagggcgctgagtacagcctgtctgagcagcagaatgacaagaacagcaaggtgctgatgcagaatgctgccacctactggaatgagctgccccagagcgcctgcaaccccacctacaacagcagcgagcacctgtttggcaccagctacccctacagcgcctggtgtgtgtaccagtacagcaacagcaatggaaatgccatcacccagacctaccagggcatcaccagctatgaggtgcagcccagccccagcggcctgctgaccaccgtggccagcacagcccagggcacccacagcaacctgctgtacagccagtacttcacctactttgctggggagccccaggccaacggctttgtgcctgtgaatggctacttccagagccagatcccagccagcaacttccggcagcccatcttcagccagtatgccagccaccagcccctgccccaggccacctacccctacctgcccaacagatttgtgcccccagaggtgccctgggtgtatgccccctggcaccaggagagcttccaccctggccactag

SEQ ID NO: 172994 - DNA, 1233 bp, Artificial Sequence
  Description of Artificial Sequence: Synthetic coding sequence
atggtgctgaaggccgagcacaccaggagccccagcgccaccctgcccagcaatgtgcccagctgccgcagcctgagcagcagtgaagatggccccagcggccccagcagcctggctgatggcggcctggcccacaacctgcaggacagcgtgcgccaccgcatcctgtacctgtctgagcagctgcgggtggagaaggccagcagagatggcaacacagtgtcctacctgaagctggtgtccaaggctgacagacaccaggtgccccacatccagcaggcctttgagaaggtgaaccagagggccagcgccaccatcgcccagatcgagcaccggctgcaccagtgccaccagcagctgcaggagctggaggagggctgcaggcctgagggcctgctgctgatggccgagagtgaccctgccaactgtgagcccccatctgagaaggccctgctgtctgagcccccagagcctggaggagaagatggccctgtgaacctgccccacgccagccggcccttcatcctggagagccgcttccagagcctgcagcagggcacctgcctggagacagaagatgtggcccagcagcagaacctgctgctgcagaaggtgaaggccgagctggaggaggccaagcgcttccacatcagcctgcaggagagctaccacagcctgaaggagaggagcctgacagacctgcagctgctgctggagagcctgcaggaggagaagtgccggcaggccctgatggaggagcaggtgaatggccgcctgcagggccagctgaatgagatctacaacctgaagcacaacctggcctgcagcgaggagaggatggcctacctgtcctatgagcgggccaaggagatctgggagatcacagagaccttcaagagccgcatcagcaagctggagatgctgcagcaggtgacccagctggaggccgctgagcacctgcagagccggcccccccagatgctgttcaagttcctgagcccccggctgagcctggccaccgtgctgctggtgtttgtgtccaccctgtgtgcctgccccagcagcctcatcagcagccggctgtgcacctgcaccatgctgatgctgattggcctgggcgtgctggcctggcagcgctggagggccatcccagccacagactggcaggagtgggtgcccagccgctgccgcctgtacagcaaggacagcggccccccagcagatggcccctag

SEQ ID NO: 172995 - DNA, 1233 bp, Artificial Sequence; identical to SEQ ID NO: 172994
  Description of Artificial Sequence: Synthetic coding sequence

SEQ ID NO: 172996 - DNA, 945 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggtggaggtggtggccgaggaggagggcctggtggagcggcgggaggaggcccagagggcccagcaggccgtgcccggccctggccccatgaccccagagagcgcccctgaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtgggggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 172997 - DNA, 927 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgcccctgaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtgggggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 172998 - DNA, 2097 bp, Artificial Sequence
  Description of Artificial Sequence: Synthetic coding sequence
atgatgaggagccgcagcaagagcccccggcggcccagccccacagcccggggggccaactgtgatgtggagctgctgaagaccaccacccgggaccgggaggagctgaagtgcatgctggagaagtatgagcggcacctggccgagatccagggcaatgtgaaggtgctgaagtctgagcgggacaagatcttcctgctgtatgagcaggcccaggaggagatcacccggctgcggcgggagatgatgaagagctgcaagagccccaagagcaccacagcccacgccatcctgcggcgggtggagacagaaagagatgtggccttcacagacctgcggaggatgaccacagagcgggacagcctgcgggagcggctgaagatcgcccaggagacagccttcaatgagaaggcccacctggagcagagaattgaggagctggagtgcaccgtgcacaacctggatgatgagaggatggagcagatgagcaacatgaccctgatgaaggagaccatcagcacagtggagaaggagatgaagagcctggccaggaaggccatggacacagaaagtgagctgggccggcagaaggccgagaacaacagcctgcggctgctgtatgagaacacagagaaggacctgagtgacacccagaggcacctggccaagaagaagtatgagctgcagctgacccaggagaagatcatgtgcctggatgagaagattgacaacttcacccggcagaacatcgcccagcgggaggagatcagcatcctgggcggcaccctgaatgacctggccaaggagaaggaatgtctgcaggcctgcctggacaagaagtctgagaacatcgccagcctgggggagagcctggccatgaaggagaagaccatcagcggcatgaagaacatcatcgccgagatggagcaggccagccggcagtgcacagaggccctgattgtgtgtgagcaggatgtgtccaggatgaggcggcagctggatgagaccaatgatgagctggcccagatcgcccgggagcgggacatcctggcccatgacaatgacaacctgcaggagcagtttgccaaggccaagcaggagaaccaggccctgagcaagaagctgaatgacacccacaatgagctgaatgacatcaagcagaaggtgcaggacaccaacctggaggtgaacaagctgaagaacatcctgaagtctgaggagagtgaaaatcggcagatgatggagcagctgaggaaggccaatgaagatgctgagaactgggagaacaaggcccggcagagcgaggccgacaacaacaccctgaagctggagctgatcacagctgaggccgagggcaaccggctgaaggagaaggtggacagcctgaaccgggaggtggagcagcacctgaatgctgagaggagctacaagagccagatcagcaccctgcacaagtctgtggtgaagatggaggaggagctgcagaaggtgcagtttgagaaggtgtctgccctggccgacctgagcagcacccgggagctgtgcatcaagctggacagcagcaaggagctgctgaaccggcagctggtggccaaggaccaggagattgagatgagagaaaatgagctggacagcgcccacagcgagattgagctgctgcggagccagatggccaatgaaagaatctccatgcagaacctggaggccctgctggtggccaacagagacaaggagtaccagagccagatcgccctgcaggagaaggagagcgagatccagctgctgaaggagcacctgtgcctggccgagaacaagatggccatccagagcagagatgtggcccagttcagaaatgtggtgacccagctggaggccgacctggacatcaccaagaggcagctgggcacagaaagatttgagcgggagagagctgtgcaggagctgcggcggcagaactacagcagcaatgcctaccacatgagcagcaccatgaagcccaacaccaagtgccacagccctgagcgggcccaccacaggagcccagaccggggcctggacaggagcctggaggagaacctgtgctacagagacttctag

SEQ ID NO: 172999 - DNA, 2073 bp, Artificial Sequence
  Description of Artificial Sequence: Synthetic coding sequence
atgatgaggagccgcagcaagagcccccggcggcccagccccacagcccggggggccaactgtgatgtggagctgctgaagaccaccacccgggaccgggaggagctgaagtgcatgctggagaagtatgagcggcacctggccgagatccagggcaatgtgaaggtgctgaagtctgagcgggacaagatcttcctgctgtatgagcaggcccaggaggagatcacccggctgcggcgggagatgatgaagagctgcaagagccccaagagcaccacagcccacgccatcctgcggcgggtggagacagaaagagatgtggccttcacagacctgcggaggatgaccacagagcgggacagcctgcgggagcggctgaagatcgcccaggagacagccttcaatgagaaggcccacctggagcagagaattgaggagctggagtgcaccgtgcacaacctggatgatgagaggatggagcagatgagcaacatgaccctgatgaaggagaccatcagcacagtggagaaggagatgaagagcctggccaggaaggccatggacacagaaagtgagctgggccggcagaaggccgagaacaacagcctgcggctgctgtatgagaacacagagaaggacctgagtgacacccagaggcacctggccaagaagaagtatgagctgcagctgacccaggagaagatcatgtgcctggatgagaagattgacaacttcacccggcagaacatcgcccagcgggaggagatcagcatcctgggcggcaccctgaatgacctggccaaggagaaggaatgtctgcaggcctgcctggacaagaagtctgagaacatcgccagcctgggggagagcctggccatgaaggagaagaccatcagcggcatgaagaacatcatcgccgagatggagcaggccagccggcagtgcacagaggccctgattgtgtgtgagcaggatgtgtccaggatgaggcggcagctggatgagaccaatgatgagctggcccagatcgcccgggagcgggacatcctggcccatgacaatgacaacctgcaggagcagtttgccaaggccaagcaggagaaccaggccctgagcaagaagctgaatgacacccacaatgagctgaatgacatcaagcagaaggtgcaggacaccaacctggaggtgaacaagctgaagaacatcctgaagtctgaggagagtgaaaatcggcagatgatggagcagctgaggaaggccaatgaagatgctgagaactgggagaacaaggcccggcagagcgaggccgacaacaacaccctgaagctggagctgatcacagctgaggccgagggcaaccggctgaaggagaaggtggacagcctgaaccgggaggtggagcagcacctgaatgctgagaggagctacaagagccagatcagcaccctgcacaagtctgtggtgaagatggaggaggagctgcagaaggtgcagtttgagaaggtgtctgccctggccgacctgagcagcacccgggagctgtgcatcaagctggacagcagcaaggagctgctgaaccggcagctggtggccaaggaccaggagattgagatgagagaaaatgagctggacagcgcccacagcgagattgagctgctgcggagccagatggccaatgaaagaatctccatgcagaacctggaggccctgctggtggccaacagagacaaggagtaccagagccagatcgccctgcaggagaaggagagcgagatccagctgctgaaggagcacctgtgcctggccgagaacaagatggccatccagagcagagatgtggcccagttcagaaatgtggtgacccagctggaggccgacctggacatcaccaagaggcagctgggcacagaaagatttgagcgggagagagctgtgcaggagctgcggcggcagaactacagcagcaatgcctaccacatgagcagcaccatgaagcccaacaccaagtgccacagccctgagcgggcccaccacaggagcccagaccggggcctggacaggagcctggagtag

SEQ ID NO: 173000 - DNA, 2097 bp, Artificial Sequence; identical to SEQ ID NO: 172998
  Description of Artificial Sequence: Synthetic coding sequence

SEQ ID NO: 173001 - DNA, 2097 bp, Artificial Sequence; identical to SEQ ID NO: 172998
  Description of Artificial Sequence: Synthetic coding sequence

SEQ ID NO: 173002 - DNA, 2097 bp, Artificial Sequence; identical to SEQ ID NO: 172998
  Description of Artificial Sequence: Synthetic coding sequence

SEQ ID NO: 173003 - DNA, 894 bp, Artificial Sequence
  Description of Artificial Sequence: Synthetic coding sequence
atgatgaggagccgcagcaagagcccccggcggcccagccccacagcccggggggccaactgtgatgtggagctgctgaagaccaccacccgggaccgggaggagctgaagtgcatgctggagaagtatgagcggcacctggccgagatccagggcaatgtgaaggtgctgaagtctgagcgggacaagatcttcctgctgtatgagcaggcccaggaggagatcacccggctgcggcgggagatgatgaagagctgcaagagccccaagagcaccacagcccacgccatcctgcggcgggtggagacagaaagagatgtggccttcacagacctgcggaggatgaccacagagcgggacagcctgcgggagcggctgaagatcgcccaggagacagccttcaatgagaaggcccacctggagcagagaattgaggagctggagtgcaccgtgcacaacctggatgatgagaggatggagcagatgagcaacatgaccctgatgaaggagaccatcagcacagtggagaaggagatgaagagcctggccaggaaggccatggacacagaaagtgagctgggccggcagaaggccgagaacaacagcctgcggctgctgtatgagaacacagagaaggacctgagtgacacccagaggcacctggccaagaagaagtatgagctgcagctgacccaggagaagatcatgtgcctggatgagaagattgacaacttcacccggcagaacatcgcccagcgggaggagatcagcatcctgggcggcaccctgaatgacctggccaaggagaaggaatgtctgcaggcctgcctggacaagaagtctgagaacatcgccagcctgggggagagcctggccatgaagacagtgtactag

SEQ ID NO: 173004 - DNA, 1881 bp, Artificial Sequence
  Description of Artificial Sequence: Synthetic coding sequence
atggccggggagcggccccccctgcggggccctggccctggccctggagaggtgcctggagagggccccccaggccctgggggcactggaggcggccctggccggggccggcccagcagctaccgggccctgcggtctgctgtgagcagcctggcccgggtggatgacttccactgtgccgagaagattggagctggcttcttcagcgaggtgtacaaggtgcgccaccggcagagcggccaggtgatggtgctgaagatgaacaagctgcccagcaacagaggcaacaccctgcgggaggtgcagctgatgaaccggctgcggcaccccaacatcctgcgcttcatgggcgtgtgtgtgcaccagggccagctgcacgccctgacagagtacatgaatggaggcaccctggagcagctgctgagcagccctgagcccctgtcctggcctgtgcggctgcacctggccctggacatcgcccggggcctgcgctacctgcacagcaaaggagtcttccaccgggacctgaccagcaagaactgcctggtgcggcgggaggaccggggcttcaccgctgtggtgggggactttggcctggccgagaagatccctgtgtaccgggagggcgccaggaaggagcccctggccgtggtgggcagcccctactggatggcccctgaggtgctgcggggggagctgtatgatgagaaggcagatgtgtttgcctttggaattgtgctgtgtgagctgattgcccgggtgcctgctgaccctgactacctgcccaggacagaagattttggcctggatgtgcctgccttccgcaccctggtgggagatgactgccccctgcccttcctgctgctggccatccactgctgcaacctggagcccagcacccgggcccccttcacagagatcacccagcacctggagtggatcctggagcagctgcctgagcccgcccccctgaccaggacagccctgacccacaaccagggctctgtggcccggggcggccccagcgccaccctgcccaggccagacccccggctgagccgcagcagaagtgacctcttcctgccccccagccctgagagcccccccaactggggagacaacctgaccagggtgaaccccttcagcctgcgggaggacctgcggggcggcaagatcaagctgctggacacccccagcaagcctgtgctgcccctggtgccccccagccccttccccagcacccagctgcccctggtgaccaccccagagaccctggtgcagcccggcaccccagcccggcgctgccgcagcctgcccagcagccctgagctgcccaggaggatggagacagccctgcccggccctggccccccagctgtgggccccagcgctgaggagaagatggagtgtgagggcagcagccctgagcctgagcccccaggccctgccccccagctgcccctggccgtggccacagacaacttcatcagcacctgcagcagcgccagccagccctggagccccaggagcggccctgtgctgaacaacaaccccccagctgtggtggtgaacagcccccagggctgggccggggagccctggaacagagcccagcacagcctgcccagggctgctgccctggagaggacagagcccagccccccaccttctgccccccgggagccagatgagggcctgccctgccccggctgctgcctgggccccttctcctttggcttcctgtccatgtgcccccggcccaccccagctgtggcccgctacagaaacctgaactgtgaggccggcagcctgctgtgccaccggggccaccacgccaagccacccacccccagcctgcagctgcccggggcccggagctag

SEQ ID NO: 173005 - DNA, 474 bp, Artificial Sequence
  Description of Artificial Sequence: Synthetic coding sequence
tctgcccgggctgctgccctgagcaggaacctgcagggccagaggcccctgcccctggccgtggccacagacaacttcatcagcacctgcagcagcgccagccagccctggagccccaggagcggccctgtgctgaacaacaaccccccagctgtggtggtgaacagcccccagggctgggccggggagccctggaacagagcccagcacagcctgcccagggctgctgccctggagaggacagagcccagccccccacccagcgccccccgggagccagatgagggcctgccctgccccggctgctgcctgggccccttctcctttggcttcctgtccatgtgcccccggcccaccccagctgtggcccgctacagaaacctgaactgtgaggccggcagcctgctgtgccaccggggccaccacgccaagccacccacccccagcctgcagctgcccggggcccggagctag

SEQ ID NO: 173006 - DNA, 1077 bp, Artificial Sequence
  Description of Artificial Sequence: Synthetic coding sequence
atggatgatgccaccgtgctgaggaagaagggctacatcgtgggcatcaacctgggcaagggcagctatgccaaggtgaagagcgcctacagcgagcggctgaagttcaacgtggccgtgaagatcatcgacaggaagaagacccccacagactttgtggagcgcttcctgccccgggagatggacatcctggccaccgtgaaccacggcagcatcatcaagacctatgagatctttgagaccagtgatggccgcatctacatcatcatggagctgggcgtgcagggcgacctgctggagttcatcaagtgccagggcgccctgcatgaagatgtggccaggaagatgttccggcagctgagcagcgctgtgaagtactgccacgacctggacatcgtgcaccgggacctgaagtgtgagaacctgctgctggacaaggacttcaacatcaagctgagtgactttggcttcagcaagcgctgcctgcgggacagcaatggccgcatcatcctgagcaagaccttctgtggcagcgctgcctatgctgcccctgaggtgctgcagagcatcccctaccagcccaaggtgtatgacatctggagcctgggcgtcatcctgtacatcatggtgtgtggctccatgccctatgatgacagcgacatcaggaagatgctgcgcatccagaaggagcaccgggtggacttccccaggagcaagaacctgacctgtgagtgcaaggacctgatctacaggatgctgcagccagatgtgtcccagaggctgcacattgatgagatcctgagccacagctggctgcagccccccaagcccaaggccaccagcagcgccagcttcaagcgggagggggagggcaagtacagagctgagtgcaagctggacaccaagacaggcctgcggccagaccacaggccagaccacaagctgggcgccaagacccagcaccggctgctggtggtgcctgaaaatgaaaataggatggaggaccggctggccgagaccagccgggccaaggaccaccacatctctggagctgaggtgggcaaggccagcacctag

SEQ ID NO: 173007 - DNA, 807 bp, Artificial Sequence
  Description of Artificial Sequence: Synthetic coding sequence
atggaggacttcctgctgagcaatggctaccagctgggcaagaccatcggggagggcacctacagcaaggtgaaggaggccttcagcaagaagcaccagaggaaggtggccatcaaggtgattgacaagatgggcggccctgaggagttcatccagcgcttcctgccccgggagctgcagatcgtgaggaccctggaccacaagaacatcatccaggtgtatgagatgctggagagcgcagatggcaagatctgcctggtgatggagctggccgagggcggagatgtgtttgactgtgtgctgaatggaggccccctgcctgagagccgggccaaggccctcttccggcagatggtggaggccatccgctactgccacggctgcggcgtggcccaccgggacctgaagtgtgaaaatgccctgctgcagggcttcaacctgaagctgacagactttggatttgccaaggtgctgcccaagagccaccgggagctgagccagaccttctgtggcagcacagcctatgctgcccctgaggtgctgcagggcatcccccatgacagcaagaagggagatgtgtggagcatgggcgtggtgctgtatgtgatgctgtgtgccagcctgccctttgatgacacagacatccccaagatgctgtggcagcagcagaagggcgtgtccttccccacccacctgagcatctctgctgactgccaggacctgctgaagaggctgctggagccagacatgatcctgcggcccagcattgaggaggtgtcctggcacccctggctggccagcacctag

SEQ ID NO: 173008 - DNA, 987 bp, Artificial Sequence
  Description of Artificial Sequence: Synthetic coding sequence
atgggcaaaggagatgtgctggaggccgcccccaccaccacagcctaccacagcctgatggatgaatatggctatgaggtgggcaaggccatcggccacggcagctatggctctgtgtatgaggccttctacaccaagcagaaggtgatggtggccgtgaagatcatcagcaagaagaaggccagtgatgactacctgaacaagttcctgccccgggagatccaggtgatgaaggtgctgcggcacaagtacctgatcaacttctaccgggccatcgagagcaccagccgggtgtacatcatcctggagctggcccagggcggagatgtgctggagtggatccagagatatggagcctgcagcgagcccctggccggcaagtggttcagccagctgaccctgggcatcgcctacctgcacagcaagagcatcgtgcaccgggacctgaagctggagaacctgctgctggacaagtgggagaatgtgaagatcagtgactttggatttgccaagatggtgcccagcaaccagcctgtgggctgcagccccagctaccggcaggtgaactgcttcagccacctgagccagacctactgcggcagctttgcctatgcctgcccagagatcctgcggggcctgccctacaaccccttcctgagtgacacctggagcatgggcgtcatcctgtacaccctggtggtggcccacctgccctttgatgacaccaacctgaagaagctgctgcgggagacccagaaggaggtgaccttccctgccaaccacaccatcagccaggagtgcaagaacctgatcctgcagatgctgcggcaggccaccaagagggccaccatcctggacatcatcaaggacagctgggtgctgaagttccagcctgagcagcccacccatgagatccggctgctggaggccatgtgccagctgcacaacaccaccaagcagcaccagagcctgcagatcaccacctag

SEQ ID NO: 173009 - DNA, 1017 bp, Artificial Sequence
  Description of Artificial Sequence: Synthetic coding sequence
atgggcaaaggagatgtgctggaggccgcccccaccaccacagcctaccacagcctgatggatgaatatggctatgaggtgggcaaggccatcggccacggcagctatggctctgtgtatgaggccttctacaccaagcagaaggtgatggtggccgtgaagatcatcagcaagaagaaggccagtgatgactacctgaacaagttcctgccccgggagatccaggtgatgaaggtgctgcggcacaagtacctgatcaacttctaccgggccatcgagagcaccagccgggtgtacatcatcctggagctggcccagggcggagatgtgctggagtggatccagagatatggagcctgcagcgagcccctggccggcaagtggttcagccagctgaccctgggcatcgcctacctgcacagcaagagcatcgtgcaccggctgatgcccagcctgtctgctgctggccgggacctgaagctggagaacctgctgctggacaagtgggagaatgtgaagatcagtgactttggatttgccaagatggtgcccagcaaccagcctgtgggctgcagccccagctaccggcaggtgaactgcttcagccacctgagccagacctactgcggcagctttgcctatgcctgcccagagatcctgcggggcctgccctacaaccccttcctgagtgacacctggagcatgggcgtcatcctgtacaccctggtggtggcccacctgccctttgatgacaccaacctgaagaagctgctgcgggagacccagaaggaggtgaccttccctgccaaccacaccatcagccaggagtgcaagaacctgatcctgcagatgctgcggcaggccaccaagagggccaccatcctggacatcatcaaggacagctgggtgctgaagttccagcctgagcagcccacccatgagatccggctgctggaggccatgtgccagctgcacaacaccaccaagcagcaccagagcctgcagatcaccacctag

SEQ ID NO: 173010 - DNA, 759 bp, Artificial Sequence
  Description of Artificial Sequence: Synthetic coding sequence
atgaaggtgctgcggcacaagtacctgatcaacttctaccgggccatcgagagcaccagccgggtgtacatcatcctggagctggcccagggcggagatgtgctggagtggatccagagatatggagcctgcagcgagcccctggccggcaagtggttcagccagctgaccctgggcatcgcctacctgcacagcaagagcatcgtgcaccgggacctgaagctggagaacctgctgctggacaagtgggagaatgtgaagatcagtgactttggatttgccaagatggtgcccagcaaccagcctgtgggctgcagccccagctaccggcaggtgaactgcttcagccacctgagccagacctactgcggcagctttgcctatgcctgcccagagatcctgcggggcctgccctacaaccccttcctgagtgacacctggagcatgggcgtcatcctgtacaccctggtggtggcccacctgccctttgatgacaccaacctgaagaagctgctgcgggagacccagaaggaggtgaccttccctgccaaccacaccatcagccaggagtgcaagaacctgatcctgcagatgctgcggcaggccaccaagagggccaccatcctggacatcatcaaggacagctgggtgctgaagttccagcctgagcagcccacccatgagatccggctgctggaggccatgtgccagctgcacaacaccaccaagcagcaccagagcctgcagatcaccacctag

SEQ ID NO: 173011 - DNA, 822 bp, Artificial Sequence
  Description of Artificial Sequence: Synthetic coding sequence
atgtctggggacaagctgctgtctgagctgggctacaagctgggccgcaccatcggggagggcagctacagcaaggtgaaggtggccaccagcaagaagtacaagggcaccgtggccatcaaggtggtggacagaagaagagcccccccagactttgtgaacaagttcctgccccgggagctgagcatcctgcggggcgtgcgccacccccacatcgtgcacgtgtttgagttcatcgaggtgtgcaatggcaagctgtacatcgtgatggaggccgccgccacagacctgctgcaggccgtgcagagaaatggccgcatccctggggtgcaggcccgggacctgtttgcccagattgctggagctgtgcgctacctgcatgaccaccacctggtgcaccgggacctgaagtgtgaaaatgtgctgctgagcccagatgagcggcgggtgaagctgacagactttggatttggccggcaggcccacggctacccagacctgagcaccacctactgcggcagcgctgcctatgccagccctgaggtgctgctgggcatcccctatgaccccaagaagtatgatgtgtggagcatgggcgtggtgctgtatgtgatggtgacaggctgcatgccctttgatgacagcgacattgctggcctgccccggcggcagaagaggggcgtgctgtacccagagggcctggagctgtctgagcgctgcaaggccctgattgctgagctgctgcagttcagccccagcgcccggcccagcgctggccaggtggccaggaactgctggctgcgggccggggacagcggctag

SEQ ID NO: 173012 - DNA, 822 bp, Artificial Sequence; identical to SEQ ID NO: 173011
  Description of Artificial Sequence: Synthetic coding sequence

SEQ ID NO: 173013 - DNA, 6411 bp, Artificial Sequence
  Description of Artificial Sequence: Synthetic coding sequence
atgagccgcagcagacatgcccggcccagccggctggtgaggaaggaggatgtgaacaagaagaagaagaacagccagctgaggaagaccaccaagggggccaacaagaatgtggcctctgtgaagaccctgagccctgggaagctgaagcagctgatccaggagagagatgtgaagaagaagacagagcccaagccccctgtgcctgtgcgcagcctgctgaccagggctggagctgccaggatgaacctggacagaacagaggtgctcttccagaaccctgagagcctgacctgcaatggcttcaccatggccctgcggagcaccagcctgagccggcggctgagccagccccccctggtggtggccaagagcaagaaggtgcccctgagcaagggcctggagaagcagcacgactgtgactacaagatcctgcctgccctgggcgtgaagcacagtgaaaatgattctgtgcccatgcaggacacccaggtgctgcctgacatcgagaccctgattggagtgcagaaccccagcctgctgaagggcaagagccaggagaccacccagttctggagccagagggtggaggacagcaagatcaacatccccacccacagcggccctgctgctgagatcctgcccggccccctggagggcacccgctgtggggagggcctcttcagcgaggagaccctgaatgacaccagcggcagccccaagatgtttgcccaggacacagtgtgtgcccccttcccccagagggccacccccaaggtgaccagccagggcaaccccagcatccagctggaggagctgggcagccgggtggagagcctgaagctgagtgacagctacctggaccccatcaagtcagaacatgactgctaccccaccagcagcctgaacaaggtgatcccagacctgaacctgaggaactgcctggccctgggcggcagcaccagccccaccagcgtcatcaagttcctgctggccggcagcaagcaggccaccctgggcgccaagccagaccaccaggaggcctttgaggccacagccaaccagcaggaggtgtctgacaccaccagcttcctgggccaggcctttggagccatcccccaccagtgggagctgcctggagctgaccctgtgcatggagaggccctgggggagaccccagacctgcctgagatccctggggccatccctgtgcagggcgaggtgtttggcaccatcctggaccagcaggagaccctgggcatgagcggctctgtggtgcctgacctgcccgtcttcctgcctgtgccccccaaccccatcgccaccttcaatgcccccagcaagtggccagagccccagagcacagtgtcctatggcctggccgtgcagggcgccatccagatcctgcccctgggcagcggccacaccccccagagcagcagcaacagcgagaagaacagcctgccccctgtgatggccatcagcaatgtggagaatgagaagcaggtgcacatctccttcctgcctgccaacacccagggcttccccctggcccctgagcggggcctcttccacgccagcctgggcatcgcccagctgagccaggccggccccagcaagagtgaccggggcagcagccaggtgtctgtgaccagcacagtgcacgtggtgaacaccaccgtggtgaccatgcctgtgcccatggtgtccaccagcagcagcagctacaccaccctgctgcccaccctggagaagaagaagaggaagagatgtggggtgtgtgagccctgccagcagaagaccaactgtggagaatgtacctactgcaagaacaggaagaacagccaccagatctgcaagaagaggaaatgtgaggagctgaagaagaagcccagcgtggtggtgcccctggaggtgatcaaggagaacaagaggccccagcgggagaagaagcccaaggtgctgaaggctgactttgacaacaagcctgtgaatggccccaagtctgagagcatggactacagccgctgtggccatggagaggagcagaagctggagctgaacccccacacagtggagaatgtgaccaagaatgaagattccatgactggaattgaggtggagaagtggacccagaacaagaagagccagctgacagaccacgtgaagggggacttcagcgccaacgtgcctgaggccgagaagagcaagaacagcgaggtggacaagaagaggaccaagagccccaagctgtttgtgcagacagtgagaaatggcatcaagcacgtgcactgcctgcctgctgagaccaacgtgtccttcaagaagttcaacatcgaggagtttgggaagaccctggagaacaacagctacaagttcctgaaggacacagccaaccacaagaatgccatgagctctgtggccacagacatgagctgtgaccacctgaagggccgcagcaatgtgctggtgttccagcagcccggcttcaactgcagcagcatcccccacagcagccacagcatcatcaaccaccacgccagcatccacaatgaaggagaccagcccaagaccccagagaacatccccagcaaggagcccaaggatggcagccctgtgcagcccagcctgctgagcctgatgaaggaccggcggctgaccctggagcaggtggtggccatcgaggccctgacccagctgtctgaggcccccagcgagaacagcagccccagcaagtctgagaaggatgaggagagcgagcagaggacagccagcctgctgaacagctgcaaggccatcctgtacacagtgaggaaggacctgcaggaccccaacctgcagggcgagccccccaagctgaaccactgccccagcctggagaagcagagcagctgcaacacagtggtgttcaacggccagaccaccaccctgagcaacagccacatcaacagcgccaccaaccaggccagcaccaagagccatgagtacagcaaggtgaccaacagcctgagcctcttcatccccaagagcaacagcagcaagattgacaccaacaagagcatcgcccagggcatcatcaccctggacaactgcagcaatgacctgcaccagctgcccccaagaaataatgaggtggagtactgcaaccagctgctggacagcagcaagaagctggacagtgatgacctgagctgccaggatgccacccacacccagattgaagaagatgtggccacccagctgacccagctggccagcatcatcaagatcaactacatcaagccagaggacaagaaggtggagagcacccccaccagcctggtgacctgcaatgtgcagcagaagtacaaccaggagaagggcaccatccagcagaagccacccagctctgtgcacaacaaccacggcagcagcctgaccaagcagaagaaccccacccagaagaagaccaagagcacccccagccgggacaggaggaagaagaagcccaccgtggtgtcctaccaggagaatgaccggcagaagtgggagaagctgagctacatgtatggcaccatctgtgacatctggatcgccagcaagttccagaactttggccagttctgcccccatgacttccccaccgtgtttgggaagatcagcagcagcaccaagatctggaagcccctggcccagaccaggagcatcatgcagcccaagacagtgtttcctcccctgacccagatcaagctgcagcgctacccagagagcgctgaggagaaggtgaaggtggagcccctggacagcctgagcctcttccacctgaagacagagagcaatggcaaggccttcacagacaaggcctacaacagccaggtgcagctgactgtgaatgccaaccagaaggcccaccccctgacccagcccagcagcccccccaaccagtgtgccaacgtgatggctggagatgaccagatccgcttccagcaggtggtgaaggagcagctgatgcaccagaggctgcccaccctgcccggcatcagccatgagacccccctgcctgagagcgccctgaccctgagaaatgtgaatgtggtgtgcagcggcggcatcaccgtggtgtccaccaagtctgaggaggaggtgtgcagcagcagctttggcaccagcgagttcagcacagtggacagcgcccagaagaacttcaatgactatgccatgaacttcttcaccaaccccaccaagaacctggtgtccatcaccaaggacagcgagctgcccacctgcagctgcctggacagagtcatccagaaggacaagggcccctactacacccacctgggcgccggccccagcgtggccgctgtgcgggagatcatggagaacagatatggccagaagggaaatgccatccgcatcgagatcgtggtgtacaccgggaaggagggcaagagcagccacggctgccccatcgccaagtgggtgctgcggcgcagcagtgatgaggagaaggtgctgtgcctggtgcggcagaggacaggccaccactgccccacagctgtgatggtggtgctgatcatggtgtgggatggcatccccctgcccatggctgaccggctgtacacagagctgacagagaacctgaagagctacaacggccaccccacagaccggcgctgcaccctgaatgaaaatagaacctgcacctgccagggcatcgaccctgagacctgtggggccagcttctcctttggctgctcctggagcatgtacttcaacggctgcaagtttggccgcagccccagcccccggcgcttcagaattgaccccagcagccccctgcacgagaagaacctggaggacaacctgcagagcctggccacccggctggcccccatctacaagcagtatgcccctgtggcctaccagaaccaggtggagtatgaaaatgtggccagagaatgtcggctgggcagcaaggagggccggcccttctctggagtgacagcctgcctggacttctgtgcccacccccaccgggacatccacaacatgaacaacggcagcacagtggtgtgcaccctgacccgggaggacaacagaagcctgggcgtcatcccccaggatgagcagctgcacgtgctgcccctgtacaagctgagtgacacagatgaatttggcagcaaggagggcatggaggccaagatcaagagcggggccatcgaggtgctggcccccaggaggaagaagaggacctgcttcacccagcctgtgcccaggtctgggaagaagagagctgccatgatgacagaggtgctggcccacaagatccgggctgtggagaagaagcccatcccccgcatcaagaggaagaacaacagcaccaccaccaacaacagcaagcccagcagcctgcccaccctgggcagcaacacagaaacagtgcagcctgaggtgaagtcagaaacagagccccacttcatcctgaagagcagtgacaacaccaagacctacagcctgatgcccagcgccccccaccctgtgaaggaggccagccctggcttctcctggagccccaagacagccagcgccaccccagcccccctgaagaatgatgccacagccagctgtggcttcagcgagaggagcagcaccccccactgcaccatgcccagcggccgcctgagcggggccaatgctgctgctgctgatggccctggcatcagccagctgggggaggtggcccccctgcccaccctgagcgcccctgtgatggagcccctcatcaacagcgagcccagcactggagtgacagagcccctgaccccccaccagcccaaccaccagcccagcttcctgaccagcccccaggacctggccagcagccccatggaggaggatgagcagcacagcgaggctgatgagcccccatctgatgagcccctgagtgatgaccccctgagccctgctgaggagaagctgccccacattgatgagtactggagcgacagcgagcacatcttcctggatgccaacatcggcggcgtggccatcgccccagcccacggctctgtgctgattgaatgtgcccggcgggagctgcacgccaccacccctgtggagcaccccaacagaaaccaccccacccggctgagcctggtgttctaccagcacaagaacctgaacaagccccagcacggctttgagctgaacaagatcaagtttgaggccaaggaggccaagaacaagaagatgaaggccagcgagcagaaggaccaggccgccaatgaaggacctgagcagagcagcgaggtgaatgagctgaaccagatccccagccacaaggccctgaccctgacccatgacaacgtggtgacagtgagcccctatgccctgacccacgtggccggcccctacaaccactgggtgtag

SEQ ID NO: 173014 - DNA, 330 bp, Artificial Sequence
  Description of Artificial Sequence: Synthetic coding sequence
atggctgaccggctgtacacagagctgacagagaacctgaagagctacaacggccaccccacagaccggcgctgcaccctgaatgaaaatagaacctgcacctgccagggcatcgaccctgagacctgtggggccagcttctcctttggctgctcctggagcatgtacttcaacggctgcaagtttggccgcagccccagcccccggcgcttcagaattgaccccagcagccccctgcacacctactatgagcgcatcaccaagggcaggaaccctgagcggcgctacatgaagccagagcgcatcagccctggccacgaggccatgtag

SEQ ID NO: 173015 - DNA, 726 bp, Artificial Sequence
  Description of Artificial Sequence: Synthetic coding sequence
atgcagtgcttctccttcatcaagaccatgatgatcctcttcaacctgctgatcttcctgtgtggggccgccctgctggccgtgggcatctgggtgtccattgatggagccagcttcctgaagatcttcggccccctgagcagcagcgccatgcagtttgtgaatgtgggctacttcctgattgctgctggggtggtggtgtttgccctgggcttcctgggctgctacggggccaagacagagagcaaatgtgccctggtgaccttcttcttcatcctgctgctgatcttcatcgccgaggtggccgctgctgtggtggccctggtgtacaccaccatggccgagcacttcctgaccctgctggtggtgcctgccatcaagaaggactatggcagccaggaggacttcacccaggtgtggaacaccaccatgaagggcctgaagtgctgcggcttcaccaactacacagactttgaggacagcccctacttcaaggagaacagcgccttcccccccttctgctgcaatgacaacgtgaccaacacagccaatgagacctgcaccaagcagaaggcccatgaccagaaggtggagggctgcttcaaccagctgctgtatgacatccgcaccaatgctgtgacagtgggcggcgtggccgccggcatcggcggcctggagctggccgccatgattgtgtccatgtacctgtactgcaacctgcagtag

SEQ ID NO: 173016 - DNA, 702 bp, Artificial Sequence
  Description of Artificial Sequence: Synthetic coding sequence
atgagcagctactttgtgaaccccaccttccctggcagcctgcccagcggccaggacagcttcctgggccagctgcccctgtaccaggccggctatgatgccctgcggcccttccctgccagctatggagccagcagcctgcctgacaagacctacaccagcccctgcttctaccagcagagcaacagcgtgctggcctgcaacagagccagctatgaatatggagccagctgcttctacagcgacaaggacctgagcggggccagccccagcggcagcggcaagcagaggggccctggggactacctgcacttcagccctgagcagcagtacaagccagacagcagcagcggccagggcaaggccctgcatgatgaaggagctgacaggaagtacaccagccctgtgtacccctggatgcagaggatgaacagctgtgccggggctgtgtatggcagccacggccggcggggccggcagacctacacccgctaccagaccctggagctggagaaggagttccacttcaaccgctacctgaccaggagaagacgcatcgagatcgccaatgccctgtgcctgacagagcggcagatcaagatctggttccagaacagaaggatgaagtggaagaaggagaacaagctgatcaacagcacccagcccagcggagaagattctgaggccaaggccggggagtag

SEQ ID NO: 173017 - DNA, 918 bp, Artificial Sequence; identical to SEQ ID NO: 155476
  Description of Artificial Sequence: Synthetic coding sequence

SEQ ID NO: 173018 - DNA, 339 bp, Artificial Sequence
  Description of Artificial Sequence: Synthetic coding sequence
atggcccgggaggacagcgtgaagtgcctgcgctgcctgctgtatgccctgaacctgctcttctggctgatgagcatctctgtgctggccgtgtctgcctggatgagggactacctgaacaacgtgctgaccctgacagctgagaccagggtggaggaggccgtcatcctgacctacttccctgtggtgcaccctgtgatgattgctgtgtgctgcttcctgatcatcgtgggcatgctgggctactgcggcaccgtgaagaggaacctgctgctgctggcctggtacttcggcagcctgctggtgatcttctgtgtggagctggcctgtggggtgtag

SEQ ID NO: 173019 - DNA, 288 bp, Artificial Sequence
  Description of Artificial Sequence: Synthetic coding sequence
atggcccgggaggacagcgtgaagtgcctgcgctgcctgctgtatgccctgaacctgctcttctggctgatgagcatctctgtgctggccgtgtctgcctggatgagggactacctgaacaacgtgctgaccctgacagctgagaccagggtggaggaggccgtcatcctgacctacttccctgtggtgcaccctgtgatgattgctgtgtgctgcttcctgatcatcgtgggcatgctgggctactgcggcaccgtgaagaggaacctgctgctgctggcctggtag

SEQ ID NO: 173020 - DNA, 363 bp, Artificial Sequence
  Description of Artificial Sequence: Synthetic coding sequence
atggcccgggaggacagcgtgaagtgcctgcgctgcctgctgtatgccctgaacctgctcttctggctgatgagcatctctgtgctggccgtgtctgcctggatgagggactacctgaacaacgtgctgaccctgacagctgagaccagggtggaggaggccgtcatcctgacctacttccctgtggtgcaccctgtgatgattgctgtgtgctgcttcctgatcatcgtgggcatgctgggctactgcggcaccgtgaagaggaacctgctgctgctggcctggtacttcggcagcctgctggtgatcttctgtgtggagctggcctgtggggtgtggacctatgagcaggagctgatgtag

SEQ ID NO: 173021 - DNA, 444 bp, Artificial Sequence
  Description of Artificial Sequence: Synthetic coding sequence
atggcccgggaggacagcgtgaagtgcctgcgctgcctgctgtatgccctgaacctgctcttctggctgatgagcatctctgtgctggccgtgtctgcctggatgagggactacctgaacaacgtgctgaccctgacagctgagaccagggtggaggaggccgtcatcctgacctacttccctgtggtgcaccctgtgatgattgctgtgtgctgcttcctgatcatcgtgggcatgctgggctactgcggcaccgtgaagaggaacctgctgctgctggcctggtacttcggcagcctgctggtgatcttctgtgtggagctggcctgtggggtgtggacctatgagcaggagctgatggtgcctgtgcagtggagcgacatggtgaccctgaaggccaggatgaccaactacggcctgccccgctaccgctggctgacctag

SEQ ID NO: 173022 - DNA, 885 bp, Artificial Sequence
  Description of Artificial Sequence: Synthetic coding sequence
atgcccaggggggacagcgagcaggtgcgctactgtgcccgcttctcctacctgtggctgaagttcagcctcatcatctacagcacagtgttctggctgattggagccctggtgctgtctgtgggcatctatgcagaggtggagcggcagaagtacaagaccctggagagcgccttcctggccccagccatcatcctgatcctgctgggcgtggtgatgttcatggtgtccttcatcggcgtgctggccagcctgcgggacaacctgtacctgctgcaggccttcatgtacatcctgggcatctgcctgatcatggagctgattggaggagtggtggccctgaccttcaggaaccagaccatcgacttcctgaatgacaacatcagaagaggaattgagaactactatgatgacctggacttcaagaacatcatggactttgtgcagaagaagttcaagtgctgcggcggggaggactacagagactggagcaagaaccagtaccatgactgcagcgcccctggccccctggcctgtggggtgccctacacctgctgcatccggaacaccacagaggtggtgaacaccatgtgtggctacaagaccatcgacaaggagcgcttctctgtgcaggacgtcatctacgtgcggggctgcaccaatgctgtgatcatctggttcatggacaactacaccatcatggccggcatcctgctgggcatcctgctgccccagttcctgggcgtgctgctgaccctgctgtacatcaccagggtggaggacatcatcatggagcacagcgtgacagatggcctgctgggccctggggccaagcccagcgtggaggccgccggcaccggctgctgcctgtgctaccccaactag

SEQ ID NO: 173023 - DNA, 582 bp, Artificial Sequence
  Description of Artificial Sequence: Synthetic coding sequence
atgggccgcttccggggcggcctgcgctgcatcaagtacctgctgctgggcttcaacctgctcttctggctggccggcagcgctgtgattgccttcggcctgtggttccgctttggaggagccatcaaggagctgagcagcgaggacaagagccctgagtacttctacgtgggcctgtatgtgctggtgggcgctggggccctgatgatggctgtgggcttcttcggctgctgcggggccatgagggagagccagtgtgtgctgggcagcttcttcacctgcctgctggtgatctttgctgctgaggtgaccactggagtgtttgccttcatcggcaaaggagtggccatcagacatgtgcagaccatgtatgaggaggcctacaatgactacctgaaggaccggggcaaaggaaatggcaccctcatcaccttccacagcaccttccagtgctgcggcaaggagagcagcgagcaggtgcagcccacctgccccaaggagctgctgggccacaagatcttcggcatgatcttctccatggtgctgtgctgtgccatccggaacagcagagatgtgatctag

SEQ ID NO: 173024 - DNA, 591 bp, Artificial Sequence
  Description of Artificial Sequence: Synthetic coding sequence
atgggccgcttccggggcggcctgcgctgcatcaagtacctgctgctgggcttcaacctgctcttctggctggccggcagcgctgtgattgccttcggcctgtggttccgctttggaggagccatcaaggagctgagcagcgaggacaagagccctgagtacttctacgtgggcctgtatgtgctggtgggcgctggggccctgatgatggctgtgggcttcttcggctgctgcggggccatgagggagagccagtgtgtgctgggcagcgccatccgccacgtgcagaccatgtatgaggaggcctacaatgactacctgaaggaccggggcaaaggaaatggcaccctcatcaccttccacagcaccttccagtgctgcggcaaggagagcagcgagcaggtgcagcccacctgccccaaggagctgctgggccacaagaactgcattgatgaaattgagaccatcatctctgtgaagctgcagctgattggcatcgtgggcattggaattgctggcctgaccatcttcggcatgatcttctccatggtgctgtgctgtgccatccggaacagcagagatgtgatctag

SEQ ID NO: 173025 - DNA, 666 bp, Artificial Sequence
  Description of Artificial Sequence: Synthetic coding sequence
atgggccgcttccggggcggcctgcgctgcatcaagtacctgctgctgggcttcaacctgctcttctggctggccggcagcgctgtgattgccttcggcctgtggttccgctttggaggagccatcaaggagctgagcagcgaggacaagagccctgagtacttctacgtgggcctgtatgtgctggtgggcgctggggccctgatgatggctgtgggcttcttcggctgctgcggggccatgagggagagccagtgtgtgctgggcagcttcttcacctgcctgctggtgatctttgctgctgaggtgaccactggagtgtttgccttcatcggcaaaggagtggccatcagacatgtgcagaccatgtatgaggaggcctacaatgactacctgaaggaccggggcaaaggaaatggcaccctcatcaccttccacagcaccttccagtgctgcggcaaggagagcagcgagcaggtgcagcccacctgccccaaggagctgctgggccacaagaactgcattgatgaaattgagaccatcatctctgtgaagctgcagctgattggaattgtgggcatcggcattgctggcctgaccatcttcggcatgatcttctccatggtgctgtgctgtgccatccggaacagcagagatgtgatctag

SEQ ID NO: 173026 - DNA, 564 bp, Artificial Sequence
  Description of Artificial Sequence: Synthetic coding sequence
ggcctgcgctgcatcaagtacctgctgctgggcttcaacctgctcttctggctggccggcagcgctgtgattgccttcggcctgtggttccgctttggaggagccatcaaggagctgagcagcgaggacaagagccctgagtacttctacgtgggcctgtatgtgctggtgggcgctggggccctgatgatggctgtgggcttcttcggctgctgcggggccatgagggagagccagtgtgtgctgggcagcttcttcacctgcctgctggtgatctttgctgctgaggtgaccactggagtgtttgccttcatcggcaaaggagtggccatcagacatgtgcagaccatgtatgaggaggcctacaatgactacctgaaggaccggggcaaaggaaatggcaccctcatcaccttccacagcaccttccagtgctgcggcaaggagagcagcgagcaggtgcagcccacctgccccaaggagctgctgggccacaagatcttcggcatgatcttctccatggtgctgtgctgtgccatccggaacagcagagatgtgatctag

SEQ ID NO: 173027 - DNA, 762 bp, Artificial Sequence
  Description of Artificial Sequence: Synthetic coding sequence
atgggccagtgtggcatcaccagcagcaagacagtgctggtgttcctgaacctgatcttctggggcgccgccggcatcctgtgctacgtgggcgcctacgtgttcatcacctatgatgattatgaccacttctttgaagatgtgtacaccctcatcccagctgtggtgatcatcgctgtgggcgccctgctcttcatcatcggcctcatcggctgctgtgccaccatccgggagagccgctgtggcctggccaccttcgtcatcatcctgctgctggtgtttgtgacagaggtggtggtggtggtgctgggctacgtgtaccgggccaaggtggagaatgaggtggacaggagcatccagaaggtgtacaagacctacaacggcaccaacccagatgctgccagccgggccatcgactatgtgcagaggcagctgcactgctgcggcatccacaactacagcgactgggagaacacagactggttcaaggagaccaagaaccagagcgtgcccctgagctgctgccgggagacagccagcaactgcaatggcagcctggcccaccccagcgacctgtatgcagagggctgtgaggccctggtggtgaagaagctgcaggagatcatgatgcacgtgatctgggccgccctggcctttgctgccatccagctgctgggcatgctgtgtgcctgcatcgtgctgtgccgccgcagccgggaccctgcctatgagctgctgatcaccggcggcacctacgcctag

SEQ ID NO: 173028 - DNA, 687 bp, Artificial Sequence
  Description of Artificial Sequence: Synthetic coding sequence
atgggccagtgtggcatcaccagcagcaagacagtgctggtgttcctgaacctgatcttctggggcgccgccggcatcctgtgctacgtgggcgcctacgtgttcatcacctatgatgattatgaccacttctttgaagatgtgtacaccctcatcccagctgtggtgatcatcgctgtgggcgccctgctcttcatcatcggcctcatcggctgctgtgccaccatccgggagagccgctgtggcctggccaccgtggagaatgaggtggacaggagcatccagaaggtgtacaagacctacaacggcaccaacccagatgctgccagccgggccattgattatgtgcagaggcagctgcactgctgcggcatccacaactacagcgactgggagaacacagactggttcaaggagaccaagaaccagagcgtgcccctgagctgctgccgggagacagccagcaactgcaatggcagcctggcccaccccagcgacctgtatgcagagggctgtgaggccctggtggtgaagaagctgcaggagatcatgatgcacgtgatctgggccgccctggcctttgctgccatccagctgctgggcatgctgtgtgcctgcatcgtgctgtgcagaagaagccgggaccctgcctatgagctgctgatcactggaggcacctacgcctag

SEQ ID NO: 173029 - DNA, 651 bp, Artificial Sequence
  Description of Artificial Sequence: Synthetic coding sequence
atgtgggagcccatgagcagcagcctgatgatgaccatgaccaccagcctgaagatgtgcaccaggagcagcctgctcttcatcatcggcctcatcggctgctgtgccaccatccgggagagccgctgtggcctggccaccttcgtcatcatcctgctgctggtgtttgtgacagaggtggtggtggtggtgctgggctacgtgtaccgggccaaggtggagaatgaggtggacaggagcatccagaaggtgtacaagacctacaacggcaccaacccagatgctgccagccgggccatcgactatgtgcagaggcagctgcactgctgcggcatccacaactacagcgactgggagaacacagactggttcaaggagaccaagaaccagagcgtgcccctgagctgctgccgggagacagccagcaactgcaatggcagcctggcccaccccagcgacctgtatgcagagggctgtgaggccctggtggtgaagaagctgcaggagatcatgatgcacgtgatctgggccgccctggcctttgctgccatccagcagctgctgggcatgctgtgtgcctgcatcgtgctgtgcagaagaagccgggaccctgcctatgagctgctgatcactggaggcacctacgcctag

SEQ ID NO: 173030 - DNA, 570 bp, Artificial Sequence
  Description of Artificial Sequence: Synthetic coding sequence
atgggccagtgtggcatcaccagcagcaagacagtgctggtgttcctgaacctgatcttctggtttgtgatcatcctgctgctggtgtttgtgacagaggtggtggtggtggtgctgggctacgtgtaccgggccaaggtggagaatgaggtggacaggagcatccagaaggtgtacaagacctacaacggcaccaacccagatgctgccagccgggccatcgactatgtgcagaggcagctgcactgctgcggcatccacaactacagcgactgggagaacacagactggttcaaggagaccaagaaccagagcgtgcccctgagctgctgccgggagacagccagcaactgcaatggcagcctggcccaccccagcgacctgtatgcagagggctgtgaggccctggtggtgaagaagctgcaggagatcatgatgcacgtgatctgggccgccctggcctttgctgccatccagctgctgggcatgctgtgtgcctgcatcgtgctgtgccgccgcagccgggaccctgcctatgagctgctgatcaccggcggcacctacgcctag

SEQ ID NO: 173031 - DNA, 633 bp, Artificial Sequence
  Description of Artificial Sequence: Synthetic coding sequence
atggtgtgtggcggctttgcctgcagcaagaatgccctgtgtgccctgaatgtggtgtacatgctggtgtccctgctgctgattggagtggccgcctggggcaagggcctgggcctggtgagcagcatccacatcatcggcggcgtgattgctgtgggcgtcttcctgctgctgattgctgtggccggcctggtgggcgctgtgaaccaccaccaggtgctgctcttcttctacatgatcatcctgggcctggtgttcatcttccagtttgtgatcagctgcagctgcctggccatcaacagaagcaagcagacagatgtgatcaatgcctcctggtgggtgatgagcaacaagaccagagatgagctggagaggagctttgactgctgcggcctcttcaacctgaccaccctgtaccagcaggactatgacttctgcacagccatctgcaagagccagagccccacctgccagatgtgtggggagaagttcctgaagcacagtgatgaggccctgaagatcctgggcggcgtgggcctcttcttctccttcacagagatcctgggcgtgtggctggccatgaggttcaggaaccagaaggacccccgggccaaccccagcgccttcctgtag

SEQ ID NO: 173032 - DNA, 963 bp, Artificial Sequence
  Description of Artificial Sequence: Synthetic coding sequence
atgggcccctggagccgggtgcgggtggccaagtgccagatgctggtgacctgcttcttcatcctgctgctgggcctgtctgtggccaccatggtgaccctgacctactttggagcccactttgctgtgatcagaagagccagcctggagaagaacccctaccaggccgtgcaccagtgggccttctctgctggcctgagcctggtgggcctgctgaccctgggcgctgtgctgtctgctgctgccaccgtgcgggaggcccagggcctgatggccggcggcttcctgtgcttcagcctggccttctgtgcccaggtgcaggtggtgttctggaggctgcacagccccacccaggtggaggatgccatgctggacacctatgacctggtgtatgagcaggccatgaagggcaccagccacgtgcggcggcaggagctggccgccatccaggatgtgttcctgtgctgcggcaagaagagccccttcagccggctgggcagcacagaggccgacctgtgccagggcgaggaggccgcccgggaggactgcctgcagggcatccgctccttcctgcggacccaccagcaggtggccagcagcctgaccagcatcggcctggccctgactgtgtctgccctgctcttcagcagcttcctgtggtttgccatccgctgtggctgcagcctggacaggaagggcaagtacaccctgaccccccgggcctgtggccggcagccccaggagcccagcctgctgcgctgcagccagggcggccccacccactgcctgcacagcgaggccgtggccatcggcccccggggctgcagcggcagcctgcgctggctgcaggagagtgatgctgcccccctgcccctgagctgccacctggccgcccaccgggccctgcagggccgcagccggggcggcctgagcggctgcccagagcggggcctgagtgactag

SEQ ID NO: 173033 - DNA, 762 bp, Artificial Sequence
  Description of Artificial Sequence: Synthetic coding sequence
atgggcccctggagccgggtgcgggtggccaagtgccagatgctggtgacctgcttcttcatcctgctgctgggcctgtctgtggccaccatggtgaccctgacctactttggagcccactttgctgtgatcagaagagccagcctggagaagaacccctaccaggccgtgcaccagtgggccttctctgctggcctgagcctggtgggcctgctgaccctgggcgctgtgctgtctgctgctgccaccgtgcgggaggcccagggcctgatggccggcggcttcctgtgcttcagcctggccttctgtgcccaggtgcaggtggtgttctggaggctgcacagccccacccaggtggaggatgccatgctggacacctatgacctggtgtatgagcaggccatgaagggcaccagccacgtgcggcggcaggagctggccgccatccaggatgtgttcctgtgctgcggcaagaagagccccttcagccggctgggcagcacagaggccgacctgtgccagggcgaggaggccgcccgggaggactgcctgcagggcatccgctccttcctgcggacccaccagcaggtggccagcagcctgaccagcatcggcctggccctgactgtgtctgccctgctcttcagcagcttcctgtggtttgccatccgctgtggctgcagcctggacaggaagggcaagtacaccctgacccccaggagccctggccagaagagccgctgggcccagtgggtgccctag

SEQ ID NO: 173034 - DNA, 525 bp, Artificial Sequence
  Description of Artificial Sequence: Synthetic coding sequence
atggccatcggctttgtgggctgcctgggcgccatcaaggagaacaagtgcctgctgctgaccttcttcctgctgctgctgctggtgttcctgctggaggccaccatcgccatcctcttctttgcctacacagacaagattgacagatatgcccagcaggacctgaagaagggcctgcacctgtatggcacccagggcaatgtgggcctgaccaatgcctggagcatcatccagacagacttccgctgctgcggcgtgagcaactacacagactggtttgaggtgtacaatgccaccagggtgcctgacagctgctgcctggagttcagcgagagctgtggcctgcacgcccctggcacctggtggaaggccccctgctatgaaacagtgaaggtgtggctgcaggagaacctgctggccgtgggcatcttcggcctgtgcacagccctggtgcagatcctgggcctgacctttgccatgaccatgtactgccaggtggtgaaggctgacacctactgtgcctag

SEQ ID NO: 173035 - DNA, 717 bp, Artificial Sequence
  Description of Artificial Sequence: Synthetic coding sequence
atggcccgggcctgcctgcaggccgtgaagtacctgatgtttgccttcaacctgctcttctggctgggcggctgcggcgtgctgggcgtgggcatctggctggccgccacccagggcagctttgccaccctgagcagcagcttccccagcctgtctgctgccaacctgctgatcatcaccggggcctttgtgatggccatcggctttgtgggctgcctgggcgccatcaaggagaacaagtgcctgctgctgaccttcttcctgctgctgctgctggtgttcctgctggaggccaccatcgccatcctcttctttgcctacacagacaagattgacagatatgcccagcaggacctgaagaagggcctgcacctgtatggcacccagggcaatgtgggcctgaccaatgcctggagcatcatccagacagacttccgctgctgcggcgtgagcaactacacagactggtttgaggtgtacaatgccaccagggtgcctgacagctgctgcctggagttcagcgagagctgtggcctgcacgcccctggcacctggtggaaggccccctgctatgaaacagtgaaggtgtggctgcaggagaacctgctggccgtgggcatcttcggcctgtgcacagccctggtgcagatcctgggcctgacctttgccatgaccatgtactgccaggtggtgaaggctgacacctactgtgcctag

SEQ ID NO: 173036 - DNA, 717 bp, Artificial Sequence; identical to SEQ ID NO: 173035
  Description of Artificial Sequence: Synthetic coding sequence

SEQ ID NO: 173037 - DNA, 717 bp, Artificial Sequence; identical to SEQ ID NO: 173035
  Description of Artificial Sequence: Synthetic coding sequence

SEQ ID NO: 173038 - DNA, 717 bp, Artificial Sequence; identical to SEQ ID NO: 173035
  Description of Artificial Sequence: Synthetic coding sequence

SEQ ID NO: 173039 - DNA, 717 bp, Artificial Sequence; identical to SEQ ID NO: 173035
  Description of Artificial Sequence: Synthetic coding sequence

SEQ ID NO: 173040 - DNA, 774 bp, Artificial Sequence
  Description of Artificial Sequence: Synthetic coding sequence
atgacccccaggtctgctggcaccagcgcccatggagctgagctgaagagatgtggcatggcccgggcctgcctgcaggccgtgaagtacctgatgtttgccttcaacctgctcttctggctgggcggctgcggcgtgctgggcgtgggcatctggctggccgccacccagggcagctttgccaccctgagcagcagcttccccagcctgtctgctgccaacctgctgatcatcactggagcctttgtgatggccatcggctttgtgggctgcctgggcgccatcaaggagaacaagtgcctgctgctgaccttcttcctgctgctgctgctggtgttcctgctggaggccaccatcgccatcctcttctttgcctacacagacaagattgacagatatgcccagcaggacctgaagaagggcctgcacctgtatggcacccagggcaatgtgggcctgaccaatgcctggagcatcatccagacagacttccgctgctgcggcgtgagcaactacacagactggtttgaggtgtacaatgccaccagggtgcctgacagctgctgcctggagttcagcgagagctgtggcctgcacgcccctggcacctggtggaaggccccctgctatgagaccgtgaaggtgtggctgcaggagaacctgctggccgtgggcatcttcggcctgtgcacagccctggtgcagatcctgggcctgacctttgccatgaccatgtactgccaggtggtgaaggctgacacctactgtgcctag

SEQ ID NO: 173041 - DNA, 717 bp, Artificial Sequence; identical to SEQ ID NO: 173035
  Description of Artificial Sequence: Synthetic coding sequence

SEQ ID NO: 173042 - DNA, 525 bp, Artificial Sequence; identical to SEQ ID NO: 173034
  Description of Artificial Sequence: Synthetic coding sequence

SEQ ID NO: 173043 - DNA, 303 bp, Artificial Sequence
  Description of Artificial Sequence: Synthetic coding sequence
atggccatcggctttgtgggctgcctgggcgccatcaaggagaacaagtgcctgctgctgaccttcttcctgctgctgctgctggtgttcctgctggaggccaccatcgccatcctcttctttgcctacacagacaagattgacagatatgcccagcaggacctgaagaagggcctgcacctgtatggcacccagggcaatgtgggcctgaccaatgcctggagcatcatccagacagacttccgctgctgcggcgtgagcaactacacagactggtttgaggtgtacaatgccaccaggtag

SEQ ID NO: 173044 - DNA, 480 bp, Artificial Sequence
  Description of Artificial Sequence: Synthetic coding sequence
atggcccgggcctgcctgcaggccgtgaagtacctgatgtttgccttcaacctgctcttctggctgggcggctgcggcgtgctgggcgtgggcatctggctggccgccacccagggcagctttgccaccctgagcagcagcttccccagcctgtctgctgccaacctgctgatcatcaccggggcctttgtgatggccatcggctttgtgggctgcctgggcgccatcaaggagaacaagtgcctgctgctgaccttcttcctgctgctgctgctggtgttcctgctggaggccaccatcgccatcctcttctttgcctacacagacaagattgacagatatgcccagcaggacctgaagaagggcctgcacctgtatggcacccagggcaatgtgggcctgaccaatgcctggagcatcatccagacagacttccgctgctgcggcgtgagcaactacacagactggtttgaggtgtag

SEQ ID NO: 173045 - DNA, 258 bp, Artificial Sequence
  Description of Artificial Sequence: Synthetic coding sequence
atggcccgggcctgcctgcaggccgtgaagtacctgatgtttgccttcaacctgctcttctggctgggcggctgcggcgtgctgggcgtgggcatctggctggccgccacccagggcagctttgccaccctgagcagcagcttccccagcctgtctgctgccaacctgctgatcatcaccggggcctttgtgatggccatcggctttgtgggctgcctgggcgccatcaaggagaacaagtgcctgctgctgacctag

SEQ ID NO: 173046 - DNA, 807 bp, Artificial Sequence
  Description of Artificial Sequence: Synthetic coding sequence
atgtctgggaagcactacaagggccctgaggtgtcctgctgcatcaagtacttcatcttcggcttcaacgtcatcttctggttcctgggcatcaccttcctgggcatcggcctgtgggcctggaatgagaagggcgtgctgagcaacatcagcagcatcacagacctgggcggctttgatcctgtgtggctgttcctggtggtgggcggcgtgatgttcatcctgggctttgctggctgcattggagccctgcgggagaacaccttcctgctgaagttcttctctgtgttcctgggcatcatcttcttcctggagctgacagctggggtgctggcctttgtgttcaaggactggatcaaggaccagctgtacttcttcatcaacaacaacatccgggcctacagagatgacatcgacctgcagaacctgattgacttcacccaggagtactggcagtgctgcggggcctttggagcagatgactggaacctgaacatctacttcaactgcacagacagcaatgccagccgggagcgctgtggggtgcccttcagctgctgcaccaaggaccctgcagaagatgtgatcaacacccagtgtggctatgatgcccggcagaagccagaggtggaccagcagatcgtcatctacaccaagggctgtgtgccccagtttgagaagtggctgcaggacaacctgaccatcgtggccggcatcttcatcggcatcgccctgctgcagatcttcggcatctgcctggcccagaacctggtgtctgacattgaagctgtgcgggcctcctggtag

SEQ ID NO: 173047 - DNA, 594 bp, Artificial Sequence
  Description of Artificial Sequence: Synthetic coding sequence
atgttcatcctgggctttgctggctgcatcggggccctgcgggagaacaccttcctgctgaagttcttcagcgtcttcctgggcatcatcttcttcctggagctgacagctggggtgctggcctttgtgttcaaggactggatcaaggaccagctgtacttcttcatcaacaacaacatccgggcctacagagatgacatcgacctgcagaacctgattgacttcacccaggagtactggcagtgctgcggggccttcggggctgatgactggaacctgaacatctacttcaactgcacagacagcaatgccagccgggagcgctgtggggtgcccttcagctgctgcaccaaggaccctgcagaagatgtgatcaacacccagtgtggctatgatgcccggcagaagccagaggtggaccagcagatcgtcatctacaccaagggctgtgtgccccagtttgagaagtggctgcaggacaacctgaccatcgtggccggcatcttcatcggcatcgccctgctgcagatcttcggcatctgcctggcccagaacctggtgtctgacatcgaggccgtgcgggcctcctggtag

SEQ ID NO: 173048 - DNA, 801 bp, Artificial Sequence
  Description of Artificial Sequence: Synthetic coding sequence
atggccagcaggaggatggagaccaagcctgtgatcacctgcctgaagaccctgctgatcatctacagctttgtgttctggaaggagaaggccgccggcttctgtggccggcaggatgtggccatggccctgatcaccggggtcatcctgctggccgtgggcgtgtggggcaagctgaccctgggcacctacatcagcctgattgctgagaacagcaccaatgccccctacgtgctgattggcaccggcaccaccatcgtggtgtttggcctgtttggctgctttgccacctgccggggcagcccctggatgctgaagctgtatgccatgttcctgagcctggtgttcctggccgagctggtggccggcatcagcggctttgtgttcagacatgagatcaaggacaccttcctgcggacctacacagatgccatgcagacctacaatggaaatgatgagaggagcagagctgtggaccacgtgcagaggagcctgagctgctgcggcgtgcagaactacaccaactggagcaccagcccctacttcctggagcacggcatcccccccagctgctgcatgaatgaaacagactgcaacccccaggacctgcacaacctgactgtggccgccaccaaggtgaaccagaagggctgctatgacctggtgaccagcttcatggagaccaacatgggcatcatcgccggcgtggccttcggcatcgccttcagccagctgattggcatgctgctggcctgctgcctgagccgcttcatcacagccaaccagtatgagatggtgtag

SEQ ID NO: 173049 - DNA, 750 bp, Artificial Sequence
  Description of Artificial Sequence: Synthetic coding sequence
atggccagcaggaggatggagaccaagcctgtgatcacctgcctgaagaccctgctgatcatctacagctttgtgttctggatcactggagtcatcctgctggccgtgggcgtgtggggcaagctgaccctgggcacctacatcagcctgattgctgagaacagcaccaatgccccctacgtgctgattggaacaggcaccaccatcgtggtgtttggcctgtttggctgctttgccacctgccggggcagcccctggatgctgaagctgtatgccatgttcctgagcctggtgttcctggccgagctggtggccggcatcagcggctttgtgttcagacatgagatcaaggacaccttcctgcggacctacacagatgccatgcagacctacaatggaaatgatgagaggagcagagctgtggaccacgtgcagaggagcctgagctgctgcggcgtgcagaactacaccaactggagcaccagcccctacttcctggagcacggcatcccccccagctgctgcatgaatgaaacagactgcaacccccaggacctgcacaacctgactgtggccgccaccaaggtgaaccagaagggctgctatgacctggtgaccagcttcatggagaccaacatgggcatcatcgccggcgtggcctttggaattgccttcagccagctgattggcatgctgctggcctgctgcctgagccgcttcatcacagccaaccagtatgagatggtgtag

SEQ ID NO: 173050 - DNA, 828 bp, Artificial Sequence
  Description of Artificial Sequence: Synthetic coding sequence
atggccaacagaacagtgtgcaatggccagggccgcagccgggacctgctgcgcatcaagaacatccccaatgcccctggccacttcctgattgctggggtgggcggcagcagcagccagggccgcagcattgaggaggagggcaagacccacctgggcatcactggagtcatcctgctggccgtgggcgtgtggggcaagctgaccctgggcacctacatcagcctgattgctgagaacagcaccaatgccccctacgtgctgattggaacaggcaccaccatcgtggtgtttggcctgtttggctgctttgccacctgccggggcagcccctggatgctgaagctgtatgccatgttcctgagcctggtgttcctggccgagctggtggccggcatcagcggctttgtgttcagacatgagatcaaggacaccttcctgcggacctacacagatgccatgcagacctacaatggaaatgatgagaggagcagagctgtggaccacgtgcagaggagcctgagctgctgcggcgtgcagaactacaccaactggagcaccagcccctacttcctggagcacggcatcccccccagctgctgcatgaatgaaacagactgcaacccccaggacctgcacaacctgactgtggccgccaccaaggtgaaccagaagggctgctatgacctggtgaccagcttcatggagaccaacatgggcatcatcgccggcgtggcctttggaattgccttcagccagctgattggcatgctgctggcctgctgcctgagccgcttcatcacagccaaccagtatgagatggtgtag

SEQ ID NO: 173051 - DNA, 672 bp, Artificial Sequence
  Description of Artificial Sequence: Synthetic coding sequence
atgatcactggagtcatcctgctggccgtgggcgtgtggggcaagctgaccctgggcacctacatcagcctgattgctgagaacagcaccaatgccccctacgtgctgattggaacaggcaccaccatcgtggtgtttggcctgtttggctgctttgccacctgccggggcagcccctggatgctgaagctgtatgccatgttcctgagcctggtgttcctggccgagctggtggccggcatcagcggctttgtgttcagacatgagatcaaggacaccttcctgcggacctacacagatgccatgcagacctacaatggaaatgatgagaggagcagagctgtggaccacgtgcagaggagcctgagctgctgcggcgtgcagaactacaccaactggagcaccagcccctacttcctggagcacggcatcccccccagctgctgcatgaatgaaacagactgcaacccccaggacctgcacaacctgactgtggccgccaccaaggtgaaccagaagggctgctatgacctggtgaccagcttcatggagaccaacatgggcatcatcgccggcgtggcctttggaattgccttcagccagctgattggcatgctgctggcctgctgcctgagccgcttcatcacagccaaccagtatgagatggtgtag

SEQ ID NO: 173052 - DNA, 714 bp, Artificial Sequence
  Description of Artificial Sequence: Synthetic coding sequence
atggccggcgtgtctgcctgcatcaagtacagcatgttcaccttcaacttcctgttctggctgtgtggcatcctgatcctggccctggccatctgggtgcgggtgtccaatgacagccaggccatctttggaagtgaagatgtgggcagcagcagctatgtggccgtggacatcctgattgctgtgggcgccatcatcatgatcctgggcttcctgggctgctgcggggccatcaaggagagccgctgcatgctgctgctcttcttcatcggcctgctgctgatcctgctgctgcaggtggccaccggcatcctgggcgctgtgttcaagagcaagagtgaccgcatcgtgaatgagaccctgtatgagaacaccaagctgctgagcgccactggagagagcgagaagcagttccaggaggccatcatcgtgttccaggaggagttcaagtgctgcggcctggtgaatggagctgctgactggggcaacaacttccagcactacccagagctgtgtgcctgcctggacaagcagaggccctgccagagctacaacgggaagcaggtgtacaaggagacctgcatctccttcatcaaggacttcctggccaagaacctgatcatcgtcatcggcatcagctttggcctggccgtgattgagatcctgggcctggtgttctccatggtgctgtactgccagatcggcaacaagtag

SEQ ID NO: 173053 - DNA, 714 bp, Artificial Sequence; identical to SEQ ID NO: 173052
  Description of Artificial Sequence: Synthetic coding sequence

SEQ ID NO: 173054 - DNA, 714 bp, Artificial Sequence; identical to SEQ ID NO: 173052
  Description of Artificial Sequence: Synthetic coding sequence

SEQ ID NO: 173055 - DNA, 720 bp, Artificial Sequence
  Description of Artificial Sequence: Synthetic coding sequence
atggcccggggctgcctgtgctgcctgaagtacatgatgttcctgttcaacctgatcttctggctgtgtggctgcggcctgctgggcgtgggcatctggctgtctgtgtcccagggcaactttgccaccttcagccccagcttccccagcctgtctgctgccaacctggtgattgccatcggcaccatcgtgatggtgacaggcttcctgggctgcctgggcgccatcaaggagaacaagtgcctgctgctgtccttcttcatcgtgctgctggtgatcctgctggccgagctgatcctgctgatcctcttctttgtgtacatggacaaggtgaatgaaaatgccaagaaggacctgaaggagggcctgctgctgtaccacacagaaaataatgtgggcctgaagaatgcctggaacatcatccaggccgagatgcgctgctgcggcgtgacagactacacagactggtaccctgtgctgggggagaacacagtgcctgaccgctgctgcatggagaacagccagggctgcggcagaaatgccaccacccccctgtggaggacaggctgctatgagaaggtgaagatgtggtttgatgacaacaagcacgtgctgggcaccgtgggcatgtgcatcctgatcatgcagatcctgggcatggccttctccatgaccctcttccagcacatccacaggacaggcaagaagtatgatgcctag

SEQ ID NO: 173056 - DNA, 720 bp, Artificial Sequence; identical to SEQ ID NO: 173055
  Description of Artificial Sequence: Synthetic coding sequence

SEQ ID NO: 173057 - DNA, 1044 bp, Artificial Sequence
  Description of Artificial Sequence: Synthetic coding sequence
atggccctgatgctgagcctggtgctgagcctgctgaagctgggcagcggccagtggcaggtgtttggaccagacaagcctgtgcaggccctggtgggggaggatgctgccttcagctgcttcctgagccccaagaccaatgctgaggccatggaggtgcgcttcttccggggccagttcagctctgtggtgcacctgtacagagatggcaaggaccagcccttcatgcagatgccccagtaccagggccgcaccaagctggtgaaggacagcattgctgagggccgcatcagcctgcggctggagaacatcaccgtgctggatgctggcctgtatggctgccgcatcagcagccagagctactaccagaaggccatctgggagctgcaggtgtctgccctgggctctgtgcccctcatcagcatcaccggctacgtggaccgggacatccagctgctgtgccagagcagcggctggttcccccggcccacagccaagtggaagggcccccagggccaggacctgagcacagacagcaggaccaacagagacatgcacggcctgtttgatgtggagatcagcctgactgtgcaggagaatgccggcagcatcagctgcagcatgagacatgcccacctgagccgggaggtggagagccgggtgcagattggagacaccttctttgagcccatctcctggcacctggccaccaaggtgctgggcatcctgtgctgcggcctcttctttggaattgtgggcctgaagatcttcttcagcaagttccagtgcaagcgggagcgggaggcctgggccggggccctcttcatggtgcctgctggcactggaagtgagatgctgccccaccctgctgccagcctgctgctggtgctggccagccggggccctggccccaagaaggaaaatcctgggggcaccggcctggagaagaaggccaggactggaagaattgaaagaagacctgagaccaggtctggaggagacagcggcagcagagatggcagccctgaggccctgcgcttctag

SEQ ID NO: 173058 - DNA, 879 bp, Artificial Sequence
  Description of Artificial Sequence: Synthetic coding sequence
atgggagagaagtctgagaactgtggggtgcctgaggacctgctgaatggcctgaaggtgacagacacccaggaggctgaatgtgccggcccccctgtgcctgaccccaagaaccagcacagccagagcaagctgctgagagatgatgaggcccacctgcaggaggaccagggcgaggaggagtgcttccatgactgcagcgccagctttgaggaggagcccggggctgacaaggtggagaacaagagcaatgaagatgtgaacagcagcgagctggatgaggagtacctgattgagctggagaagaacatgtctgatgaggagaagcagaagaggcgggaggagagcacccggctgaaggaggagggcaatgagcagttcaagaagggggactacattgaagctgagagcagctacagccgggccctggagatgtgccccagctgcttccagaaggagaggagcatcctcttcagcaacagagctgctgccaggatgaagcaggacaagaaggagatggccatcaatgactgcagcaaggccatccagctgaaccccagctacatccgggccatcctgcggcgggcagagctgtatgagaagacagacaagctggatgaggccctggaggactacaagagcatcctggagaaggaccccagcatccaccaggcccgggaggcctgcatgaggctgcccaagcagatcgaggagagaaatgaaaggctgaaggaggagatgctgggcaagctgaaggacctgggcaacctggtgctgcggcccttcggcctgagcacagagaacttccagatcaagcaggacagcagcacaggcagctacagcatcaactttgtgcagaaccccaacaacaacagatag

SEQ ID NO: 173059 - DNA, 2199 bp, Artificial Sequence
  Description of Artificial Sequence: Synthetic coding sequence
atggatgctgacaaggagaaggacctgcagaagttcctgaagaatgtggatgagatcagcaacctgatccaggagatgaacagtgatgatcctgtggtgcagcagaaggctgtgctggagacagagaagaggctgctgctgatggaggaggaccaggaggaggatgagtgcaggaccaccctgaacaagaccatgatcagccccccccagacagccatgaagtctgctgaggagatcaacagcgaggccttcctggcctctgtggagaaggatgccaaggagcgggccaagagaagaagagagaacaaggtgctggctgatgccctgaaggagaagggaaatgaggcctttgctgagggcaactatgaaacagccatcctgcgctacagcgagggcctggagaagctgaaggacatgaaggtgctgtacaccaacagagcccaggcctacatgaagctggaggactatgagaaggccctggtggactgtgagtgggccctgaagtgtgatgagaagtgcaccaaggcctacttccacatgggcaaggccaacctggccctgaagaactacagcgtgtcccgggagtgctacaagaagatcctggagatcaaccccaagctgcagacccaggtgaagggctacctgaaccaggtggacctgcaggagaaggctgacctgcaggagaaggaggcccacgagctgctggacagcggcaagaacacagctgtgaccaccaagaacctgctggagaccctgagcaagccagaccagatccccctcttctacgccggcggcatcgagatcctgacagagatgatcaatgaatgtacagagcagaccctcttcaggatgcacaacggcttcagcatcatcagtgacaatgaggtgatccgccgctgcttcagcacagctggaaatgatgctgtggaggagatggtgtgtgtgtctgtgctgaagctgtggcaggccgtgtgcagcagaaatgaggagaaccagagggtgctggtgatccaccacgaccgggcccggctgctggccgccctgctgagcagcaaggtgctggccatccggcagcagagctttgccctgctgctgcacctggcccagacagagagcggccgcagcctcatcatcaaccacctggacctgacccggctgctggaggccctggtgtccttcctggacttcagtgacaaggaggccaacacagccatgggcctcttcacagacctggccctggaggagcgcttccaggtgtggttccaggccaacctgcccggggtgctgcctgccctgactggagtgctgaagacagaccccaaggtgagcagcagcagcgccctgtgccagtgcatcgccatcatgggcaacctgtctgctgagcccaccaccaggaggcacatggccgcctgtgaggagtttggagatggctgcctgagcctgctggcccgctgtgaagaagatgtggacctcttccgggaggtgatctacaccctgctgggcctgatgatgaacctgtgcctgcaggccccctttgtgtctgaggtgtgggccgtggaggtgtcccggcgctgcctgagcctgctgaacagccaggacggcggcatcctgaccagggctgctggggtgctgagcaggaccctgagcagcagcctgaagatcgtggaggaggccctgcgggccggcgtggtgaagaagatgatgaagttcctgaagacaggaggagaaacagccagccgctatgccatcaagatcctggccatctgcaccaacagctaccacgaggcccgggaggaggtgatccggctggacaagaagctgtctgtgatgatgaagctgctgagcagtgaagatgaggtgctggtgggcaatgctgccctgtgcctgggcaactgcatggaggtgcccaacgtggccagcagcctgctgaagacagacctgctgcaggtgctgctgaagctggccggcagtgacacccagaagacagctgtgcaggtgaatgccggcatcgccctgggcaagctgtgcacagctgagccccgggtgcctgctgagagcagccacctgcagtttggccgggagagcgctgcccctgaggccctgagcccccggcgctgggaggagatgttccacatgctggtgttcagcctgagctctgtggaccccccacctcctccaccccagacctgctacccctag

SEQ ID NO: 173060 - DNA, 324 bp, Artificial Sequence
  Description of Artificial Sequence: Synthetic coding sequence
atggatgctgacaaggagaaggacctgcagaagttcctgaagaatgtggatgagatcagcaacctgatccaggagatgaacagtgatgatcctgtggtgcagcagaaggctgtgctggagacagagaagaggctgctgctgatggaggaggaccaggaggaggatgagtgcaggaccaccctgaacaagaccatgatcagccccccccagacagccatgaagtctgctgaggagatcaacagcgaggccttcctggcctctgtggagaaggatgccaaggagcgggccaagagaagaagagagaacaaggtgctggccgactag

SEQ ID NO: 173061 - DNA, 609 bp, Artificial Sequence
  Description of Artificial Sequence: Synthetic coding sequence
atggatgctgacaaggagaaggacctgcagaagttcctgaagaatgtggatgagatcagcaacctgatccaggagatgaacagtgatgatcctgtggtgcagcagaaggctgtgctggagacagagaagaggctgctgctgatggaggaggaccaggaggaggatgagtgcaggaccaccctgaacaagaccatgatcagccccccccagacagccatgaagtctgctgaggagatcaacagcgaggccttcctggcctctgtggagaaggatgccaaggagcgggccaagagaagaagagagaacaaggtgctggctgatgccctgaaggagaagggaaatgaggcctttgctgagggcaactatgaaacagccatcctgcgctacagcgagggcctggagaagctgaaggacatgaaggtgctgtacaccaacagagcccaggcctacatgaagctggaggactatgagaaggccctggtggactgtgagtgggccctgaagtgtgatgagaagtgcaccaaggcctacttccacatgggcaaggccaacctggccctgaagaactacagcgtgtcccgggagtgctacaagaagatcctggagtag

SEQ ID NO: 173062 - DNA, 504 bp, Artificial Sequence
  Description of Artificial Sequence: Synthetic coding sequence
atggatgctgacaaggagaaggacctgcagaagttcctgaagaatgtggatgagatcagcaacctgatccaggagatgaacagtgatgatcctgtggtgcagcagaaggctgtgctggagacagagaagaggctgctgctgatggaggaggaccaggaggaggatgagtgcaggaccaccctgaacaagaccatgatcagccccccccagacagccatgaagtctgctgaggagatcaacagcgaggccttcctggcctctgtggagaaggatgccaaggagcgggccaagagaagaagagagaacaaggtgctggctgatgccctgaaggagaagggaaatgaggcctttgctgagggcaactatgaaacagccatcctgcgctacagcgagggcctggagaagctgaaggacatgaaggtgctgtacaccaacagagcccaggcctacatgaagctggaggactatgagaaggccctggtggactgtgagtgggccctgtag

SEQ ID NO: 173063 - DNA, 2118 bp, Artificial Sequence
  Description of Artificial Sequence: Synthetic coding sequence
atggatgctgacaaggagaaggacctgcagaagttcctgaagaatgtggatgagatcagcaacctgatccaggagatgaacagtgatgatcctgtggtgcagcagaaggctgtgctggagacagagaagaggctgctgctgatggaggaggaccaggaggaggatgagtgcaggaccaccctgaacaagaccatgatcagccccccccagacagccatgaagtctgctgaggagatcaacagcgaggccttcctggcctctgtggagaaggatgccaaggagcgggccaagagaagaagagagaacaaggtgctggctgatgccctgaaggagaagggaaatgaggcctttgctgagggcaactatgaaacagccatcctgcgctacagcgagggcctggagaagctgaaggacatgaaggtgctgtacaccaacagagcccaggcctacatgaagctggaggactatgagaaggccctggtggactgtgagtgggccctgaagtgtgatgagaagtgcaccaaggcctacttccacatgggcaaggccaacctggccctgaagaactacagcgtgtcccgggagtgctacaagaagatcctggagatcaaccccaagctgcagacccaggtgaagggctacctgaaccaggtggacctgcaggagaaggctgacctgcaggagaaggaggcccacgagctgctggacagcggcaagaacacagctgtgaccaccaagaacctgctggagaccctgagcaagccagaccagatccccctcttctacgccggcggcatcgagatcctgacagagatgatcaatgaatgtacagagcagaccctcttcaggatgcacaacggcttcagcatcatcagtgacaatgaggtgatccgccgctgcttcagcacagctggaaatgatgctgtggaggagatggtgtgtgtgtctgtgctgaagctgtggcaggccgtgtgcagcagaaatgaggagaaccagagggtgctggtgatccaccacgaccgggcccggctgctggccgccctgctgagcagcaaggtgctggccatccggcagcagagctttgccctgctgctgcacctggcccagacagagagcggccgcagcctcatcatcaaccacctggacctgacccggctgctggaggccctggtgtccttcctggacttcagtgacaaggaggccaacacagccatgggcctcttcacagacctggccctggaggagcgcttccaggtgtggttccaggccaacctgcccggggtgctgcctgccctgactggagtgctgaagacagaccccaaggtgagcagcagcagcgccctgtgccagtgcatcgccatcatgggcaacctgtctgctgagcccaccaccaggaggcacatggccgcctgtgaggagtttggagatggctgcctgagcctgctggcccgctgtgaagaagatgtggacctcttccgggaggtgatctacaccctgctgggcctgatgatgaacctgtgcctgcaggccccctttgtgtctgaggtgtgggccgtggaggtgtcccggcgctgcctgagcctgctgaacagccaggacggcggcatcctgaccagggctgctggggtgctgagcaggaccctgagcagcagcctgaagatcgtggaggaggccctgcgggccggcgtggtgaagaagatgatgaagttcctgaagacaggaggagaaacagccagccgctatgccatcaagatcctggccatctgcaccaacagctaccacgaggcccgggaggaggtgatccggctggacaagaagctgtctgtgatgatgaagctgctgagcagtgaagatgaggtgctggtgggcaatgctgccctgtgcctgggcaactgcatggaggtgcccaacgtggccagcagcctgctgaagacagacctgctgcaggtgctgctgaagctggccggcagtgacacccagaagacagctgtgcaggtgaatgccggcatcgccctgggcaagctgtgcacagctgagcccaggtttgctgcccagctgaggaagctgcacggcctggagatcctgaacagcaccatgaagtacatcagtgacagctag

SEQ ID NO: 173064 - DNA, 1143 bp, Artificial Sequence
  Description of Artificial Sequence: Synthetic coding sequence
atgttccggctgctgtcctggagcctgggccggggcttcctgcgggctgctggaagacgctgccggggctgcagcgcccggctgctgcccggcctggccggcggccctggccctgaggtgcaggtgccccccagccgggtggccccccacggccggggccctggcctgctgcccctgctggccgccctggcctggttcagcaggcctgctgctgctgaggaggaggagcagcagggcgcagatggagctgctgctgaagatggagcagatgaggccgaggccgagatcatccagctgctgaagagggccaagctgagcatcatgaaggatgagcctgaggaggccgagctgatcctgcatgatgccctgcggctggcctaccagacagacaacaagaaggccatcacctacacctatgacctgatggccaacctggccttcatccggggccagctggagaatgctgagcagctgttcaaggccaccatgagctacctgctgggcggcggcatgaagcaggaggacaatgccatcatcgagatcagcctgaagctggccagcatctatgctgcccagaaccggcaggagtttgctgtggccggctatgagttctgcatcagcaccctggaggagaagattgagcgggagaaggagctggccgaggacatcatgtctgtggaggagaaggccaacacccacctgctgctgggcatgtgcctggatgcctgtgcccgctacctgctcttcagcaagcagcccagccaggcccagaggatgtatgagaaggccctgcagatcagcgaggagatccagggcgagcggcacccccagaccatcgtgctgatgtctgacctggccaccaccctggatgcccagggccgctttgatgaggcctacatctacatgcagagggccagtgacctggcccggcagatcaaccaccctgagctgcacatggtgctgagcaacctggccgctgtgctgatgcaccgggagcgctacacccaggccaaggagatctaccaggaggccctgaagcaggccaagctgaagaaggatgagatctctgtgcagcacatccgggaggagctggccgagctgagcaagaagagccggcccctgaccaacagcgtgaagctgtag

SEQ ID NO: 173065 - DNA, 1143 bp, Artificial Sequence; identical to SEQ ID NO: 173064
  Description of Artificial Sequence: Synthetic coding sequence

SEQ ID NO: 173066 - DNA, 1506 bp, Artificial Sequence
  Description of Artificial Sequence: Synthetic coding sequence
atggcccagccccacaccacctctgtgccctactttgcccggagccctgcccctcctccacccagccgcagcggggccccaccccagcccccagccaccctgcggcccagcagaagaaggaccaggcctcccaggcctgctgacagaagagatgccccagctgactgtgcctacctgtggaggatcctgaccccccggcggggccgggccaggagaagtgatgtgggcgcccggcaccgggcctgtggcagaagagatgtgctgctgagccggcagggccctgccaaccctgagggcgccaggagagtggtgggcggccaggagcgggtgtggccagctgtgagaagaggccggggcggctccatgttccggctgctgtcctggagcctgggccggggcttcctgcgggccgccggccgccgctgccggggctgcagcgcccggctgctgcccggcctggccggcggccctggccctgaggtgcaggtgccccccagccgggtggcccctcatggccggggccctggcctgctgcccctgctggccgccctggcctggttcagcaggcctgctgctgctgaggaggaggagcagcagggcgcagatggagctgctgctgaagatggagcagatgaagctgaggccgagatcatccagctgctgaagagggccaagctgagcatcatgaaggatgagcctgaggaggccgagctgatcctgcatgatgccctgcggctggcctaccagacagacaacaagaaggccatcacctacacctatgacctgatggccaacctggccttcatccggggccagctggagaatgctgagcagctgttcaaggccaccatgagctacctgctgggcggcggcatgaagcaggaggacaatgccatcatcgagatcagcctgaagctggccagcatctatgctgcccagaaccggcaggagtttgctgtggccggctatgagttctgcatcagcaccctggaggagaagattgaaagagagaaggagctggccgaggacatcatgtctgtggaggagaaggccaacacccacctgctgctgggcatgtgcctggatgcctgtgcccgctacctgctcttcagcaagcagcccagccaggcccagaggatgtatgagaaggccctgcagatcagcgaggagatccagggcgagcggcacccccagaccatcgtgctgatgtctgacctggccaccaccctggatgcccagggccgctttgatgaggcctacatctacatgcagagggccagtgacctggcccggcagatcaaccaccctgagctgcacatggtgctgagcaacctggccgctgtgctgatgcaccgggagcgctacacccaggccaaggagatctaccaggaggccctgaagcaggccaagctgaagaaggatgagatctctgtgcagcacatccgggaggagctggccgagctgagcaagaagagccggcccctgaccaacagcgtgaagctgtag

SEQ ID NO: 173067 - DNA, 501 bp, Artificial Sequence
  Description of Artificial Sequence: Synthetic coding sequence
tgacaggagcgggtgtggccagctgtgcggcggggccggggcggctccatgttccggctgctgtcctggagcctgggccggggcttcctgcgggctgctggaagacgctgccggggctgcagcgcccggctgctgcccggcctggccggcggccctggccctgaggtgcaggtgccccccagccgggtggccccccacggccggggccctggcctgctgcccctgctggccgccctggcctggttcagcaggcctgctgctgctgaggaggaggagcagcagggcgcagatggagctgctgctgaagatggagcagatgaggccgaggccgagatcatccagctgctgaagagggccaaggtgcggcggctgcgggccctgcggcctgctgagcggggcagcctgtgtgagcggggcctgggcgtggccgcccactacagcctgcggctggccgaggagtggatggaggccccccgggtgaagctgcccaggatgtcctag

SEQ ID NO: 173068 - DNA, 3951 bp, Artificial Sequence
  Description of Artificial Sequence: Synthetic coding sequence
atggacagccaggagctgaagaccctcatcaactactactgccaggagcgctacttccaccacgtgctgctggtggccagcgagggcatcaagagatatggcagtgaccctgtgttccgcttctaccacgcctacggcaccctgatggagggcaagacccaggaggccctgcgggagtttgaggccatcaagaacaagcaggatgtgtccctgtgcagcctgctggccctgatctatgcccacaagatgagccccaacccagaccgggaggccatcctggagagtgatgcccgggtgaaggagcagaggaagggggccggggagaaggccctgtaccacgccggcctcttcctgtggcacatcggcagacatgacaaggcccgggagtacatcgacaggatgatcaagatcagtgatggcagcaagcagggccacgtgctgaaggcctggctggacatcacccggggcaaggagccctacaccaagaaggccctgaagtactttgaggagggcctgcaggatggaaatgacacctttgccctgctgggcaaggcccagtgcctggagatgaggcagaactacagcggggccctggagaccgtgaaccagatcatcgtgaacttccccagcttcctgcctgcctttgtgaagaagatgaagctgcagctggccctgcaggactgggaccagacagtggagacagcccagaggctgctgctgcaggacagccagaatgtggaggccctgaggatgcaggccctgtactacgtgtgccgggagggggacatcgagaaggccagcaccaagctggagaacctgggcaacaccctggatgccatggagccccagaatgcccagctgttctacaacatcaccctggccttcagcaggacctgtggccgcagccagctgatcctgcagaagatccagaccctgctggagcgggccttcagcctgaacccccagcagagcgagtttgccacagagctgggctaccagatgatcctgcagggccgggtgaaggaggccctgaagtggtacaagacagccatgaccctggatgagacctctgtgtctgccctggtgggcttcatccagtgccagctgattgagggccagctgcaggatgctgaccagcagctggagttcctgaatgagatccagcagagcatcggcaagtctgctgagctgatctacctgcatgctgtgctggccatgaagaagaacaagaggcaggaggaggtgatcaacctgctgaatgatgtgctggacacccacttcagccagctggagggcctgcccctgggcatccagtactttgagaagctgaacccagacttcctgctggagatcgtgatggagtacctgtccttctgccccatgcagcctgccagccctggccagcccctgtgccccctgctgcggcgctgcatctctgtgctggagaccgtggtgaggacagtgcccggcctgctgcagaccgtcttcctgattgccaaggtgaagtacctgagcggggacatcgaggccgccttcaacaacctgcagcactgcctggagcacaaccccagctatgcagatgcccacctgctgctggcccaggtgtacctgagccaggagaaggtgaagctgtgcagccagagcctggagctgtgcctgtcctatgacttcaaggtgcgggactaccccctgtaccacctgatcaaggcccagagccagaagaagatgggagaaattgctgatgccatcaagaccctgcacatggccatgagcctgcccggcatgaagagaattggagccagcaccaagagcaaggacaggaagacagaggtggacaccagccaccggctgagcatcttcctggagctgattgatgtgcaccggctgaatggagagcagcacgaggccaccaaggtgctgcaggatgccatccacgagttcagcggcaccagcgaggaggtgcgggtgaccatcgccaatgctgacctggccctggcccagggcgacatcgagcgggccctgagcatcctgcagaatgtgacagctgagcagccctacttcatcgaggcccgggagaagatggctgacatctacctgaagcacaggaaggacaagatgctgtacatcacctgcttccgggagattgctgagaggatggccaaccccaggagcttcctgctgctgggagatgcctacatgaacatcctggagcctgaggaggccatcgtggcctatgagcaggccctgaaccagaaccccaaggatggcaccctggccagcaagatgggcaaggccctgatcaagacccacaactacagcatggccatcacctactatgaagctgccctgaagacaggccagaagaactacctgtgctatgacctggccgagctgctgctgaagctgaagtggtatgacaaggccgagaaggtgctgcagcacgccctggcccacgagcctgtgaatgagctgagcgccctgatggaggatggccgctgccaggtgctgctggccaaggtgtacagcaagatggagaagctgggagatgccatcacagccctgcagcaggcccgggagctgcaggcccgggtgctgaagagggtgcagatggagcagccagatgctgtgcctgcccagaagcacctggccgctgagatctgtgccgagatcgccaagcacagcgtggcccagagggactatgagaaggccatcaagttctaccgggaggccctggtgcactgtgaaacagacaacaagatcatgctggagctggcccggctgtacctggcccaggatgatcctgacagctgcctgcggcagtgtgccctgctgctgcagagcgaccaggacaatgaagctgccaccatgatgatggctgacctgatgttcaggaagcaggactatgagcaggccgtgttccacctgcagcagctgctggagaggaagccagacaactacatgaccctgagccggctgattgacctgctgcggcgctgtgggaagctggaggatgtgccccgcttcttctccatggccgagaagaggaacagccgggccaagctggagcccggcttccagtactgcaagggcctgtacctgtggtacaccggggagcccaatgatgccctgcggcacttcaacaaggccaggaaggaccgggactggggccagaatgccctgtacaacatgattgagatctgcctgaacccagacaatgagaccgtgggcggggaggtgtttgagaacctggatggagacctgggcaacagcacagagaagcaggagagcgtgcagctggccgtgaggacagctgagaagctgctgaaggagctgaagccccagacagtgcagggccacgtgcagctgcgcatcatggagaactactgcctgatggccaccaagcagaagagcaatgtggagcaggccctgaacaccttcacagaaattgctgccagcgagaaggagcacatcccagccctgctgggcatggccacagcctacatgatcctgaagcagaccccccgggccaggaaccagctgaagagaattgccaagatgaactggaatgccattgatgctgaggagtttgagaagtcctggctgctgctggccgacatctacatccagagcgccaagtatgacatggccgaggacctgctgaagcgctgcctgcggcacaacagaagctgctgcaaggcctatgagtacatgggctacatcatggagaaggagcaggcctacacagatgctgccctgaactatgagatggcctggaagtacagcaacagaaccaacccagctgtgggctacaagctggccttcaactacctgaaggccaagcgctacgtggacagcattgacatctgccaccaggtgctggaggcccaccccacctaccccaagatcaggaaggacatcctggacaaggcccgggccagcctgcggccctag

SEQ ID NO: 173069 - DNA, 765 bp, Artificial Sequence
  Description of Artificial Sequence: Synthetic coding sequence
atgattgagatctgcctgaacccagacaatgagaccgtgggcggggaggtgtttgagaacctggatggagacctgggcaacagcacagagaagcaggagagcgtgcagctggccgtgaggacagctgagaagctgctgaaggagctgaagccccagacagtgcagggccacgtgcagctgcgcatcatggagaactactgcctgatggccaccaagcagaagagcaatgtggagcaggccctgaacaccttcacagaaattgctgccagcgagaaggagcacatcccagccctgctgggcatggccacagcctacatgatcctgaagcagaccccccgggccaggaaccagctgaagagaattgccaagatgaactggaatgccattgatgctgaggagtttgagaagtcctggctgctgctggccgacatctacatccagagcgccaagtatgacatggccgaggacctgctgaagcgctgcctgcggcacaacagaagctgctgcaaggcctatgagtacatgggctacatcatggagaaggagcaggcctacacagatgctgccctgaactatgagatggcctggaagtacagcaacagaaccaacccagctgtgggctacaagctggccttcaactacctgaaggccaagcgctacgtggacagcattgacatctgccaccaggtgctggaggcccaccccacctaccccaagatcaggaaggacatcctggacaaggcccgggccagcctgcggccctag

SEQ ID NO: 173070 - DNA, 6078 bp, Artificial Sequence
  Description of Artificial Sequence: Synthetic coding sequence
atggacaactttgctgagggggacttcaccgtggccgactatgccctgctggaggactgcccccacgtggatgactgtgtgtttgctgctgagttcatgagcaatgactatgtgcgggtgacccagctgtactgtgatggagtgggcgtgcagtacaaggactacatccagagcgagaggaacctggagtttgacatctgcagcatctggtgcagcaagcccatctctgtgctgcaggactactgtgatgccatcaagatcaacatcttctggcccctgctcttccagcaccagaacagcagcgtcatcagccggctgcacccctgtgtggatgccaacaacagccgggccagcgagatcaacctgaagaagctgcagcacctggagctgatggaggacatcgtggacctggccaagaaggtggccaatgacagcttcctgattggaggcctgctgcgcatcggctgcaagattgagaacaagatcctggccatggaggaggccctgaactggatcaagtatgctggagatgtgaccatcctgaccaagctgggcagcattgacaactgctggcccatgctgagcatcttcttcacagagtacaagtaccacatcaccaagatcgtgatggaggactgcaacctgctggaggagctgaagacccagagctgcatggactgcatcgaggagggggagctgatgaagatgaagggaaatgaggagttcagcaaggagagatttgatattgccatcatctactacacccgggccatcgagtacagacctgagaactacctgctgtatggcaacagagccctgtgcttcctgaggacaggccagttcagaaatgccctgggagatggcaagagggccaccatcctgaagaacacctggcccaagggccactaccgctactgtgatgccctgtccatgctgggggagtatgactgggccctgcaggccaacatcaaggcccagaagctgtgcaagaatgaccctgagggcatcaaggacctgatccagcagcacgtgaagctgcagaagcagatcgaggacctgcagggccgcacagccaacaaggaccccatcaaggccttctatgagaacagagcctacacccccaggagcctgagcgcccccatcttcaccaccagcctgaactttgtggagaaggagcgggacttcaggaagatcaaccacgagatggccaacggcggcaaccagaacctgaaggtggctgatgaggccctgaaggtggatgactgtgactgccaccctgagttcagcccccccagcagccagccccccaagcacaagggcaagcagaagagcagaaataatgaaagtgagaagttcagcagcagcagccccctgaccctgcctgctgacctgaagaacatcctggagaagcagttcagcaagagcagccgggccgcccaccaggactttgccaacatcatgaagatgctgcggagcctcatccaggacggctacatggccctgctggagcagcgctgccgctctgctgcccaggccttcacagagctgctgaatggcctggacccccagaagatcaagcagctgaacctggccatgatcaactacgtgctggtggtgtatggcctggccatcagcctgctgggcatcggccagcctgaggagctgtctgaggccgagaaccagttcaagaggatcatcgagcactaccccagcgagggcctggactgcctggcctactgcggcatcggcaaggtgtacctgaagaagaaccgcttcctggaggccctgaaccactttgagaaggcccggaccctcatctaccgcctgcccggggtgctgacctggcccaccagcaatgtcatcatcgaggagagccagccccagaagatcaagatgctgctggagaagtttgtggaggagtgcaagttcccccctgtgcctgatgccatctgctgctaccagaagtgccacggctacagcaagatccagatctacatcacagatcctgacttcaagggcttcatccgcatcagctgctgccagtactgcaagattgagttccacatgaactgctggaagaagctgaagaccaccaccttcaatgacaagattgacaaggacttcctgcagggcatctgcctgaccccagactgtgagggcgtcatcagcaagatcatcatcttcagcagcggcggggaggtgaagtgtgaatttgagcacaaggtgatcaaggagaaggtgcccccccggcccatcctgaagcagaagtgcagcagcctggagaagctgcggctgaaggaggacaagaagctgaagaggaagatccagaagaaggaggccaagaagctggcccaggagaggatggaggaggacctgcgggagagcaacccccccaagaatgaggagcagaaggagaccgtggacaacgtgcagcgctgccagttcctggatgaccgcatcctgcagtgcatcaagcagtatgctgacaagatcaagagcggcatccagaacacagccatgctgctgaaggagctgctgtcctggaaggtgctgagcacagaggactacaccacctgcttcagcagcaggaacttcctgaatgaagctgtggactatgtgatccgccacctgatccaggagaacaacagagtgaagacccgcatcttcctgcacgtgctgtctgagctgaaggaggtggagcccaagctggccgcctggatccagaagctgaacagctttggcctggatgccaccggcaccttcttcagccgctatggagccagcctgaagctgctggacttcagcatcatgaccttcctgtggaatgagaagtatggccacaagctggacagcattgagggcaagcagctggactacttcagcgagcccgccagcctgaaggaggcccgctgcctgatctggctgctggaggagcaccgggacaagtttcctgccctgcacagcgccctggatgagttctttgacatcatggacagccgctgcaccgtgctgaggaagcaggacagcggggaggcccccttcagcagcaccaaggtgaagaacaagagcaagaagaagaagcccaaggacagcaagcccatgctggtgggcagcggcaccacctctgtgaccagcaacaatgagatcatcaccagcagcgaggaccacagcaacagaaacagcgacagcgctggcccctttgctgtgcctgaccacctgcggcaggatgtggaggagtttgaggccctgtatgaccagcacagcaatgaatatgtggtgaggaacaagaagctgtgggacatgaaccccaagcagaagtgcagcaccctgtatgactacttcagccagttcctggaggagcacggccccctggacatgagcaacaagatgttttctgcagaatatgagttcttccctgaggagacccggcagatcctggagaaggccggcggcctgaagcccttcctgctgggctgccccaggtttgtggtgattgacaactgcatcgccctgaagaaggtggccagccggctgaagaagaagaggaagaagaagaacatcaagaccaaggtggaggagatcagcaaggccggggagtatgtgcgggtgaagctgcagctgaacccagctgcccgggagttcaagccagatgtgaagagcaagcctgtgtctgacagcagcagcgccccagcctttgaaaatgtgaagcccaagcctgtgtctgccaacagccccaagccagcctgtgaagatgtgaaggccaagcctgtgtctgacaacagcagccggcaggtgtctgaagatggccagcccaagggcgtgagcagcaacagccccaagccaggctctgaagatgccaactacaagagggtgtcctgcaacagccccaagcctgtgctggaggatgtgaagcccacctactgggcccagagccacctggtgacaggctactgcacctacctgcccttccagagatttgacatcacccagaccccaccagcctacatcaacgtgctgcccggcctgccccagtacaccagcatctacacccccctggccagcctgagccctgagtaccagctgcccaggtctgtgcctgtggtgcccagctttgtggccaatgacagagctgacaagaatgctgctgcctactttgagggccaccacctgaatgcagaaaatgtggccggccaccagatcgccagcgagacccagatcctggagggcagcctgggcatctctgtgaagagccactgcagcactggagatgcccacacagtgctgtctgagagcaacagaaatgatgagcactgcggcaacagcaacaacaagtgtgaggtgattcctgagagcaccagcgctgtgaccaacatcccccacgtgcagatggtggccatccaggtgtcctggaacatcatccaccaggaggtgaacacagagccctacaacccctttgaggagcggcagggcgagatcagcagaattgagaaggagcaccaggtgctgcaggaccagctgcaggaggtgtatgaaaattatgagcagatcaagctgaagggcctggaggagacccgggacctggaggagaagctgaagaggcacctggaggagaacaagatcagcaagacagagctggactggttcctgcaggacctggagcgggagatcaagaagtggcagcaggagaagaaggagatccaggagcggctgaagagcctgaagaagaagatcaagaaggtgtccaatgccagcgagatgtacacccagaagaatgatggcaaggagaaggagcacgagctgcacctggaccagagcctggagatcagcaacaccctgaccaatgagaagatgaagattgaggagtacatcaagaagggcaaggaggactatgaggagagccaccagagagctgtggccgctgaggtgtctgtgctggagaactggaaggagagcgaggtgtacaagctgcagatcatggagagccaggccgaggccttcctgaagaagctgggcctcatcagccgggaccctgctgcctacccagacatggagagtgacatccgctcctgggagctgttcctgagcaatgtgaccaaggagattgagaaggccaagagccagtttgaggagcagatcaaggccatcaagaatggcagccggctgtctgagctgagcaaggtgcagatcagcgagctgtccttccctgcctgcaacacagtgcaccctgagctgctgcctgagagcagtggagatgatggccagggcctggtgaccagcgccagtgatgtgacaggcaaccacgccgccctgcaccgggaccccagcgtcttctctgctggggacagccctggagaggcccccagcgccctgctgcccggccccccacctggccagcctgaggccacccagctgaccggccccaagagagctggccaggccgccctgtctgagaggagccctgtggccgacaggaagcagcctgtgcccccaggccgggccgcccggagcagccagagccccaagaagcccttcaacagcatcatcgagcacctgtctgtggtgttcccctgctacaacagcacagagctggccggcttcatcaagaaggtgcgcagcaagaacaagaacagcctgagcggcctgagcattgatgagatcgtgcagagggtgacagagcacatcctggatgagcagaagaagaagaagcccaaccctgggaaggacaagaggacctatgagcccagcagcgccacccctgtgaccaggagcagccagggcagccccagcgtggtggtggcccccagccccaagaccaagggccagaaggccgaggatgtgcctgtgcgcatcgccctgggcgccagcagctgtgagatctgccacgaggtgttcaagagcaagaatgtgcgggtgctgaagtgtggccacaagtaccacaagggctgcttcaagcagtggctgaagggccagagcgcctgcccagcctgccagggccgggacctgctgacagaggagagccccagcggccggggctggcccagccagaaccaggagctgcccagctgcagcagcaggtag

SEQ ID NO: 173071 - DNA, 6078 bp, Artificial Sequence; identical to SEQ ID NO: 173070
  Description of Artificial Sequence: Synthetic coding sequence

SEQ ID NO: 173072 - DNA, 6078 bp, Artificial Sequence; identical to SEQ ID NO: 173070
  Description of Artificial Sequence: Synthetic coding sequence

SEQ ID NO: 173073 - DNA, 3540 bp, Artificial Sequence
  Description of Artificial Sequence: Synthetic coding sequence
atggacaactttgctgagggggacttcaccgtggccgactatgccctgctggaggactgcccccacgtggatgactgtgtgtttgctgctgagttcatgagcaatgactatgtgcgggtgacccagctgtactgtgatggagtgggcgtgcagtacaaggactacatccagagcgagaggaacctggagtttgacatctgcagcatctggtgcagcaagcccatctctgtgctgcaggactactgtgatgccatcaagatcaacatcttctggcccctgctcttccagcaccagaacagcagcgtcatcagccggctgcacccctgtgtggatgccaacaacagccgggccagcgagatcaacctgaagaagctgcagcacctggagctgatggaggacatcgtggacctggccaagaaggtggccaatgacagcttcctgattggaggcctgctgcgcatcggctgcaagattgagaacaagatcctggccatggaggaggccctgaactggatcaagtatgctggagatgtgaccatcctgaccaagctgggcagcattgacaactgctggcccatgctgagcatcttcttcacagagtacaagtaccacatcaccaagatcgtgatggaggactgcaacctgctggaggagctgaagacccagagctgcatggactgcatcgaggagggggagctgatgaagatgaagggaaatgaggagttcagcaaggagagatttgatattgccatcatctactacacccgggccatcgagtacagacctgagaactacctgctgtatggcaacagagccctgtgcttcctgaggacaggccagttcagaaatgccctgggagatggcaagagggccaccatcctgaagaacacctggcccaagggccactaccgctactgtgatgccctgtccatgctgggggagtatgactgggccctgcaggccaacatcaaggcccagaagctgtgcaagaatgaccctgagggcatcaaggacctgatccagcagcacgtgaagctgcagaagcagatcgaggacctgcagggccgcacagccaacaaggaccccatcaaggccttctatgagaacagagcctacacccccaggagcctgagcgcccccatcttcaccaccagcctgaactttgtggagaaggagcgggacttcaggaagatcaaccacgagatggccaacggcggcaaccagaacctgaaggtggctgatgaggccctgaaggtggatgactgtgactgccaccctgagttcagcccccccagcagccagccccccaagcacaagggcaagcagaagagcagaaataatgaaagtgagaagttcagcagcagcagccccctgaccctgcctgctgacctgaagaacatcctggagaagcagttcagcaagagcagccgggccgcccaccaggactttgccaacatcatgaagatgctgcggagcctcatccaggacggctacatggccctgctggagcagcgctgccgctctgctgcccaggccttcacagagctgctgaatggcctggacccccagaagatcaagcagctgaacctggccatgatcaactacgtgctggtggtgtatggcctggccatcagcctgctgggcatcggccagcctgaggagctgtctgaggccgagaaccagttcaagaggatcatcgagcactaccccagcgagggcctggactgcctggcctactgcggcatcggcaaggtgtacctgaagaagaaccgcttcctggaggccctgaaccactttgagaaggcccggaccctcatctaccgcctgcccggggtgctgacctggcccaccagcaatgtcatcatcgaggagagccagccccagaagatcaagatgctgctggagaagtttgtggaggagtgcaagttcccccctgtgcctgatgccatctgctgctaccagaagtgccacggctacagcaagatccagatctacatcacagatcctgacttcaagggcttcatccgcatcagctgctgccagtactgcaagattgagttccacatgaactgctggaagaagctgaagaccaccaccttcaatgacaagattgacaaggacttcctgcagggcatctgcctgaccccagactgtgagggcgtcatcagcaagatcatcatcttcagcagcggcggggaggtgaagtgtgaatttgagcacaaggtgatcaaggagaaggtgcccccccggcccatcctgaagcagaagtgcagcagcctggagaagctgcggctgaaggaggacaagaagctgaagaggaagatccagaagaaggaggccaagaagctggcccaggagaggatggaggaggacctgcgggagagcaacccccccaagaatgaggagcagaaggagaccgtggacaacgtgcagcgctgccagttcctggatgaccgcatcctgcagtgcatcaagcagtatgctgacaagatcaagagcggcatccagaacacagccatgctgctgaaggagctgctgtcctggaaggtgctgagcacagaggactacaccacctgcttcagcagcaggaacttcctgaatgaagctgtggactatgtgatccgccacctgatccaggagaacaacagagtgaagacccgcatcttcctgcacgtgctgtctgagctgaaggaggtggagcccaagctggccgcctggatccagaagctgaacagctttggcctggatgccaccggcaccttcttcagccgctatggagccagcctgaagctgctggacttcagcatcatgaccttcctgtggaatgagaagtatggccacaagctggacagcattgagggcaagcagctggactacttcagcgagcccgccagcctgaaggaggcccgctgcctgatctggctgctggaggagcaccgggacaagtttcctgccctgcacagcgccctggatgagttctttgacatcatggacagccgctgcaccgtgctgaggaagcaggacagcggggaggcccccttcagcagcaccaaggtgaagaacaagagcaagaagaagaagcccaaggacagcaagcccatgctggtgggcagcggcaccacctctgtgaccagcaacaatgagatcatcaccagcagcgaggaccacagcaacagaaacagcgacagcgctggcccctttgctgtgcctgaccacctgcggcaggatgtggaggagtttgaggccctgtatgaccagcacagcaatgaatatgtggtgaggaacaagaagctgtgggacatgaaccccaagcagaagtgcagcaccctgtatgactacttcagccagttcctggaggagcacggccccctggacatgagcaacaagatgttttctgcagaatatgagttcttccctgaggagacccggcagatcctggagaaggccggcggcctgaagcccttcctgctgggctgccccaggtttgtggtgattgacaactgcatcgccctgaagaaggtggccagccggctgaagtag

SEQ ID NO: 173074 - DNA, 2343 bp, Artificial Sequence
  Description of Artificial Sequence: Synthetic coding sequence
atggacaactttgctgagggggacttcaccgtggccgactatgccctgctggaggactgcccccacgtggatgactgtgtgtttgctgctgagttcatgagcaatgactatgtgcgggtgacccagctgtactgtgatggagtgggcgtgcagtacaaggactacatccagagcgagaggaacctggagtttgacatctgcagcatctggtgcagcaagcccatctctgtgctgcaggactactgtgatgccatcaagatcaacatcttctggcccctgctcttccagcaccagaacagcagcgtcatcagccggctgcacccctgtgtggatgccaacaacagccgggccagcgagatcaacctgaagaagctgcagcacctggagctgatggaggacatcgtggacctggccaagaaggtggccaatgacagcttcctgattggaggcctgctgcgcatcggctgcaagattgagaacaagatcctggccatggaggaggccctgaactggatcaagtatgctggagatgtgaccatcctgaccaagctgggcagcattgacaactgctggcccatgctgagcatcttcttcacagagtacaagtaccacatcaccaagatcgtgatggaggactgcaacctgctggaggagctgaagacccagagctgcatggactgcatcgaggagggggagctgatgaagatgaagggaaatgaggagttcagcaaggagagatttgatattgccatcatctactacacccgggccatcgagtacagacctgagaactacctgctgtatggcaacagagccctgtgcttcctgaggacaggccagttcagaaatgccctgggagatggcaagagggccaccatcctgaagaacacctggcccaagggccactaccgctactgtgatgccctgtccatgctgggggagtatgactgggccctgcaggccaacatcaaggcccagaagctgtgcaagaatgaccctgagggcatcaaggacctgatccagcagcacgtgaagctgcagaagcagatcgaggacctgcagggccgcacagccaacaaggaccccatcaaggccttctatgagaacagagcctacacccccaggagcctgagcgcccccatcttcaccaccagcctgaactttgtggagaaggagcgggacttcaggaagatcaaccacgagatggccaacggcggcaaccagaacctgaaggtggctgatgaggccctgaaggtggatgactgtgactgccaccctgagttcagcccccccagcagccagccccccaagcacaagggcaagcagaagagcagaaataatgaaagtgagaagttcagcagcagcagccccctgaccctgcctgctgacctgaagaacatcctggagaagcagttcagcaagagcagccgggccgcccaccaggactttgccaacatcatgaagatgctgcggagcctcatccaggacggctacatggccctgctggagcagcgctgccgctctgctgcccaggccttcacagagctgctgaatggcctggacccccagaagatcaagcagctgaacctggccatgatcaactacgtgctggtggtgtatggcctggccatcagcctgctgggcatcggccagcctgaggagctgtctgaggccgagaaccagttcaagaggatcatcgagcactaccccagcgagggcctggactgcctggcctactgcggcatcggcaaggtgtacctgaagaagaaccgcttcctggaggccctgaaccactttgagaaggcccggaccctcatctaccgcctgcccggggtgctgacctggcccaccagcaatgtcatcatcgaggagagccagccccagaagatcaagatgctgctggagaagtttgtggaggagtgcaagttcccccctgtgcctgatgccatctgctgctaccagaagtgccacggctacagcaagatccagatctacatcacagatcctgacttcaagggcttcatccgcatcagctgctgccagtactgcaagattgagttccacatgaactgctggaagaagctgaagaccaccaccttcaatgacaagattgacaaggacttcctgcagggcatctgcctgaccccagactgtgagggcgtcatcagcaagatcatcatcttcagcagcggcggggaggtgaagtgtgaatttgagcacaaggtgatcaaggagaaggtgcccccccggcccatcctgaagcagaagtgcagcagcctggagaagctgcggctgaaggaggacaagaagctgaagaggaagatccagaagaaggaggcctag

SEQ ID NO: 173075 - DNA, 1839 bp, Artificial Sequence
  Description of Artificial Sequence: Synthetic coding sequence
atgctgggggagtatgactgggccctgcaggccaacatcaaggcccagaagctgtgcaagaatgaccctgagggcatcaaggacctgatccagcagcacgtgaagctgcagaagcagatcgaggacctgcagggccgcacagccaacaaggaccccatcaaggccttctatgagaacagagcctacacccccaggagcctgagcgcccccatcttcaccaccagcctgaactttgtggagaaggagcgggacttcaggaagatcaaccacgagatggccaacggcggcaaccagaacctgaaggtggctgatgaggccctgaaggtggatgactgtgactgccaccctgagttcagcccccccagcagccagccccccaagcacaagggcaagcagaagagcagaaataatgaaagtgagaagttcagcagcagcagccccctgaccctgcctgctgacctgaagaacatcctggagaagcagttcagcaagagcagccgggccgcccaccaggactttgccaacatcatgaagatgctgcggagcctcatccaggacggctacatggccctgctggagcagcgctgccgctctgctgcccaggccttcacagagctgctgaatggcctggacccccagaagatcaagcagctgaacctggccatgatcaactacgtgctggtggtgtatggcctggccatcagcctgctgggcatcggccagcctgaggagctgtctgaggccgagaaccagttcaagaggatcatcgagcactaccccagcgagggcctggactgcctggcctactgcggcatcggcaaggtgtacctgaagaagaaccgcttcctggaggccctgaaccactttgagaaggcccggaccctcatctaccgcctgcccggggtgctgacctggcccaccagcaatgtcatcatcgaggagagccagccccagaagatcaagatgctgctggagaagtttgtggaggagtgcaagttcccccctgtgcctgatgccatctgctgctaccagaagtgccacggctacagcaagatccagatctacatcacagatcctgacttcaagggcttcatccgcatcagctgctgccagtactgcaagattgagttccacatgaactgctggaagaagctgaagaccaccaccttcaatgacaagattgacaaggacttcctgcagggcatctgcctgaccccagactgtgagggcgtcatcagcaagatcatcatcttcagcagcggcggggaggtgaagtgtgaatttgagcacaaggtgatcaaggagaaggtgcccccccggcccatcctgaagcagaagtgcagcagcctggagaagctgcggctgaaggaggacaagaagctgaagaggaagatccagaagaaggaggccaagaagctggcccaggagaggatggaggaggacctgcgggagagcaacccccccaagaatgaggagcagaaggagaccgtggacaacgtgcagcgctgccagttcctggatgaccgcatcctgcagtgcatcaagcagtatgctgacaagatcaagagcggcatccagaacacagccatgctgctgaaggagctgctgtcctggaaggtgctgagcacagaggactacaccacctgcttcagcagcaggaacttcctgaatgaagctgtggactatgtgatccgccacctgatccaggagaacaacagagtgaagacccgcatcttcctgcacgtgctgtctgagctgaaggaggtggagcccaagctggccgcctggatccagaagctgaacagctttggcatgagcctgtacatccctgagcagtag

SEQ ID NO: 173076 - DNA, 1842 bp, Artificial Sequence
  Description of Artificial Sequence: Synthetic coding sequence
atggatgctgtgctggcctgccgcctgcggggccggggcaacagagtggccgccctgcggccccggcccaggcctgggggcagcgctggccccagcccctttgccctgctgtgtgccggcctgagccctgagcccagggctggggtgggcagcgagttccctgcctggttcctgggcggcagcagccagaggaggaacatggccctgctgggcagcagagctgagctggaggctgatgaagatgtgtttgaagatgccctggagaccatctccatggccaaggagagcatgtaccacgccctgggctacagcaccatcgtggtgctgcaggccgtgctgacctttgagcagcaggacatccagaatggcatcagcgccatgaaggatgccctgcagacctgccagaagtacaggaagaagtacacagtggtggagagcttcagcagcctgctgagccggggcagcctggagcagctgtctgaggaggagatgcacgccgagatctgctacgccgagtgcctgctgcagaaggccgccctgacctttgtgcaggatgagaacatgatcaacttcatcaagggcggcctgaagatccgcaccagctaccagatctacaaggaatgtctgagcatcctgcacgagatccagaagaacaagctgcagcaggagttcttctatgaatttgagggcggcgtgaagctgggcagcggggccttcaacctgatgctgagcctgctgcctgcccgcatcatccggctgctggagttcatcggcttcagcggcaaccgggagctgggcctgctgcagctgcgggagggcgccagcggccgctccatgaggtctgccctgtgctgcctgaccatcctggccttccacacctacatcagcctcatcctgggcactggagaggtgaatgtggccgaggccgagcggctgctggcccccttcctgcagcagttccccaacggcagcctggtgctcttctaccacgccagaattgagctgctgaagggcaacctggaggaggcccaggaggtgttccagaagtgcatctctgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgtccatgctgcctgaagaagatgtggtggccaccaatgaaaatgtggtgaccctcttccggcaggtggacagcctgaagcagagaattgctgggaagagcatccccacagagaagtttgctgtgaggaaggcccggcgctacagcgccagcctgcctgcccctgtgaagctgatcctgcctgccctggagatgatgtatgtgtggaatggcttcagcatcgtgtccaagaggaaggacctgtctgagaacctgctggtgacagtggagaaggccgaggccgccctgcagagccagaacttcaacagcttctctgtggatgatgaatgtctggtgaagctgctgaagggctgctgcctgaagaacctgcagaggcccctgcaggccgagctgtgctacaaccacgtggtggagagcgagaagctgctgaagtatgaccactacctggtgcccttcaccctgtttgagctggccagcctgtacaagagccagggcgagattgacaaggccatcaagttcctggagacagccaggaacaactacaaggactacagcctggagagccggctgcacttccgcatccaggccgccctgcacctgtggaggaagcccagcagtgactag

SEQ ID NO: 173077 - DNA, 1851 bp, Artificial Sequence
  Description of Artificial Sequence: Synthetic coding sequence
atggccctgctgggcagcagagctgagctggaggctgatgaagatgtgtttgaagatgccctggagaccatcagcatcagcagccacagcgacatggccaccagcagcctgcactttgccagctgtgacacccagcaggccccccggcagagaggagccagcacagtgagcagcagcagcagcaccaaggtggacctgaagagcggcctggaggagtgtgctgtggccctgaacctcttcctgagcaacaagttcacagatgccctggagctgctgcggccctgggccaaggagagcatgtaccacgccctgggctacagcaccatcgtggtgctgcaggccgtgctgacctttgagcagcaggacatccagaatggcatcagcgccatgaaggatgccctgcagacctgccagaagtacaggaagaagtacacagtggtggagagcttcagcagcctgctgagccggggcagcctggagcagctgtctgaggaggagatgcatgctgagatctgctacgcagaatgtctgctgcagaaggccgccctgacctttgtgcaggatgagaacatgatcaacttcatcaagggcggcctgaagatccgcaccagctaccagatctacaaggagtgcctgagcatcctgcacgagatccagaagaacaagctgcagcaggagttcttctatgaatttgaaggaggagtgaagctgggcagcggggccttcaacctgatgctgagcctgctgcctgcccgcatcatccggctgctggagttcatcggcttcagcggcaaccgggagctgggcctgctgcagctgcgggagggcgccagcggccgctccatgaggtctgccctgtgctgcctgaccatcctggccttccacacctacatcagcctcatcctgggcaccggggaggtgaatgtggccgaggccgagcggctgctggcccccttcctgcagcagttccccaacggcagcctggtgctcttctaccacgcccgcatcgagctgctgaagggcaacctggaggaggcccaggaggtgttccagaagtgcatctctgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgtccatgctgcctgaggaggatgtggtggccaccaatgaaaatgtggtgaccctcttccggcaggtggacagcctgaagcagagaattgctgggaagagcatccccacagagaagtttgctgtgaggaaggcccggcgctacagcgccagcctgcctgcccctgtgaagctgatcctgcctgccctggagatgatgtatgtgtggaatggcttcagcatcgtgtccaagaggaaggacctgtctgagaacctgctggtgacagtggagaaggccgaggccgccctgcagagccagaacttcaacagcttctctgtggatgatgagtgcctggtgaagctgctgaagggctgctgcctgaagaacctgcagaggcccctgcaggccgagctgtgctacaaccacgtggtggagagcgagaagctgctgaagtatgaccactacctggtgcccttcaccctgtttgagctggccagcctgtacaagagccagggcgagattgacaaggccatcaagttcctggagacagccaggaacaactacaaggactacagcctggagagccggctgcacttccgcatccaggccgccctgcacctgtggaggaagcccagcagtgactag

SEQ ID NO: 173078 - DNA, 2010 bp, Artificial Sequence
  Description of Artificial Sequence: Synthetic coding sequence
atggatgctgtgctggcctgccgcctgcggggccggggcaacagagtggccgccctgcggccccggcccaggcctgggggcagcgctggccccagcccctttgccctgctgtgtgccggcctgagccctgagcccagggctggggtgggcagcgagttccctgcctggttcctgggcggcagcagccagaggaggaacatggccctgctgggcagcagagctgagctggaggctgatgaagatgtgtttgaagatgccctggagaccatcagcatcagcagccacagcgacatggccaccagcagcctgcactttgccagctgtgacacccagcaggccccccggcagagaggagccagcacagtgagcagcagcagcagcaccaaggtggacctgaagagcggcctggaggagtgtgctgtggccctgaacctcttcctgagcaacaagttcacagatgccctggagctgctgcggccctgggccaaggagagcatgtaccacgccctgggctacagcaccatcgtggtgctgcaggccgtgctgacctttgagcagcaggacatccagaatggcatcagcgccatgaaggatgccctgcagacctgccagaagtacaggaagaagtacacagtggtggagagcttcagcagcctgctgagccggggcagcctggagcagctgtctgaggaggagatgcatgctgagatctgctacgcagaatgtctgctgcagaaggccgccctgacctttgtgcaggatgagaacatgatcaacttcatcaagggcggcctgaagatccgcaccagctaccagatctacaaggagtgcctgagcatcctgcacgagatccagaagaacaagctgcagcaggagttcttctatgaatttgaaggaggagtgaagctgggcagcggggccttcaacctgatgctgagcctgctgcctgcccgcatcatccggctgctggagttcatcggcttcagcggcaaccgggagctgggcctgctgcagctgcgggagggcgccagcggccgctccatgaggtctgccctgtgctgcctgaccatcctggccttccacacctacatcagcctcatcctgggcaccggggaggtgaatgtggccgaggccgagcggctgctggcccccttcctgcagcagttccccaacgtgcgcagcgtcttccagagcgcccaggaggtgttccagaagtgcatctctgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgtccatgctgcctgaagaagatgtggtggccaccaatgaaaatgtggtgaccctcttccggcaggtggacagcctgaagcagagaattgctgggaagagcatccccacagagaagtttgctgtgaggaaggcccggcgctacagcgccagcctgcctgcccctgtgaagctgatcctgcctgccctggagatgatgtatgtgtggaatggcttcagcatcgtgtccaagaggaaggacctgtctgagaacctgctggtgacagtggagaaggccgaggccgccctgcagagccagaacttcaacagcttctctgtggatgatgaatgtctggtgaagctgctgaagggctgctgcctgaagaacctgcagaggcccctgcaggccgagctgtgctacaaccacgtggtggagagcgagaagctgctgaagtatgaccactacctggtgcccttcaccctgtttgagctggccagcctgtacaagagccagggcgagattgacaaggccatcaagttcctggagacagccaggaacaactacaaggactacagcctggagagccggctgcacttccgcatccaggccgccctgcacctgtggaggaagcccagcagtgactag

SEQ ID NO: 173079 - DNA, 2049 bp, Artificial Sequence
  Description of Artificial Sequence: Synthetic coding sequence
atggatgctgtgctggcctgccgcctgcggggccggggcaacagagtggccgccctgcggccccggcccaggcctgggggcagcgctggccccagcccctttgccctgctgtgtgccggcctgagccctgagcccagggctggggtgggcagcgagttccctgcctggttcctgggcggcagcagccagaggaggaacatggccctgctgggcagcagagctgagctggaggctgatgaagatgtgtttgaagatgccctggagaccatcagcatcagcagccacagcgacatggccaccagcagcctgcactttgccagctgtgacacccagcaggccccccggcagagaggagccagcacagtgagcagcagcagcagcaccaaggtggacctgaagagcggcctggaggagtgtgctgtggccctgaacctcttcctgagcaacaagttcacagatgccctggagctgctgcggccctgggccaaggagagcatgtaccacgccctgggctacagcaccatcgtggtgctgcaggccgtgctgacctttgagcagcaggacatccagaatggcatcagcgccatgaaggatgccctgcagacctgccagaagtacaggaagaagtacacagtggtggagagcttcagcagcctgctgagccggggcagcctggagcagctgtctgaggaggagatgcatgctgagatctgctacgcagaatgtctgctgcagaaggccgccctgacctttgtgcaggatgagaacatgatcaacttcatcaagggcggcctgaagatccgcaccagctaccagatctacaaggagtgcctgagcatcctgcacgagatccagaagaacaagctgcagcaggagttcttctatgaatttgaaggaggagtgaagctgggcagcggggccttcaacctgatgctgagcctgctgcctgcccgcatcatccggctgctggagttcatcggcttcagcggcaaccgggagctgggcctgctgcagctgcgggagggcgccagcggccgctccatgaggtctgccctgtgctgcctgaccatcctggccttccacacctacatcagcctcatcctgggcaccggggaggtgaatgtggccgaggccgagcggctgctggcccccttcctgcagcagttccccaacggcagcctggtgctcttctaccacgcccgcatcgagctgctgaagggcaacctggaggaggcccaggaggtgttccagaagtgcatctctgtgcaggaggagtggaagcagttccaccacctgtgctactgggagctgatgtggatcaacgtgttccagcagaactggatgcaggcctactactacagcgacctgctgtgcaaggagagcaagtggagcaaggccacctacgtgttcctgaaggccgccatcctgtccatgctgcctgaggaggatgtggtggccaccaatgaaaatgtggtgaccctcttccggcaggtggacagcctgaagcagagaattgctgggaagagcatccccacagagaagtttgctgtgaggaaggcccggcgctacagcgccagcctgcctgcccctgtgaagctgatcctgcctgccctggagatgatgtatgtgtggaatggcttcagcatcgtgtccaagaggaaggacctgtctgagaacctgctggtgacagtggagaaggccgaggccgccctgcagagccagaacttcaacagcttctctgtggatgatgagtgcctggtgaagctgctgaagggctgctgcctgaagaacctgcagaggcccctgcaggccgagctgtgctacaaccacgtggtggagagcgagaagctgctgaagtatgaccactacctggtgcccttcaccctgtttgagctggccagcctgtacaagagccagggcgagattgacaaggccatcaagttcctggagacagccaggaacaactacaaggactacagcctggagagccggctgcacttccgcatccaggccgccctgcacctgtggaggaagcccagcagtgactag

SEQ ID NO: 173080 - DNA, 585 bp, Artificial Sequence
  Description of Artificial Sequence: Synthetic coding sequence
atggccctgctgggcagcagagctgagctggaggctgatgaagatgtgtttgaagatgccctggagaccatcagcatcagcagccacagcgacatggccaccagcagcctgcactttgccagctgtgacacccagcaggccccccggcagagaggagccagcacagtgagcagcagcagcagcaccaaggtggacctgaagagcggcctggaggagtgtgctgtggccctgaacctcttcctgagcaacaagttcacagatgccctggagctgctgcggccctgggccaaggagagcatgtaccacgccctgggctacagcaccatcgtggtgctgcaggccgtgctgacctttgagcagcaggacatccagaatggcatcagcgccatgaaggatgccctgcagacctgccagaagtacaggaagaagtacacagtggtggagagcttcagcagcctgctgagccggggcagcctggagcagctgtctgaggaggagatgcatgctgagatctgctacgcagaatgtctgctgcagaaggccgccctgacctttgtgcagaggatgtccttctacccagcctag

SEQ ID NO: 173081 - DNA, 1164 bp, Artificial Sequence
  Description of Artificial Sequence: Synthetic coding sequence
atggagcagcccggccaggaccccaccagtgatgatgtgatggacagcttcctggagaagttccagagccagccctaccggggcggcttccacgaggaccagtgggagaaggagtttgagaaggtgcccctcttcatgagccgggcccccagcgagattgaccccagagaaaatccagacctggcctgcctgcagagcatcatctttgatgaggagaggagccctgaggagcaggccaagacctacaaggatgagggcaatgactacttcaaggagaaggactacaagaaggccgtcatctcctacacagagggcctgaagaagaagtgtgccgaccctgacctgaatgctgtgctgtacaccaacagagctgctgcccagtactacctgggcaacttccgcagcgccctgaatgatgtgacagctgccaggaagctgaagccctgccacctgaaggccatcatccggggggccctgtgccacctggagctgaagcactttgctgaggccgtgaactggtgtgatgagggcctgcagattgatgccaaggagaagaagctgctggagatgagggccaaggctgacaagctgaagagaattgagcagagagatgtgaggaaggccaacctgaaggagaagaaggagaggaaccagaatgaggccctgctgcaggccatcaaggccaggaacatccggctgtctgaggccgcctgtgaagatgaagattctgccagcgagggcctgggggagctgttcctggatggcctgagcacagagaacccccacggggcccggctgagcctggatggccagggccgcctgtcctggcctgtgctcttcctgtacccagaatatgcccagagcgacttcatcagcgccttccacgaggacagccgcttcatcgaccacctgatggtgatgtttggagagacccccagctgggacctggagcagaagtactgcccagacaacctggaggtgtactttgaagatgaggacagagctgagctgtacagagtgcctgccaagagcaccctgctgcaggtgctgcagcaccagcgctactttgtgaaggccctgaccccagccttcctggtgtgtgtgggcagcagccccttctgcaagaacttcctgcggggcaggaaggtgtaccagatcagatag

SEQ ID NO: 173082 - DNA, 1515 bp, Artificial Sequence
  Description of Artificial Sequence: Synthetic coding sequence
atggccaccagagatgtggtgctgagccgggtgcctgagcaggaggaggacagaacagtgtccctgcagaatgctgctgccatctatgacctgctgagcatcaccctgggccggcggggccagtatgtgatgctgtctgaatgtctggagcgggccatgaagtttgcctttggagagttccacctgtggtaccaggtggccctgtccatggtggcctgtgggaagagcgcctatgctgtgtccctgctgagagaatgtgtgaagctgcggcccagcgaccccaccgtgcccctgatggccgccaaggtgtgcatcggcagcctgcgctggctggaggaggccgagcactttgccatgatggtgatcagcctgggggaggaggccggggagttcctgcccaagggctacctggccctgggcctgacctacagcctgcaggccacagatgccaccctgaagagcaagcaggatgagctgcacaggaaggccctgcagaccctggagcgggcccagcagctggcccccagcgacccccaggtgatcctgtatgtgtccctgcagctggccctggtgcggcagatcagcagcgccatggagcagctgcaggaggccctgaaggtgaggaaggatgatgcccacgccctgcacctgctggccctgctcttcagcgcccagaagcaccaccagcacgccctggatgtggtgaacatggccatcacagagcaccctgagaacttcaacctgatgttcaccaaggtgaagctggagcaggtgctgaagggccctgaggaggccctggtgacctgccggcaggtgctgcggctgtggcagaccctgtacagcttcagccagctgggcggcctggagaaggatggcagctttggagagggcctgaccatgaagaagcagagcggcatgcacctgaccctgcctgatgcccatgatgctgacagcggcagcagaagagccagcagcattgctgccagccggctggaggaggccatgtctgagctgaccatgcccagctctgtgctgaagcagggccccatgcagctgtggaccaccctggagcagatctggctgcaggccgctgagctgttcatggagcagcagcacctgaaggaggccggcttctgcatccaggaggccgccggcctcttccccaccagccacagcgtgctgtacatgaggggccgcctggccgaggtgaagggcaacctggaggaggccaagcagctgtacaaggaggccctgactgtgaacccagatggagtgcgcatcatgcacagcctgggcctgatgctgagccggctgggccacaagagcctggcccagaaggtgctgagagatgctgtggagcggcagagcacctgccacgaggcctggcagggcctgggggaggtgctgcaggcccagggccagaatgaagctgctgtggactgcttcctgacagccctggagctggaggccagcagccctgtgctgcccttcagcatcatcccccgggagctgtag

SEQ ID NO: 173083 - DNA, 2577 bp, Artificial Sequence
  Description of Artificial Sequence: Synthetic coding sequence
atggccgccaagggggcccacggcagctacctgaaggtggagagcgagctggagcgctgcagagctgagggccactgggacaggatgcctgagctggtgcggcagctgcagaccctgtccatgcctgggggcggcggcaacagaagaggcagccccagcgctgccttcaccttcccagacacagatgactttgggaagctgctgctggccgaggccctgctggagcagtgcctgaaggagaaccacgccaagatcaaggacagcatgcccctgctggagaagaatgagcccaagatgtctgaggccaagaactacctgagcagcatcctgaaccacggccgcctgagcccccagtacatgtgtgaggccatgctgatcctgggcaagctgcactacgtggagggcagctacagagatgccatctccatgtatgcccgggccggcattgatgacatgtccatggagaacaagcccctgtaccagatgaggctgctgtctgaggcctttgtgatcaagggcctgagcctggagcggctgcccaacagcatcgccagccgcttccggctgacagagcgggaggaggaggtgatcacctgctttgagcgggcctcctggatcgcccaggtgttcctgcaggagctggagaagaccaccaacaacagcaccagccgccacctgaagggctgccaccccctggactatgagctgacctacttcctggaggccgccctgcagagcgcctacgtgaagaacctgaagaagggcaacatcgtgaagggcatgagggagctgcgggaggtgctgaggacagtggagaccaaggccacccagaacttcaaggtgatggccgccaagcacctggccggcgtgctgctgcacagcctgtctgaggagtgctactggagccccctgagccaccccctgcctgagttcatgggcaaggaggagagcagctttgccacccaggccctgaggaagccccacctgtatgaaggagacaacctgtactgccccaaggacaacatcgaggaggccctgctgctgctgctgatcagcgagagcatggccaccagagatgtggtgctgagccgggtgcctgagcaggaggaggacagaacagtgtccctgcagaatgctgctgccatctatgacctgctgagcatcaccctgggccggcggggccagtatgtgatgctgtctgaatgtctggagcgggccatgaagtttgcctttggagagttccacctgtggtaccaggtggccctgtccatggtggcctgtgggaagagcgcctatgctgtgtccctgctgagagaatgtgtgaagctgcggcccagcgaccccaccgtgcccctgatggccgccaaggtgtgcatcggcagcctgcgctggctggaggaggccgagcactttgccatgatggtgatcagcctgggggaggaggccggggagttcctgcccaagggctacctggccctgggcctgacctacagcctgcaggccacagatgccaccctgaagagcaagcaggatgagctgcacaggaaggccctgcagaccctggagcgggcccagcagctggcccccagcgacccccaggtgatcctgtatgtgtccctgcagctggccctggtgcggcagatcagcagcgccatggagcagctgcaggaggccctgaaggtgaggaaggatgatgcccacgccctgcacctgctggccctgctcttcagcgcccagaagcaccaccagcacgccctggatgtggtgaacatggccatcacagagcaccctgagaacttcaacctgatgttcaccaaggtgaagctggagcaggtgctgaagggccctgaggaggccctggtgacctgccggcaggtgctgcggctgtggcagaccctgtacagcttcagccagctgggcggcctggagaaggatggcagctttggagagggcctgaccatgaagaagcagagcggcatgcacctgaccctgcctgatgcccatgatgctgacagcggcagcagaagagccagcagcattgctgccagccggctggaggaggccatgtctgagctgaccatgcccagctctgtgctgaagcagggccccatgcagctgtggaccaccctggagcagatctggctgcaggccgctgagctgttcatggagcagcagcacctgaaggaggccggcttctgcatccaggaggccgccggcctcttccccaccagccacagcgtgctgtacatgaggggccgcctggccgaggtgaagggcaacctggaggaggccaagcagctgtacaaggaggccctgactgtgaacccagatggagtgcgcatcatgcacagcctgggcctgatgctgagccggctgggccacaagagcctggcccagaaggtgctgagagatgctgtggagcggcagagcacctgccacgaggcctggcagggcctgggggaggtgctgcaggcccagggccagaatgaagctgctgtggactgcttcctgacagccctggagctggaggccagcagccctgtgctgcccttcagcatcatcccccgggagctgtag

SEQ ID NO: 173084 - DNA, 2058 bp, Artificial Sequence
  Description of Artificial Sequence: Synthetic coding sequence
aagaagaagatcaacttcttcaagaagccccacagcctgagcctgaggaagaagcgggaggaggaggtgatcacctgctttgagcgggcctcctggatcgcccaggtgttcctgcaggagctggagaagaccaccaacaacagcaccagccgccacctgaagggctgccaccccctggactatgagctgacctacttcctggaggccgccctgcagagcgcctacgtgaagaacctgaagaagggcaacatcgtgaagggcatgagggagctgcgggaggtgctgaggacagtggagaccaaggccacccagaacttcaaggtgatggccgccaagcacctggccggcgtgctgctgcacagcctgtctgaggagtgctactggagccccctgagccaccccctgcctgagttcatgggcaaggaggagagcagctttgccacccaggccctgaggaagccccacctgtatgaaggagacaacctgtactgccccaaggacaacatcgaggaggccctgctgctgctgctgatcagcgagagcatggccaccagagatgtggtgctgagccgggtgcctgagcaggaggaggacagaacagtgtccctgcagaatgctgctgccatctatgacctgctgagcatcaccctgggcagaagaggccagtatgtgatgctgtctgagtgcctggagcgggccatgaagtttgccttcggggagttccacctgtggtaccaggtggccctgtccatggtggcctgtgggaagagcgcctatgctgtgtccctgctgcgggagtgtgtgaagctgcggcccagcgaccccaccgtgcccctgatggccgccaaggtgtgcatcggcagcctgcgctggctggaggaggccgagcactttgccatgatggtgatcagcctgggggaggaggccggggagttcctgcccaagggctacctggccctgggcctgacctacagcctgcaggccacagatgccaccctgaagagcaagcaggatgagctgcacaggaaggccctgcagaccctggagcgggcccagcagctggcccccagcgacccccaggtgatcctgtatgtgtccctgcagctggccctggtgcggcagatcagcagcgccatggagcagctgcaggaggccctgaaggtgaggaaggatgatgcccacgccctgcacctgctggccctgctcttcagcgcccagaagcaccaccagcacgccctggatgtggtgaacatggccatcacagagcaccctgagaacttcaacctgatgttcaccaaggtgaagctggagcaggtgctgaagggccctgaggaggccctggtgacctgccggcaggtgctgcggctgtggcagaccctgtacagcttcagccagctgggcggcctggagaaggatggcagctttggagagggcctgaccatgaagaagcagagcggcatgcacctgaccctgcctgatgcccatgatgctgacagcggcagccggcgggccagcagcattgctgccagccggctggaggaggccatgtctgagctgaccatgcccagctctgtgctgaagcagggccccatgcagctgtggaccaccctggagcagatctggctgcaggccgctgagctgttcatggagcagcagcacctgaaggaggccggcttctgcatccaggaggccgccggcctcttccccaccagccacagcgtgctgtacatgaggggccgcctggccgaggtgaagggcaacctggaggaggccaagcagctgtacaaggaggccctgactgtgaacccagatggagtgcgcatcatgcacagcctgggcctgatgctgagccggctgggccacaagagcctggcccagaaggtgctgagagatgctgtggagcggcagagcacctgccacgaggcctggcagggcctgggggaggtgctgcaggcccagggccagaatgaggccgctgtggactgcttcctgacagccctggagctggaggccagcagccctgtgctgcccttcagcatcatcccccgggagctgtag

SEQ ID NO: 173085 - DNA, 441 bp, Artificial Sequence
  Description of Artificial Sequence: Synthetic coding sequence
atggccgccaagggggcccacggcagctacctgaaggtggagagcgagctggagcgctgcagagctgagggccactgggacaggatgcctgagctggtgcggcagctgcagaccctgtccatgcctgggggcggcggcaacagaagaggcagccccagcgctgccttcaccttcccagacacagatgactttgggaagctgctgctggccgaggccctgctggagcagtgcctgaaggagaaccacgccaagatcaaggacagcatgcccctgctggagaagaatgagcccaagatgtctgaggccaagaactacctgagcagcatcctgaaccacggccgcctgagcggcctggccgtgctgctgcggctggtgagcaacagctgggcccaggccatcctgctgctgcagcccccagaggccctgggcctgcaggagtag

SEQ ID NO: 173086 - DNA, 1596 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccaggccgcctggatcctgaaggcccgggccctgacagagatggtgtacattgatgaaattgatgtggaccaggagggcattgctgagatgatgctggatgaaaatgccatcgcccaggtgccccggcccggcaccagcctgaagctgcccggcaccaaccagacaggaggccccagccaggccgtgcggcccatcacccaggccggccggcccatcaccggcttcctgcggcccagcacccagagcggccggcccggcaccatggagcaggccatccgcacccccaggacagcctacacagcccggcccatcaccagcagcagcggccgctttgtgcggctgggcacagcctccatgctgaccagcccagatggccccttcatcaacctgagccggctgaacctgaccaagtacagccagaagcccaagctggccaaggccctgtttgagtacatcttccaccatgaaaatgatgtgaagaccatccacctggaggatgtggtgctgcacctgggcatctaccccttcctgctgaggaacaagaaccacatcgagaagaatgccctggacctggccgccctgagcacagagcacagccagtacaaggactggtggtggaaggtgcagatcggcaagtgctactaccgcctgggcatgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctaccgccgcctgctgcagatgggcatctacaacggccagctgttcaacaacctgggcctgtgctgcttctacgcccagcagtatgacatgaccctgaccagctttgagcgggccctgagcctggctgaaaatgaggaggaggccgcagatgtgtggtacaacctgggccacgtggccgtgggcatcggggacaccaacctggcccaccagtgcttccggctggccctggtgaacaacaacaaccacgccgaggcctacaacaacctggccgtgctggagatgaggaagggccacgtggagcaggcccgggccctgctgcagacagccagcagcctggccccccacatgtatgagccccacttcaactttgccaccatcagtgacaagatcggggacctgcagaggagctatgtggccgcccagaagtctgaggccgccttcccagaccacgtggacacccagcacctgatcaagcagctgcggcagcactttgccatgctgtag

SEQ ID NO: 173087 - DNA, 636 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccagaagatctcctgggcctggtggcacgtgcctgtgatcccagccacctgggaggccgaggccggggagctgctggagcccaggaagaggcggctgcagcaggccgagatcacccccctgtacagcagcctgggcaacaagagcaagacccccagccagaaggccgcctggatcctgaaggcccgggccctgacagagatggtgtacattgatgaaattgatgtggaccaggagggcattgctgagatgatgctggatgaaaatgccatcgcccaggtgcccaggcctggcaccagcctgaagctgcccggcaccaaccagacaggaggccccagccaggccgccaaccacacctcctggaagacccactaccgcttcccccaggcccagcacgccgagtggaaggcccggcactacggcaccggctaccagaacacccagaaccggctgcacagccccccctaccaccagctgctgaggaagatctgccaggccggaaatggcttccacgcctacaagagctag

SEQ ID NO: 173088 - DNA, 1518 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccaggccgcctggatcctgaaggcccgggccctgacagagatggtgtacattgatgaaattgatgtggaccaggagggcattgctgagatgatgctggatgaaaatgccatcgcccaggtgccccggcccggcaccagcctgaagctgcccggcaccaaccagacaggaggccccagccaggccgtgcggcccatcacccaggccggccggcccatcaccggcttcctgcggcccagcacccagagcggccggcccggcaccatggagcaggccatccgcacccccaggacagcctacacagcccggcccatcaccagcagcagcggccgctttgtgcggctgggcacagcctccatgctgaccagcccagatggccccttcatcaacctgagccggctgaacctgaccaagtacagccagaagcccaagctggccaaggccctgtttgagtacatcttccaccatgaaaatgatgtgaagacagccctggacctggccgccctgagcacagagcacagccagtacaaggactggtggtggaaggtgcagatcggcaagtgctactaccgcctgggcatgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctaccgccgcctgctgcagatgggcatctacaacggccagctgttcaacaacctgggcctgtgctgcttctacgcccagcagtatgacatgaccctgaccagctttgagcgggccctgagcctggctgaaaatgaggaggaggccgcagatgtgtggtacaacctgggccacgtggccgtgggcatcggggacaccaacctggcccaccagtgcttccggctggccctggtgaacaacaacaaccacgccgaggcctacaacaacctggccgtgctggagatgaggaagggccacgtggagcaggcccgggccctgctgcagacagccagcagcctggccccccacatgtatgagccccacttcaactttgccaccatcagtgacaagatcggggacctgcagaggagctatgtggccgcccagaagtctgaggccgccttcccagaccacgtggacacccagcacctgatcaagcagctgcggcagcactttgccatgctgtag

SEQ ID NO: 173089 - DNA, 1428 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccaggccgcctggatcctgaaggcccgggccctgacagagatggtgtacattgatgaaattgatgtggaccaggagggcattgctgagatgatgctggatgaaaatgccatcgcccaggtgccccggcccggcaccagcctgaagctgcccggcaccaaccagacaggaggccccagccaggccgtgcggcccatcacccaggccggccggcccatcaccggcttcctgcggcccagcacccagagcggccggcccggcaccatggagcaggccatccgcacccccaggacagcctacacagcccggcccatcaccagcagcagcggccgctttgtgcggctgggcacagccctgtttgagtacatcttccaccatgaaaatgatgtgaagacagccctggacctggccgccctgagcacagagcacagccagtacaaggactggtggtggaaggtgcagatcggcaagtgctactaccgcctgggcatgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctaccgccgcctgctgcagatgggcatctacaacggccagctgttcaacaacctgggcctgtgctgcttctacgcccagcagtatgacatgaccctgaccagctttgagcgggccctgagcctggctgaaaatgaggaggaggccgcagatgtgtggtacaacctgggccacgtggccgtgggcatcggggacaccaacctggcccaccagtgcttccggctggccctggtgaacaacaacaaccacgccgaggcctacaacaacctggccgtgctggagatgaggaagggccacgtggagcaggcccgggccctgctgcagacagccagcagcctggccccccacatgtatgagccccacttcaactttgccaccatcagtgacaagatcggggacctgcagaggagctatgtggccgcccagaagtctgaggccgccttcccagaccacgtggacacccagcacctgatcaagcagctgcggcagcactttgccatgctgtag

SEQ ID NO: 173090 - DNA, 753 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctacagaaggctgctgcagatgggcatctacaacggccagctgttcaacaacctgggcctgtgctgcttctacgcccagcagtatgacatgaccctgaccagctttgagcgggccctgagcctggccgagaatgaggaggaggccgcagatgtgtggtacaacctgggccacgtggccgtgggcattggagacaccaacctggcccaccagtgcttccggctggccctggtgaacaacaacaaccacgccgaggcctacaacaacctggccgtgctggagatgaggaaaggacatgtggagcaggcccgggccctgctgcagacagccagcagcctggccccccacatgtatgagccccacttcaactttgccaccatcagtgacaagattggagacctgcagaggagctatgtggccgcccagaagtctgaggccgccttcccagaccacgtggacacccagcacctgatcaagcagctgcggcagcactttgccatgctgtag

SEQ ID NO: 173091 - DNA, 954 bp, Artificial Sequence
  Description of Artificial Sequence: Synthetic coding sequence
atgatcctgtcctatgaagtcatcctgcacgccctggacctggccgccctgagcacagagcacagccagtacaaggactggtggtggaaggtgcagatcggcaagtgctactaccgcctgggcatgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctaccgccgcctgctgcagatgggcatctacaacggccagctgttcaacaacctgggcctgtgctgcttctacgcccagcagtatgacatgaccctgaccagctttgagcgggccctgagcctggctgaaaatgaggaggaggccgcagatgtgtggtacaacctgggccacgtggccgtgggcatcggggacaccaacctggcccaccagtgcttccggctggccctggtgaacaacaacaaccacgccgaggcctacaacaacctggccgtgctggagatgaggaagggccacgtggagcaggcccgggccctgctgcagacagccagcagcctggccccccacatgtatgagccccacttcaactttgccaccatcagtgacaagatcggggacctgcagaggagctatgtggccgcccagaagtctgaggccgccttcccagaccacgtggacacccagcacctgatcaagcagctgcggcagcactttgccatgctgtag

SEQ ID NO: 173092 - DNA, 1548 bp, Artificial Sequence
  Description of Artificial Sequence: Synthetic coding sequence
atgagcagcgagatggagcccctgctgctggcctggagctacttcagaagaaggaagttccagctgtgtgccgacctgtgcacccagatgctggagaagagcccctatgaccaggagccagaccctgagctgcctgtgcaccaggccgcctggatcctgaaggcccgggccctgacagagatggtgtacattgatgaaattgatgtggaccaggagggcattgctgagatgatgctggatgaaaatgccatcgcccaggtgccccggcccggcaccagcctgaagctgcccggcaccaaccagacaggaggccccagccaggccgtgcggcccatcacccaggccggccggcccatcaccggcttcctgcggcccagcacccagagcggccggcccggcaccatggagcaggccatccgcacccccaggacagcctacacagcccggcccatcaccagcagcagcggccgctttgtgcggctgggcacagcctccatgctgaccagcccagatggccccttcatcaacctgagccggctgaacctgaccaagtacagccagaagcccaagctggccaaggccctgtttgagtacatcttccaccatgaaaatgatgtgaagacagccctggacctggccgccctgagcacagagcacagccagtacaaggactggtggtggaaggtgcagatcggcaagtgctactaccgcctgggcatgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctaccgccgcctgctgcagatgggcatctacaacggccagctgttcaacaacctgggcctgtgctgcttctacgcccagcagtatgacatgaccctgaccagctttgagcgggccctgagcctggctgaaaatgaggaggaggccgcagatgtgtggtacaacctgggccacgtggccgtgggcatcggggacaccaacctggcccaccagtgcttccggctggccctggtgaacaacaacaaccacgccgaggcctacaacaacctggccgtgctggagatgaggaagggccacgtggagcaggcccgggccctgctgcagacagccagcagcctggccccccacatgtatgagccccacttcaactttgccaccatcagtgacaagatcggggacctgcagaggagctatgtggccgcccagaagtctgaggccgccttcccagaccacgtggacacccagcacctgatcaagcagctgcggcagcactttgccatgctgtag

SEQ ID NO: 173093 - DNA, 831 bp, Artificial Sequence
  Description of Artificial Sequence: Synthetic coding sequence
atgtaccgggaggccgagaagcagttcaagagcgccctgaagcagcaggagatggtggacaccttcctgtacctggccaaggtgtatgtgtccctggaccagcctgtgacagccctgaacctcttcaagcagggcctggacaagtttcctggagaggtgaccctgctgtgtggcatcgcccgcatctatgaggagatgaacaacatgagcagcgctgctgagtactacaaggaggtgctgaagcaggacaacacccacgtggaggccatcgcctgcatcggcagcaaccacttctacagcgaccagcctgagatcgccctgcgcttctacagaaggctgctgcagatgggcatctacaacggccagctgttcaacaacctgggcctgtgctgcttctacgcccagcagtatgacatgaccctgaccagctttgagcgggccctgagcctggccgagaatgaggaggaggccgcagatgtgtggtacaacctgggccacgtggccgtgggcattggagacaccaacctggcccaccagtgcttccggctggccctggtgaacaacaacaaccacgccgaggcctacaacaacctggccgtgctggagatgaggaaaggacatgtggagcaggcccgggccctgctgcagacagccagcagcctggccccccacatgtatgagccccacttcaactttgccaccatcagtgacaagattggagacctgcagaggagctatgtggccgcccagaagtctgaggccgccttcccagaccacgtggacacccagcacctgatcaagcagctgcggcagcactttgccatgctgtag

SEQ ID NO: 173094 - DNA, 348 bp, Artificial Sequence
  Description of Artificial Sequence: Synthetic coding sequence
atgagcagccccagcagccccttccgggagcagagcttcctgtgtgccgctggagatgctggggaggagagccgggtgcaggtgctgaagaatgaggtgcggcggggcagccctgtgctgctgggctgggtggagcaggcctatgctgacaagtgtgtgtgtggccccagcgcccccccagcccccaccccacccagcctgagccagagggtgatgtgcaatgacctcttcaaggtgaaccccttccagctgcagcagttccgggctgaccccagcacagccagcctgctgctgtgccctgggggcctggaccacaagctgaacctgcggggcaaggcctggggctag

SEQ ID NO: 173095 - DNA, 348 bp, Artificial Sequence; identical to SEQ ID NO: 173094
  Description of Artificial Sequence: Synthetic coding sequence

SEQ ID NO: 173096 - DNA, 357 bp, Artificial Sequence
  Description of Artificial Sequence: Synthetic coding sequence
atggagggcggggcctacggggccggcaaggccggcggggcctttgacccctacaccctggtgcggcagccccacaccatcctgcgggtggtgtcctggctgttcagcatcgtggtgtttggcagcatcgtgaatgaaggctacctgaacagcgccagcgagggggaggagttctgcatctacaacagaaaccccaatgcctgcagctatggagtggccgtgggcgtgctggccttcctgacctgcctgctgtacctggccctggatgtgtacttcccccagatcagctctgtgaaggacaggaagaaggctgtgctgagtgacattggagtgtctgcctgggagatgcacagctag

SEQ ID NO: 173097 - DNA, 1389 bp, Artificial Sequence
  Description of Artificial Sequence: Synthetic coding sequence
atggccgcccagaggaggagcctgctgcagagcgagcagcagcccagctggacagatgacctgcccctgtgccacctgtctggagtgggcagcgccagcaacagaagctacagcgcagatggcaagggcacagagagccaccccccagaggacagctggctgaagttccgctctgagaacaactgcttcctgtatggagtcttcaacggctatgatggcaacagagtgaccaactttgtggcccagaggctgtctgctgagctgctgctgggccagctgaatgctgagcacgccgaggctgatgtgagaagagtgctgctgcaggcctttgatgtggtggagaggagcttcctggagagcattgatgatgccctggccgagaaggccagcctgcagagccagctgcctgagggcgtgccccagcaccagctgcccccccagtaccagaagatcctggagcggctgaagaccctggagcgggagatctctggaggagccatggctgtggtggccgtgctgctgaacaacaagctgtatgtggccaacgtgggcaccaacagagccctgctgtgcaagagcacagtggatggcctgcaggtgacccagctgaatgtggaccacaccacagaaaatgaagatgagctgttccggctgagccagctgggcctggatgctgggaagatcaagcaggtgggcatcatctgtggccaggagagcaccaggagaattggagactacaaggtgaagtatggctacacagacatcgacctgctgtctgctgccaagagcaagcccatcatcgccgagcctgagatccatggagcccagcccctggatggagtgacaggcttcctggtgctgatgtctgagggcctgtacaaggccctggaggccgcccacggccctggccaggccaaccaggagattgctgccatgattgacacagaatttgccaagcagaccagcctggatgctgtggcccaggccgtggtggacagagtgaagaggatccacagcgacacctttgccagcggcggggagcgggcccgcttctgccccaggcatgaggacatgaccctgctggtgaggaactttggctaccccctgggggagatgagccagcccacccccagccctgccccagctgctgggggccgggtgtaccctgtgtctgtgccctacagcagcgcccagagcaccagcaagacctctgtgaccctgagcctggtgatgcccagccagggccagatggtgaatggagcccacagcgccagcaccctggatgaggccacccccaccctgaccaaggaccccagcaggcctgccagtgacctgacagccatcccccagtgccagctgaacctgctgggcagcctgaccccaggatag

SEQ ID NO: 173098 - DNA, 2082 bp, Artificial Sequence
  Description of Artificial Sequence: Synthetic coding sequence
atggcccagggcagccaccagattgacttccaggtgctgcatgacctgcggcagaagtttcctgaggtgcctgaggtggtggtgagccgctgcatgctgcagaacaacaacaacctggatgcctgctgtgctgtgctgagccaggagagcacccgctacctgtatggagagggggacctgaacttcagtgatgacagcggcatcagcggcctgaggaaccacatgaccagcctgaacctggacctgcagagccagaacatctaccaccacggccgggagggcagcaggatgaatggcagcaggaccctgacccacagcatcagtgatggccagctgcagggcggccagagcaacagcgagctgttccagcaggagccccagacagccccagcccaggtgccccagggcttcaacgtgtttggcatgagcagcagcagcggggccagcaacagcgccccccacctgggcttccacctgggcagcaagggcaccagcagcctgagccagcagaccccccgcttcaaccccatcatggtgaccctggcccccaacatccagacaggaagaaacacccccaccagcctgcacatccacggcgtgcccccacctgtgctgaacagcccccagggcaacagcatctacatccggccctacatcaccacccctgggggcaccacccggcagacccagcagcacagcggctgggtgtcccagttcaaccccatgaacccccagcaggtgtaccagcccagccagcccggcccctggaccacctgcccagccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcacaggccccaggaagaaccagatcgagatcaagctggagcccccccagaggaacaacagcagcaagctgcggagcagcggccccaggaccagcagcaccagcagctctgtgaacagccagaccctgaacagaaaccagcccaccgtgtacatcgccgccagcccccccaacacagatgagctgatgagccgcagccagcccaaggtgtacatcagcgccaatgctgccactggagatgagcaggtgatgaggaaccagcccaccctcttcatcagcaccaacagcggggccagcgctgccagcaggaacatgagcggccaggtgtccatgggccctgccttcatccaccaccacccccccaagagccgggccatcggcaacaacagcgccaccagcccccgggtggtggtgacccagcccaacaccaagtacaccttcaagatcaccgtgagccccaacaagcccccagctgtgtcccctggggtggtgagccccacctttgagctgaccaacctgctgaaccacccagaccactacgtggagacagagaacatccagcacctgacagaccccaccctggcccacgtggaccgcatcagcgagaccaggaagctgtccatgggcagtgatgatgctgcctacacccaggccctgctggtgcaccagaaggccaggatggagcggctgcagcgggagctggagatccagaagaagaagctggacaagctgaagtctgaggtgaatgagatggagaacaacctgacccggcggcggctgaagaggagcaacagcatcagccagatccccagcctggaggagatgcagcagctgcggagctgcaaccggcagctgcagattgacatcgactgcctgaccaaggagattgacctcttccaggcccggggcccccacttcaaccccagcgccatccacaacttctatgacaacattggatttgtgggccctgtgccccccaagcccaaggaccagaggagcatcatcaagacccccaagacccaggacacagaagatgatgaaggagcccagtggaactgcacagcctgcaccttcctgaaccacccagccctgatccgctgtgagcagtgtgagatgcccaggcacttctag

SEQ ID NO: 173099 - DNA, 2082 bp, Artificial Sequence; identical to SEQ ID NO: 173098
  Description of Artificial Sequence: Synthetic coding sequence

SEQ ID NO: 173100 - DNA, 1611 bp, Artificial Sequence
  Description of Artificial Sequence: Synthetic coding sequence
atggcccagggcagccaccagattgacttccaggtgctgcatgacctgcggcagaagtttcctgaggtgcctgaggtggtggtgagccgctgcatgctgcagaacaacaacaacctggatgcctgctgtgctgtgctgagccaggagagcacccgctacctgtatggagagggggacctgaacttcagtgatgacagcggcatcagcggcctgaggaaccacatgaccagcctgaacctggacctgcagagccagaacatctaccaccacggccgggagggcagcaggatgaatggcagcaggaccctgacccacagcatcagtgatggccagctgcagggcggccagagcaacagcgagctgttccagcaggagccccagacagccccagcccaggtgccccagggcttcaacgtgtttggcatgagcagcagcagcggggccagcaacagcgccccccacctgggcttccacctgggcagcaagggcaccagcagcctgagccagcagaccccccgcttcaaccccatcatggtgaccctggcccccaacatccagacaggaagaaacacccccaccagcctgcacatccacggcgtgcccccacctgtgctgaacagcccccagggcaacagcatctacatccggccctacatcaccacccctgggggcaccacccggcagacccagcagcacagcggctgggtgtcccagttcaaccccatgaacccccagcaggtgtaccagcccagccagcccggcccctggaccacctgcccagccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcacaggccccaggaagaaccagatcgagatcaagctggagcccccccagaggaacaacagcagcaagctgcggagcagcggccccaggaccagcagcaccagcagctctgtgaacagccagaccctgaacagaaaccagcccaccgtgtacatcgccgccagcccccccaacacagatgagctgatgagccgcagccagcccaaggtgtacatcagcgccaatgctgccactggagatgagcaggtgatgaggaaccagcccaccctcttcatcagcaccaacagcggggccagcgctgccagcaggaacatgagcggccaggtgtccatgggccctgccttcatccaccaccacccccccaagagccgggccatcggcaacaacagcgccaccagcccccgggtggtggtgacccagcccaacaccaagtacaccttcaagatcaccgtgagccccaacaagcccccagctgtgtcccctggggtggtgagccccacctttgagctgaccaacctgctgaaccacccagaccactacgtggagacagagaacatccagcacctgacagaccccaccctggcccacgtggaccgcatcagcgagaccaggaagctgtccatgggcagtgatgatgctgcctacacccaggacatctag

SEQ ID NO: 173101 - DNA, 1986 bp, Artificial Sequence
  Description of Artificial Sequence: Synthetic coding sequence
atgcagaacaacaacaacctggatgcctgctgtgctgtgctgagccaggagagcacccgctacctgtatggagagggggacctgaacttcagtgatgacagcggcatcagcggcctgaggaaccacatgaccagcctgaacctggacctgcagagccagaacatctaccaccacggccgggagggcagcaggatgaatggcagcaggaccctgacccacagcatcagtgatggccagctgcagggcggccagagcaacagcgagctgttccagcaggagccccagacagccccagcccaggtgccccagggcttcaacgtgtttggcatgagcagcagcagcggggccagcaacagcgccccccacctgggcttccacctgggcagcaagggcaccagcagcctgagccagcagaccccccgcttcaaccccatcatggtgaccctggcccccaacatccagacaggaagaaacacccccaccagcctgcacatccacggcgtgcccccacctgtgctgaacagcccccagggcaacagcatctacatccggccctacatcaccacccctgggggcaccacccggcagacccagcagcacagcggctgggtgtcccagttcaaccccatgaacccccagcaggtgtaccagcccagccagcccggcccctggaccacctgcccagccagcaaccccctgagccacaccagcagccagcagcccaaccagcagggccaccagaccagccacgtgtacatgcccatcagcagccccaccaccagccagccccccaccatccacagcagcggcagcagccagagcagcgcccacagccagtacaacatccagaacatcagcacaggccccaggaagaaccagatcgagatcaagctggagcccccccagaggaacaacagcagcaagctgcggagcagcggccccaggaccagcagcaccagcagctctgtgaacagccagaccctgaacagaaaccagcccaccgtgtacatcgccgccagcccccccaacacagatgagctgatgagccgcagccagcccaaggtgtacatcagcgccaatgctgccactggagatgagcaggtgatgaggaaccagcccaccctcttcatcagcaccaacagcggggccagcgctgccagcaggaacatgagcggccaggtgtccatgggccctgccttcatccaccaccacccccccaagagccgggccatcggcaacaacagcgccaccagcccccgggtggtggtgacccagcccaacaccaagtacaccttcaagatcaccgtgagccccaacaagcccccagctgtgtcccctggggtggtgagccccacctttgagctgaccaacctgctgaaccacccagaccactacgtggagacagagaacatccagcacctgacagaccccaccctggcccacgtggaccgcatcagcgagaccaggaagctgtccatgggcagtgatgatgctgcctacacccaggccctgctggtgcaccagaaggccaggatggagcggctgcagcgggagctggagatccagaagaagaagctggacaagctgaagtctgaggtgaatgagatggagaacaacctgacccggcggcggctgaagaggagcaacagcatcagccagatccccagcctggaggagatgcagcagctgcggagctgcaaccggcagctgcagattgacatcgactgcctgaccaaggagattgacctcttccaggcccggggcccccacttcaaccccagcgccatccacaacttctatgacaacattggatttgtgggccctgtgccccccaagcccaaggaccagaggagcatcatcaagacccccaagacccaggacacagaagatgatgaaggagcccagtggaactgcacagcctgcaccttcctgaaccacccagccctgatccgctgtgagcagtgtgagatgcccaggcacttctag

SEQ ID NO: 173102 - DNA, 2082 bp, Artificial Sequence; identical to SEQ ID NO: 173098
  Description of Artificial Sequence: Synthetic coding sequence

SEQ ID NO: 173103 - DNA, 714 bp, Artificial Sequence
  Description of Artificial Sequence: Synthetic coding sequence
atgtctgacagcgacctgggggaggatgagggcctgctgagcctggccggcaagaggaagagaagaggcaacctgcccaaggagagcgtgaagatcctgcgggactggctgtacctgcaccgctacaatgcctaccccagcgagcaggagaagctgagcctgagcggccagaccaacctgtctgtgctgcagatctgcaactggttcatcaatgcccggcggcggctgctgcctgacatgctgaggaaggatggcaaggaccccaaccagttcaccatcagcagaagaggaggcaaggccagtgatgtggccctgccccggggcagcagccccagcgtgctggccgtgtctgtgcctgcccccaccaacgtgctgagcctgtctgtgtgcagcatgcccctgcacagcggccagggcgagaagccagctgcccccttccccagaggagagctggagagccccaagcccctggtgaccccaggcagcaccctgaccctgctgaccagggctgaggccggcagccccaccggcggcctcttcaacaccccaccacccaccccacctgagcaggacaaggaggacttcagcagcttccagctgctggtggaggtggccctgcagagagctgctgagatggagctgcagaagcagcaggaccccagcctgcccctgctgcacacccccatccccctggtgtctgagaacccccagtag

SEQ ID NO: 173104 - DNA, 714 bp, Artificial Sequence; identical to SEQ ID NO: 173103
  Description of Artificial Sequence: Synthetic coding sequence

SEQ ID NO: 173105 - DNA, 525 bp, Artificial Sequence
  Description of Artificial Sequence: Synthetic coding sequence
atgtctgacagcgacctgggggaggatgagggcctgctgagcctggccggcaagaggaagagaagaggcaacctgcccaaggagagcgtgaagatcctgcgggactggctgtacctgcaccgctacaatgcctaccccagcgagcaggagaagctgagcctgagcggccagaccaacctgtctgtgctgcagatctgcaactggttcatcaatgcccggcggcggctgctgcctgacatgctgaggaaggatggcaaggaccccaaccagttcaccatcagcagaagaggaggcaaggccagtgatgtggccctgccccggggcagcagccccagcgtgctggccgtgtctgtgcctgcccccaccaacgtgctgagcctgtctgtgtgcagcatgcccctgcacagcggccagggcgagaagccagctgcccccttccccagaggagagctggagagccccaagcccctggtgaccccaggcagcaccctgaccctgctgaccagggctgaggccggcagctag

SEQ ID NO: 173106 - DNA, 714 bp, Artificial Sequence; identical to SEQ ID NO: 173103
  Description of Artificial Sequence: Synthetic coding sequence

SEQ ID NO: 173107 - DNA, 726 bp, Artificial Sequence
  Description of Artificial Sequence: Synthetic coding sequence
atggaggccgctgctgatggccctgctgagacccagagccctgtggagaaggacagccctgccaagacccagagccctgcccaggacaccagcatcatgagcagaaataatgctgacaccggccgggtgctggccctgcctgagcacaagaagaagaggaagggcaacctgcctgctgagagcgtgaagatcctgcgggactggatgtacaagcaccgcttcaaggcctaccccagcgaggaggagaagcagatgctgtctgagaagaccaacctgagcctgctgcagatcagcaactggttcatcaatgcccggcggcgcatcctgcctgacatgctgcagcagaggagaaatgaccccatcatcggccacaagacaggcaaggatgcccacgccacccacctgcagagcacagaggcctctgtgcctgccaagagcggccccagcggccctgacaacgtgcagagcctgcccctgtggcccctgcccaagggccagatgagccgggagaagcagcctgaccctgagagcgcccccagccagaagctgaccggcatcgcccagcccaagaagaaggtgaaggtgtctgtgaccagccccagcagccctgagctggtgtccccagaggagcacgccgacttcagcagcttcctgctgctggtggatgctgctgtgcagagagctgctgagctggagctggagaagaagcaggagcccaacccctag

SEQ ID NO: 173108 - DNA, 726 bp, Artificial Sequence; identical to SEQ ID NO: 173107
  Description of Artificial Sequence: Synthetic coding sequence

SEQ ID NO: 173109 - DNA, 558 bp, Artificial Sequence
  Description of Artificial Sequence: Synthetic coding sequence
atggaggccgctgctgatggccctgctgagacccagagccctgtggagaaggacagccctgccaagacccagagccctgcccaggacaccagcatcatgagcagaaataatgctgacaccggccgggtgctggccctgcctgagcacaagaagaagaggaagggcaacctgcctgctgagagcgtgaagatcctgcgggactggatgtacaagcaccgcttcaaggcctaccccagcgaggaggagaagcagatgctgtctgagaagaccaacctgagcctgctgcgcatcagcaactggttcatcaatgcccggcggcgcatcctgcctgacatgctgcagcagaggagaaatgaccccatcatcggccacaagacaggcaaggatgcccacgccacccacctgcagagcacagaggcctctgtgcctgccaagagcggccctgtggtgcagaccatgtacaaggcctgcccctgtggcccctgccagagggcccgctgccaggagaggagcaaccagatccgcagccggcccctggcccggagcagccctgagtag

SEQ ID NO: 173110 - DNA, 558 bp, Artificial Sequence; identical to SEQ ID NO: 173109
  Description of Artificial Sequence: Synthetic coding sequence

SEQ ID NO: 173111 - DNA, 1773 bp, Artificial Sequence
  Description of Artificial Sequence: Synthetic coding sequence
atggccggggctgtgcctggggccatcatggatgaggactactacggcagcgctgctgagtggggagatgaagcagatggcggccagcaggaggatgacagcggggagggggaggatgatgctgaggtgcagcaggagtgcctgcacaagttcagcacccgggactacatcatggagcccagcatcttcaacaccctgaagcgctacttccaggccggcggcagcccagaaaatgtcatccagctgctgtctgagaactacacagctgtggcccagacagtgaacctgctggccgagtggctgatccagacaggagtggagcctgtgcaggtgcaggagaccgtggagaaccacctgaagagcctgctgatcaagcactttgaccccaggaaggctgacagcatcttcacagaggagggggagaccccagcctggctggagcagatgattgcccacaccacctggagggacctcttctacaagctggccgaggcccacccagactgcctgatgctgaacttcaccgtgaagctgatcagtgatgctggctaccagggcgagatcacctctgtgtccacagcctgccagcagctggaggtgttcagccgggtgctgcggaccagcctggccaccatcctggatggaggagaggagaacctggagaagaacctgcctgagtttgccaagatggtgtgccacggggagcacacctacctgtttgcccaggccatgatgtctgtgctggcccaggaggagcagggcggcagcgctgtgagaagaattgcccaggaggtgcagagatttgcccaggagaagggccatgatgccagccagatcaccctggccctgggcacagctgccagctacccccgggcctgccaggccctgggcgccatgctgagcaagggggccctgaacccagctgacatcaccgtgctcttcaagatgttcacctccatggaccccccacctgtggagctgatccgggtgcctgccttcctggacctcttcatgcagagcctcttcaagccaggggcccgcatcaaccaggaccacaagcacaagtacatccacatcctggcctatgctgcctctgtggtggagacctggaagaagaacaagagggtgtccatcaacaaggatgagctgaagagcaccagcaaggctgtggagaccgtgcacaacctgtgctgcaatgaaaacaagggggccagcgagctggtggccgagctgagcaccctgtaccagtgcatccgcttccctgtggtggccatgggcgtgctgaagtgggtggactggacagtgtctgagccccgctacttccagctgcagacagaccacacccctgtgcacctggccctgctggatgagatcagcacctgccaccagctgctgcacccccaggtgctgcagctgctggtgaagctgtttgaaacagagcacagccagctggatgtgatggagcagctggagctgaagaagaccctgctggacaggatggtgcacctgctgagccggggctacgtgctgcctgtggtgtcctacatcaggaagtgcctggagaagctggacacagacatcagcctcatccgctactttgtgacagaggtgctggatgtgattgccccaccctacaccagtgactttgtgcagctgttcctgcccatcctggagaatgacagcattgctggcaccatcaagacagaaggagaacatgaccctgtgacagagttcatcgcccactgcaagagcaacttcatcatggtgaactag

SEQ ID NO: 173112 - DNA, 1773 bp, Artificial Sequence; identical to SEQ ID NO: 173111
  Description of Artificial Sequence: Synthetic coding sequence

SEQ ID NO: 173113 - DNA, 774 bp, Artificial Sequence
  Description of Artificial Sequence: Synthetic coding sequence
atgcctgcccgctgtgtggccgcccactgcggcaacaccaccaagagcggcaagagcctcttccgcttccccaaggacagagctgtgcggctgctgtgggacagatttgtgcggggctgcagagctgactggtatggaggaaatgacagaagtgtcatctgcagcgaccactttgccccagcctgctttgatgtgtcctctgtcatccagaagaacctgcgcttcagccagaggctgcggctggtggccggggctgtgcccaccctgcaccgggtgcctgccccagcccccaagagaggagaggagggggaccaggccggccgcctggacaccagaggagagctgcaggccgcccggcacagcgaggccgcccctggccctgtgtcctgcacccggcccagggctgggaagcaggccgccgccagccagatcacctgtgaaaatgagctggtgcagacccagccccatgctgacaaccccagcaacacagtgacctctgtgcccacccactgtgaggagggccctgtgcacaagagcacccagatcagcctgaagaggcccaggcacaggtctgtgggcatccaggccaaggtgaaggccttcggcaagaggctgtgcaatgccaccacccagacagaggagctgtggagcaggaccagcagcctgtttgacatctacagcagtgacagcgagacagacacagactgggacatcaagtctgagcagagcgacctgagctacatggctgtgcaggtgaaggaggagacctgctag

SEQ ID NO: 173114 - DNA, 498 bp, Artificial Sequence
  Description of Artificial Sequence: Synthetic coding sequence
atggagccccccaagatgaaccctgtggtggagcccctgtcctggatgctgggcacctggctgagtgaccccccaggagctggcacctaccccaccctgcagcccttccagtacctggaggaggtgcacatcagccacgtgggccagcccatgctgaacttctccttcaacagcttccacccagacaccaggaagcccatgcaccgggagtgtggcttcatccggctgaagccagacaccaacaaggtggcctttgtgtctgcccagaacacaggagtggtggaggtggaggagggggaggtgaatggccaggagctgtgcatcgccagccacagcatcgcccgcatcagctttgccaaggagccccacgtggagcagatcaccaggaagttccggctgaacagcgagggcaagctggagcagacagtgtccatggccaccaccacccagcccatgacccagcacctgcacgtgacctacaagaaggtgaccccctag

SEQ ID NO: 173115 - DNA, 1734 bp, Artificial Sequence
  Description of Artificial Sequence: Synthetic coding sequence
atggtgatctgctgtgccgctgtgaactgcagcaaccggcagggcaagggggagaagagagctgtgtccttccaccgcttccccctgaaggacagcaagaggctcatccagtggctgaaggctgtgcagagggacaactggacccccaccaagtacagcttcctgtgcagcgagcacttcaccaaggacagcttcagcaagaggctggaggaccagcaccggctgctgaagcccacagctgtgcccagcatcttccacctgacagagaagaagagaggagctgggggccacggccgcaccaggaggaaggatgccagcaaggccactggaggagtgcggggccacagcagcgctgccaccagcagaggagctgctggctggagccccagcagcagcggcaaccccatggccaagccagagagccggcggctgaagcaggccgccctgcagggcgaggccacccccagggctgcccaggaggccgccagccaggagcaggcccagcaggccctggagaggaccccaggagatggcctggccaccatggtggccggcagccagggcaaggccgaggccagcgccacagatgctggagatgaaagtgccaccagcagcattgagggcggcgtgacagacaagagcggcatctccatggatgacttcaccccacctggcagcggggcctgcaagttcatcggcagcctgcacagctacagcttcagcagcaagcacacccgggagcggcccagcgtgccccgggagcccatcgacaggaagaggctgaagaaggatgtggagcccagctgcagcggcagcagcctgggccctgacaagggcctggcccagagcccccccagcagcagcctgacagccaccccccagaagcccagccagagccccagcgcccccccagcagatgtgacccccaagccagccacagaagctgtgcagagcgagcacagtgatgccagccccatgagcatcaatgaagtcatcctgagcgccagcggggcctgcaagctgattgacagcctgcacagctactgcttcagcagccggcagaacaagagccaggtgtgctgcctgcgggagcaggtggagaagaagaatggagagctgaagagcctgcggcagagggtgtccagaagtgacagccaggtgaggaagctgcaggagaagctggatgagctgcggcgggtgtctgtgccctaccccagcagcctgctgagccccagccgggagccccccaagatgaaccctgtggtggagcccctgtcctggatgctgggcacctggctgagtgaccccccaggagctggcacctaccccaccctgcagcccttccagtacctggaggaggtgcacatcagccacgtgggccagcccatgctgaacttctccttcaacagcttccacccagacaccaggaagcccatgcaccgggagtgtggcttcatccggctgaagccagacaccaacaaggtggcctttgtgtctgcccagaacacaggagtggtggaggtggaggagggggaggtgaatggccaggagctgtgcatcgccagccacagcatcgcccgcatcagctttgccaaggagccccacgtggagcagatcaccaggaagttccggctgaacagcgagggcaagctggagcagacagtgtccatggccaccaccacccagcccatgacccagcacctgcacgtgacctacaagaaggtgaccccctag

SEQ ID NO: 173116 - DNA, 510 bp, Artificial Sequence
  Description of Artificial Sequence: Synthetic coding sequence
atgagcatcaatgaggtgatcctgagcgccagcggggcctgcaagctgattgacagcctgcacagctactgcttcagcagccggcagaacaagagccaggtgtgctgcctgcgggagcaggtggagaagaagaatggagagctgaagagcctgcggcagagggtgtccagaagtgacagccaggtgaggaagctgcaggagaagctggatgagctgcggcgggtgtctgtgccctaccccagcagcctgctgagccccagccgggagccccccaagatgaaccctgtggtggagcccctgtcctggatgctgggcacctggctgagtgaccccccaggggccggcacctaccccaccctgcagcccttccagtacctggaggaggtgcacatcagccacgtgggccagcccatgctgaacttctccttcaacagcttccacccagacaccaggaagcccatgcacagagaatgtggcttcatccggctgaagccaggcagcagcggctag

SEQ ID NO: 173117 - DNA, 1062 bp, Artificial Sequence
  Description of Artificial Sequence: Synthetic coding sequence
atgaagagggacagctgggtgcccagcaagtaccagttcctgtgcagcgaccacttcaccccagacagcctggacatccgctggggcatccgctacctgaagcagacagctgtgcccaccatcttcagcctgcctgaggacaaccagggcaaggaccccagcaagaagaagagccagaagaagaacctggaggatgagaaggaggtgtgccccaaggccaagtctgaggagagctttgtgctgaatgagaccaagaagaacatcgtgaacacagatgtgccccaccagcaccctgagctgctgcacagcagcagcctggtgaagcccccagcccccaagacaggcagcatccagaacaacatgctgaccctgaacctggtgaagcagcacacaggcaagccagagagcaccctggagacctctgtgaaccaggacaccggccggggcggcttccacacctgctttgagaacctgaacagcaccaccatcaccctgaccaccagcaacagcgagagcatccaccagagcctggagacccaggaggtgctggaggtgaccaccagccacctggccaaccccaacttcaccagcaacagcatggagatcaagagcgcccaggagaaccccttcctgttcagcaccatcaaccagacagtggaggagctgaacaccaacaaggagagcgtcatcgccatctttgtgcctgctgagaacagcaagcccagcgtgaacagcttcatcagcgcccagaaggagaccacagagatggaggacacagacatcgaggacagcctgtacaaggatgtggactatggaacagaggtgctgcagatcgagcacagctactgccggcaggacatcaacaaggagcacctgtggcagaaggtgtccaagctgcacagcaagatcaccctgctggagctgaaggagcagcagaccctgggccgcctgaagagcctggaggccctgatccggcagctgaagcaggagaactggctgtctgaggagaatgtgaagatcatcgagaaccacttcaccacctatgaggtgaccatgatctag

SEQ ID NO: 173118 - DNA, 1188 bp, Artificial Sequence
  Description of Artificial Sequence: Synthetic coding sequence
atgccccgctactgtgccgccatctgctgcaagaacagaagaggaagaaacaacaaggacaggaagctgtccttctaccccttccccctgcatgacaaggagcggctggagaagtggctgaagaacatgaagagggacagctgggtgcccagcaagtaccagttcctgtgcagcgaccacttcaccccagacagcctggacatccgctggggcatccgctacctgaagcagacagctgtgcccaccatcttcagcctgcctgaggacaaccagggcaaggaccccagcaagaagaagagccagaagaagaacctggaggatgagaaggaggtgtgccccaaggccaagtctgaggagagctttgtgctgaatgagaccaagaagaacatcgtgaacacagatgtgccccaccagcaccctgagctgctgcacagcagcagcctggtgaagcccccagcccccaagacaggcagcatccagaacaacatgctgaccctgaacctggtgaagcagcacacaggcaagccagagagcaccctggagacctctgtgaaccaggacaccggccggggcggcttccacacctgctttgagaacctgaacagcaccaccatcaccctgaccaccagcaacagcgagagcatccaccagagcctggagacccaggaggtgctggaggtgaccaccagccacctggccaaccccaacttcaccagcaacagcatggagatcaagagcgcccaggagaaccccttcctgttcagcaccatcaaccagacagtggaggagctgaacaccaacaaggagagcgtcatcgccatctttgtgcctgctgagaacagcaagcccagcgtgaacagcttcatcagcgcccagaaggagaccacagagatggaggacacagacatcgaggacagcctgtacaaggatgtggactatggaacagaggtgctgcagatcgagcacagctactgccggcaggacatcaacaaggagcacctgtggcagaaggtgtccaagctgcacagcaagatcaccctgctggagctgaaggagcagcagaccctgggccgcctgaagagcctggaggccctgatccggcagctgaagcaggagaactggctgtctgaggagaatgtgaagatcatcgagaaccacttcaccacctatgaggtgaccatgatctag

SEQ ID NO: 173119 - DNA, 669 bp, Artificial Sequence
  Description of Artificial Sequence: Synthetic coding sequence
atggtgaagtgctgcagcgccatcggctgtgccagccgctgcctgcccaacagcaagctgaagggcctgaccttccacgtgttccccacagatgagaacatcaagaggaagtgggtgctggccatgaagaggctggatgtgaatgctgctggcatctgggagcccaagaagggagatgtgctgtgcagccgccacttcaagaagacagactttgacagaagtgcccccaacatcaagctgaagccaggagtcatccccagcatctttgacagcccctaccacctgcagggcaagcgggagaagctgcactgcaggaagaacttcaccctgaagacagtgcctgccaccaactacaaccaccacctggtgggcgccagcagctgcatcgaggagttccagagccagttcatctttgagcacagctacagcgtgatggacagccccaagaagctgaagcacaagctggaccacgtgattggagagctggaggacaccaaggagagcctgagaaatgtgctggaccgggagaagcgcttccagaagagcctgaggaagaccatccgggagctgaaggatgaatgtctcatcagccaggagacagccaaccggctggacaccttctgctgggactgctgccaggagagcattgagcaggactacatctcctag

SEQ ID NO: 173120 - DNA, 99 bp, Artificial Sequence
  Description of Artificial Sequence: Synthetic coding sequence
atggtgaagtgctgcagcgccatcggctgtgccagccgctgcctgcccaacagcaagctgaagggcctgaccttccacgtgttccccacagatgaatag

SEQ ID NO: 173121 - DNA, 243 bp, Artificial Sequence
  Description of Artificial Sequence: Synthetic coding sequence
atggtgaagtgctgcagcgccatcggctgtgccagccgctgcctgcccaacagcaagctgaagggcctgaccttccacgtgttccccacagatgagaacatcaagaggaagtgggtgctggccatgaagaggctggatgtgaatgctgctggcatctgggagcccaagaagggagatgtgctgtgcagccgccacttcaagaagacagactttgacagaagtgcccccaacatcaagctgtag

SEQ ID NO: 173122 - DNA, 669 bp, Artificial Sequence; identical to SEQ ID NO: 173119
  Description of Artificial Sequence: Synthetic coding sequence

SEQ ID NO: 173123 - DNA, 825 bp, Artificial Sequence
  Description of Artificial Sequence: Synthetic coding sequence
atgcccaagtactgccgggcccccaactgcagcaacacagctggccgcctgggcgctgacaacagacctgtgtccttctacaagttccccctgaaggatggcccccggctgcaggcctggctgcagcacatgggctgtgagcactgggtgcccagctgccaccagcacctgtgcagcgagcacttcacccccagctgcttccagtggcgctggggcgtgcgctacctgcggccagatgctgtgcccagcatcttcagccggggccccccagccaagagccagaggaggaccaggagcacccagaagcctgtgagccccccaccacccctgcagaagaacacccccctgccccagagccctgccatccctgtgtctggccctgtgcggctggtggtgctgggccccaccagcggcagccccaagacagtggccaccatgctgctgacccccctggccccagcccccaccccagagaggagccagcctgaggtgcctgcccagcaggcccagacaggcctgggccctgtgctgggcgccctgcagaggagagtgcggcggctgcagcgctgccaggagcggcaccaggcccagctgcaggccctggagcggctggcccagcagctgcatggagagagcctgctggcccgggcccggcggggcctgcagaggctgaccacagcccagaccctgggccctgaggagagccagaccttcaccatcatctgtggcggccctgacatcgccatggtgctggcccaggaccctgccccagccaccgtggatgccaagccagagctgctggacacccgcatccccagcgcctag

SEQ ID NO: 173124 - DNA, 825 bp, Artificial Sequence; identical to SEQ ID NO: 173123
  Description of Artificial Sequence: Synthetic coding sequence

SEQ ID NO: 173125 - DNA, 390 bp, Artificial Sequence
  Description of Artificial Sequence: Synthetic coding sequence
atgctgctgacccccctggccccagcccccaccccagagaggagccagcctgaggtgcctgcccagcaggcccagacaggcctgggccctgtgctgggcgccctgcagaggagagtgcggcggctgcagcgctgccaggagcggcaccaggcccagctgcaggccctggagcggctggcccagcagctgcacggggagagcctgctggcccgggcccggcggggcctgcagaggctgaccacagcccagaccctgggccctgaggagagccagaccttcaccatcatctgtggcggccctgacatcgccatggtgctggcccaggaccctgccccagccaccgtggatgccaagccagagctgctggacacccgcatccccagcgcctag

SEQ ID NO: 173126 - DNA, 2712 bp, Artificial Sequence
  Description of Artificial Sequence: Synthetic coding sequence
atgaccaggagctgcagcgctgtgggctgcagcacccgggacacagtgctgagccgggagcggggcctgtccttccaccagttccccacagacaccatccagaggagcaagtggatccgggctgtgaacagagtggaccccaggagcaagaagatctggatccctggccctggggccatcctgtgcagcaagcacttccaggagagtgactttgagagctatggcatccggaggaagctgaagaagggagctgtgcccagcgtgtccctgtacaagatcccccagggcgtgcacctgaagggcaaggcccggcagaagatcctgaagcagcccctgcctgacaacagccaggaggtggccacagaggaccacaactacagcctgaagacccccctgaccatcggggctgagaagctggccgaggtgcagcagatgctgcaggtgtccaagaagaggctcatctctgtgaagaactacaggatgatcaagaagaggaagggcctgcggctgattgatgccctggtggaggagaagctgctgtctgaggagacagaatgtctgctgcgggcccagttcagtgacttcaagtgggagctgtacaactggagggagacagatgagtacagcgctgagatgaagcagtttgcctgcaccctgtacctgtgcagcagcaaggtgtatgactatgtgaggaagatcctgaagctgccccacagcagcatcctgcggacctggctgagcaagtgccagcccagccctggcttcaacagcaacatcttctccttcctgcagaggagagtggagaatggagaccagctgtaccagtactgcagcctgctgatcaagtccatgcccctgaagcagcagctgcagtgggaccccagcagccacagcctgcagggcttcatggactttggcctgggcaagctggatgctgatgagacccccctggccagcgagaccgtgctgctgatggctgtgggcatcttcggccactggaggacccccctgggctacttctttgtgaacagagccagcggctacctgcaggcccagctgctgcggctgaccatcggcaagctgagtgacatcggcatcaccgtgctggccgtgaccagtgatgccacagcccacagcgtgcagatggccaaggccctgggcatccacattgatggagatgacatgaagtgcaccttccagcaccccagcagcagcagccagcagatcgcctacttctttgacagctgccacctgctgcggctcatcagaaatgccttccagaacttccagagcatccagttcatcaatggcatcgcccactggcagcacctggtggagctggtggccctggaggagcaggagctgagcaacatggagcgcatccccagcaccctggccaacctgaagaaccacgtgctgaaggtgaacagcgccacccagctgttcagcgagagcgtggccagcgccctggagtacctgctgagcctggacctgccccccttccagaactgcatcggcaccatccacttcctgcggctcatcaacaacctgtttgacatcttcaacagcaggaactgctacggcaagggcctgaagggccccctgctgcctgagacctacagcaagatcaaccacgtgctgattgaggccaagaccatctttgtgaccctgagtgacaccagcaacaaccagatcatcaagggcaagcagaagctgggcttcctgggcttcctgctgaatgctgagagcctgaagtggctgtaccagaactacgtgttccccaaggtgatgcccttcccctacctgctgacctacaagttcagccatgaccacctggagctgttcctgaagatgctgcggcaggtgctggtgaccagcagcagccccacctgcatggccttccagaaggcctactacaacctggagacccgctacaagttccaggatgaggtgttcctgagcaaggtgtccatctttgacatcagcatcgcccggaggaaggacctggccctgtggacagtgcagaggcagtatggagtgtctgtgaccaagacagtgttccacgaggagggcatctgccaggactggagccactgcagcctgtctgaggccctgctggacctgagtgaccacagaagaaacctgatctgctacgccggctacgtggccaacaagctgagcgccctgctgacctgtgaggactgcatcacagccctgtatgccagtgacctgaaggccagcaagattggcagcctgctgtttgtgaagaagaagaatggcctgcacttccccagcgagagcctgtgcagggtcatcaacatctgtgagcgggtggtgaggacccacagcaggatggccatctttgagctggtgtccaagcagcgggagctgtacctgcagcagaagatcctgtgtgagctgagcggccacatcaacctgtttgtggatgtgaacaagcacctgtttgatggagaggtgtgtgccatcaaccactttgtgaagctgctgaaggacatcatcatctgcttcctgaacatccgggccaagaatgtggcccagaaccccctgaagcaccacagcgagaggacagacatgaagaccctgagcaggaagcactggagctctgtgcaggactacaagtgcagcagctttgccaacaccagcagcaagttccgccacctgctgagcaatgatggctaccccttcaagtag

SEQ ID NO: 173127 - DNA, 2712 bp, Artificial Sequence; identical to SEQ ID NO: 173126
  Description of Artificial Sequence: Synthetic coding sequence

SEQ ID NO: 173128 - DNA, 642 bp, Artificial Sequence
  Description of Artificial Sequence: Synthetic coding sequence
atggtgcagagctgcagcgcctacggctgcaagaacagatatgacaaggacaagcctgtgtccttccacaagttccccctgacccggcccagcctgtgcaaggagtgggaggccgctgtgcggaggaagaacttcaagcccaccaagtacagcagcatctgcagcgagcacttcaccccagactgcttcaagcgggagtgcaacaacaagctgctgaaggaaaatgctgtgcccaccatcttcctgtgcacagagccccatgacaagaaggaggacctgctggagccccaggagcagctgcccccaccacccctgcccccacctgtgtcccaggtggatgctgccatcggcctgctgatgccacccctgcagacccctgtgaacctgagcgtcttctgtgaccacaactacacagtggaggacaccatgcaccagaggaagaggatccaccagctggagcagcaggtggagaagctgaggaagaagctgaagacagcccagcagcgctgccggcggcaggagcggcagctggagaagctgaaggaggtggtgcacttccagaaggagaaggatgatgtgtctgagcggggctacgtgatcctgcccaatgactactttgagatcgtggaggtgcctgcctag

SEQ ID NO: 173129 - DNA, 162 bp, Artificial Sequence
  Description of Artificial Sequence: Synthetic coding sequence
atggtgcagagctgcagcgcctacggctgcaagaacagatatgacaaggacaagcctgtgtccttccacaagaagaagatcttctggagccacaggaacagcttcccccacctgctgtaccgcctgctcttcccccggctgatgctgctgctggactactag

SEQ ID NO: 173130 - DNA, 687 bp, Artificial Sequence
  Description of Artificial Sequence: Synthetic coding sequence
atgcccaccaactgtgccgccgccggctgtgccaccacctacaacaagcacatcaacatctccttccaccgcttccccctggaccccaagaggaggaaggagtgggtgcggctggtgcggaggaagaactttgtgcctgggaagcacaccttcctgtgcagcaagcactttgaggccagctgctttgacctgaccggccagacccggcggctgaagatggatgctgtgcccaccatctttgacttctgcacccacatcaagtccatgaagctgaagagcaggaacctgctgaagaagaacaacagctgcagccctgctggccccagcaacctgaagagcaacatcagcagccagcaggtgctgctggagcacagctatgccttcaggaaccccatggaggccaagaagaggatcatcaagctggagaaggagatcgccagcctgcggaggaagatgaagacctgcctgcagaaggagcggcgggccacccggcgctggatcaaggccacctgcctggtgaagaacctggaggccaacagcgtgctgcccaagggcaccagcgagcacatgctgcccacagccctgagcagcctgcccctggaggacttcaagatcctggagcaggaccagcaggacaagaccctgctgagcctgaacctgaagcagaccaagagcaccttcatctag

SEQ ID NO: 173131 - DNA, 720 bp, Artificial Sequence
  Description of Artificial Sequence: Synthetic coding sequence
atgcccaagagctgtgccgcccggcagtgctgcaaccgctacagcagcaggaggaagcagctgaccttccaccgcttccccttcagcaggcctgagctgctgaaggagtgggtgctgaacatcggccggggcaacttcaagcccaagcagcacacagtcatctgcagcgagcacttccggcctgagtgcttcagcgcctttggaaacaggaagaacctgaagcacaatgctgtgcccaccgtgtttgccttccaggaccccacccagcaggtgagagaaaatacagatcctgccagcgagagaggaaatgccagcagcagccagaaggagaaggtgctgcctgaggccggggccggggaggacagccctggaagaaacatggacacagccctggaggagctgcagctgcccccaaatgctgagggccacgtgaagcaggtgagcccccggcggccccaggccacagaagctgtgggccggcccaccggccctgctggcctgcggaggacccccaacaagcagcccagcgaccacagctatgccctgctggacctggacagcctgaagaagaagctgttcctgaccctgaaggaaaatgagaagctgaggaagaggctgcaggcccagaggctggtgatgaggaggatgagcagccggctgcgggcctgcaagggccaccagggcctgcaggcccggctgggccctgagcagcagagctag

SEQ ID NO: 173132 - DNA, 717 bp, Artificial Sequence
  Description of Artificial Sequence: Synthetic coding sequence
atgcccaagagctgtgccgcccggcagtgctgcaaccgctacagcagcaggaggaagcagctgaccttccaccgcttccccttcagcaggcctgagctgctgaaggagtgggtgctgaacatcggccggggcaacttcaagcccaagcagcacacagtcatctgcagcgagcacttccggcctgagtgcttcagcgcctttggaaacaggaagaacctgaagcacaatgctgtgcccaccgtgtttgccttccaggaccccacccaggtgcgggagaacacagatcctgccagcgagagaggaaatgccagcagcagccagaaggagaaggtgctgcctgaggccggggccggggaggacagccctggcaggaacatggacacagccctggaggagctgcagctgcccccaaatgctgagggccacgtgaagcaggtgagcccccggcggccccaggccacagaggccgtgggccggcccactggacctgctggcctgcggaggacccccaacaagcagcccagcgaccacagctatgccctgctggacctggacagcctgaagaagaagctgttcctgaccctgaaggaaaatgagaagctgaggaagaggctgcaggcccagaggctggtgatgaggaggatgagcagccggctgcgggcctgcaagggccaccagggcctgcaggcccggctgggccctgagcagcagagctag

SEQ ID NO: 173133 - DNA, 528 bp, Artificial Sequence
  Description of Artificial Sequence: Synthetic coding sequence
atgcccaagagctgtgccgcccggcagtgctgcaaccgctacagcagcaggaggaagcagctgaccttccaccgcttccccttcagcaggcctgagctgctgaaggagtgggtgctgaacatcggccggggcaacttcaagcccaagcagcacacagtcatctgcagcgagcacttccggcctgagtgcttcagcgcctttggaaacaggaagaacctgaagcacaatgctgtgcccaccgtgtttgccttccaggaccccacccagcaggtgagagaaaatacagatcctgccagcgagagaggaaatgccagcagcagccagaaggagaagaccagcccctgccgcagccaggtgctgcctgaggccggggccggggaggacagccctggcaggaacatggacacagccctggaggagctgcagctgcccccaaatgctgagggccacgtgaagcaggccatgctgttcaacgtggagaatggcaccccagccagccgggaggccctgtggctgtctgaggagtag

SEQ ID NO: 173134 - DNA, 732 bp, Artificial Sequence
  Description of Artificial Sequence: Synthetic coding sequence
atggagcacgccttcacccccctggagcccctgctgagcacaggcaacctgaagtactgcctggtgatcctgaaccagcccctggacaactacttccgccacctgtggaacaaggccctgctgcgggcctgtgctgatggaggagccaaccggctgtatgacatcacagaaggagagcgggagagcttcctgcctgagttcatcaatggagactttgacagcatccggcctgaggtgcgggagtactatgccaccaagggctgtgagctgatcagcaccccagaccaggaccacacagacttcaccaagtgcctgaagatgctgcagaagaagattgaggagaaggacctgaaggtggatgtgattgtgaccctgggcggcctggccggccgctttgaccagatcatggcctctgtgaacaccctcttccaggccacccacatcacccccttccccatcatcatcatccaggaggagagcctcatctacctgctgcagcccgggaagcaccggctgcacgtggacaccggcatggagggggactggtgtggcctcatccctgtgggccagccctgcatgcaggtgaccaccaccggcctgaagtggaacctgaccaatgatgtgctggccttcggcaccctggtgtccaccagcaacacctatgatggcagcggcgtggtgacagtggagacagaccaccccctgctgtggaccatggccatcaagagctag

SEQ ID NO: 173135 - DNA, 585 bp, Artificial Sequence
  Description of Artificial Sequence: Synthetic coding sequence
atggagcacgccttcacccccctggagcccctgctgagcacaggcaacctgaagtactgcctggtgatcctgaaccagcccctggacaactacttccgccacctgtggaacaaggccctgctgcgggcctgtgctgatggaggagccaaccggctgtatgacatcacagaaggagagcgggagagcttcctgcctgagttcatcaatggagactttgacagcatccggcctgaggtgcgggagtactatgccaccaagggctgtgagctgatcagcaccccagaccaggaccacacagacttcaccaagtgcctgaagatgctgcagaagaagattgaggagaaggacctgaagggcaagcaccggctgcacgtggacaccggcatggagggggactggtgtggcctcatccctgtgggccagccctgcatgcaggtgaccaccaccggcctgaagtggaacctgaccaatgatgtgctggccttcggcaccctggtgtccaccagcaacacctatgatggcagcggcgtggtgacagtggagacagaccaccccctgctgtggaccatggccatcaagagctag

SEQ ID NO: 173136 - DNA, 375 bp, Artificial Sequence
  Description of Artificial Sequence: Synthetic coding sequence
atggtggatgtgattgtgaccctgggcggcctggccggccgctttgaccagatcatggcctctgtgaacaccctcttccaggccacccacatcacccccttccccatcatcatcatccaggaggagagcctcatctacctgctgcagcccgggaagcaccggctgcacgtggacaccggcatggagggggactggtgtggcctcatccctgtgggccagccctgcatgcaggtgaccaccaccggcctgaagtggaacctgcggacctgtgactacaccaggaccacctggatcgccaaggacaaccctgtgcccaggctcatccgcctcatccggctgaaccacatctgcaaggtgcccctggccatcaagtag

SEQ ID NO: 173137 - DNA, 504 bp, Artificial Sequence
  Description of Artificial Sequence: Synthetic coding sequence
atggagcacgccttcacccccctggagcccctgctgagcacaggcaacctgaagtactgcctggtgatcctgaaccagcccctggacaactacttccgccacctgtggaacaaggccctgctgcgggcctgtgctgatggaggagccaaccggctgtatgacatcacagaaggagagcgggagagcttcctgcctgagttcatcaatggagactttgacagcatccggcctgaggtgcgggagtactatgccaccaagggctgtgagctgatcagcaccccagaccaggaccacacagacttcaccaagtgcctgaagatgctgcagaagaagattgaggagaaggacctgaaggtggatgtgattgtgaccctgggcggcctggccggccgctttgaccagatcatggcctctgtgaacaccctcttccaggccacccacatcacccccttccccatcatcatcatccaggaggagagcctcatctacctgctgcagccctag

SEQ ID NO: 173138 - DNA, 693 bp, Artificial Sequence
  Description of Artificial Sequence: Synthetic coding sequence
atggcccagggcctcatcgaggtggagaggaagttcctgcccggccctggaacagaggagcggctgcaggagctgggcggcaccctggagtacagagtgaccttccgggacacctactatgacaccccagagctgagcctgatgcaggccgaccactggctgcggcggcgggaggacagcggctgggagctgaagtgccctggagctgctggggtgctgggcccccacacagagtacaaggagctgacagctgagcccaccatcgtggcccagctgtgcaaggtgctgcgggcagatggcctgggcgctggagatgtggccgctgtgctgggccccctgggcctgcaggaggtggccagctttgtgaccaagaggtctgcctggaagctggtgctgctgggcgcagatgaggaggagccccagctgcgggtggacctggacacagctgactttggctatgctgtgggggaggtggaggccctggtgcatgaggaggccgaggtgcccacagccctggagaagatccaccggctgagctccatgctgggcgtgcctgcccaggagacagccccagccaagctgattgtgtacctgcagcgcttccggccccaggactaccagaggctgctggaggtgaacagcagccgggagcggccccaggagacagaagatcctgaccactgcctgggctag

SEQ ID NO: 173139 - DNA, 693 bp, Artificial Sequence; identical to SEQ ID NO: 173138
  Description of Artificial Sequence: Synthetic coding sequence

SEQ ID NO: 173140 - DNA, 372 bp, Artificial Sequence
  Description of Artificial Sequence: Synthetic coding sequence
atggcccagggcctcatcgaggtggagaggaagttcctgcccggccctggaacagaggagcggctgcaggagctgggcggcaccctggagtacagagtgaccttccgggacacctactatgacaccccagagctgagcctgatgcaggccgaccactggctgcggcggcgggaggacagcggctgggagctgaagtgccctggagctgctggggtgctgggcccccacacagagtacaaggagctgacagctgagcccaccatcgtggcccagctgtgcaaggtgctgcgggcagatggcctgggcgctggagatgtggccgctgtgctgggccccctgggcctgcaggaggtggccagctttgtgacctag

SEQ ID NO: 173141 - DNA, 2070 bp, Artificial Sequence
  Description of Artificial Sequence: Synthetic coding sequence
atgaagcccccagctgcctgtgccggggacatggctgatgctgccagcccctgcagcgtggtgaatgacctgcgctgggacctgagcgcccagcagatcgaggagaggacccgggagctgattgagcagaccaagagggtgtatgaccaggtgggcacccaggagtttgaagatgtgtcctatgagagcaccctgaaggccctggctgatgtggaggtgacctacacagtgcagaggaacatcctggacttcccccagcacgtgagccccagcaaggacatcagaacagccagcacagaagctgacaagaagctgtctgaatttgatgtggagatgtccatgagagaagatgtgtaccagagaattgtgtggctgcaggagaaggtgcagaaggacagcctgcggcctgaggccgcccgctacctggagcggctcatcaagctgggcagaagaaatggcctgcacctgccccgggagacccaggagaacatcaagaggatcaagaagaagctgagcctgctgtgcatcgacttcaacaagaacctgaatgaagacaccaccttcctgcccttcaccctgcaggagctgggcggcctgcctgaggacttcctgaacagcctggagaagatggaggatggcaagctgaaggtgaccctgaagtacccccactacttccccctgctgaagaagtgccacgtgcctgagaccaggaggaaggtggaggaggccttcaactgccgctgcaaggaggagaactgtgccatcctgaaggagctggtgaccctgcgggcccagaagagccggctgctgggcttccacacccacgccgactatgtgctggagatgaacatggccaagaccagccagacagtggccaccttcctggatgagctggcccagaagctgaagcccctgggggagcaggagagagctgtgatcctggagctgaagagagcagaatgtgaaagaagaggcctgccctttgatggccgcatccgggcctgggacatgagatactacatgaaccaggtggaggagacccgctactgtgtggaccagaacctgctgaaggagtacttccctgtgcaggtggtgacccacggcctgctgggcatctaccaggagctgctgggcctggccttccaccacgaggagggcgccagcgcctggcatgaagatgtgcggctgtacacagccagagatgctgccagcggggaggtggtgggcaagttctacctggacctgtacccccgggagggcaagtatggccatgctgcctgcttcggcctgcagcccggctgcctgcggcaggacggcagccggcagatcgccatcgccgccatggtggccaacttcaccaagcccacagcagatgcccccagcctgctgcagcatgatgaggtggagacctacttccatgaatttggacatgtgatgcaccagctgtgcagccaggccgagtttgccatgttcagcggcacccacgtggagcgggactttgtggaggcccccagccagatgctggagaactgggtgtgggagcaggagcccctgctgaggatgagccgccactacagaactggatctgctgtgccccgggagctgctggagaagctgattgagagccggcaggccaacacaggcctcttcaacctgcggcagatcgtgctggccaaggtggaccaggccctgcacacccagacagatgctgaccctgctgaggagtatgcccggctgtgccaggagatcctgggcgtgcctgccaccccaggcaccaacatgcctgccaccttcggccacctggccggcggctatgatgcccagtactacggctacctgtggagcgaggtgtacagcatggacatgttccacacccgcttcaagcaggagggcgtgctgaacagcaaggtgggcatggactaccgcagctgcatcctgcggcctgggggctctgaagatgccagcgccatgctgcggcgcttcctgggccgggaccccaagcaggatgccttcctgctgagcaagggcctgcaggtgggcggctgtgagcctgagccccaggtgtgctag

SEQ ID NO: 173142 - DNA, 777 bp, Artificial Sequence
  Description of Artificial Sequence: Synthetic coding sequence
atgttttctggcacccacgtggagcgggactttgtggaggcccccagccagatgctggagaactgggtgtgggagcaggagcccctgctgaggatgagccgccactacagaacaggcagcgctgtgccccgggagctgctggagaagctgattgagagccggcaggccaacacaggcctcttcaacctgcggcagatcgtgctggccaaggtggaccaggccctgcacacccagacagatgctgaccctgctgaggagtatgcccggctgtgccaggagatcctgggcgtgcctgccaccccaggcaccaacatgcctgccaccttcggccacctggccggcggctatgatgcccagtactacggctacctgtggagcgaggtgtacagcatggacatgttccacacccgcttcaagcaggagggcgtgctgaacagcaagttcccccactatgaggtgcggcccctgcggcacgtgtccctgtgcctgcccctgacctggtgtgaccccggcagcggccagcccccagagagcctgaccaggaaccgctggctgcctgccctgcgggccggccctgccctgcccggctgcaacatcgccctgggcagcctgcaggtgggcatggactaccgcagctgcatcctgcggcctgggggctctgaagatgccagcgccatgctgcggcgcttcctgggccgggaccccaagcaggatgccttcctgctgagcaagggcctgcaggtgggcggctgtgagcctgagccccaggtgtgctag

SEQ ID NO: 173143 - DNA, 738 bp, Artificial Sequence
  Description of Artificial Sequence: Synthetic coding sequence
atggatggcaccaggaccagcctggacatcgaggagtacagcgacacagaggtgcagaagaaccaggtgctgaccctggaggagtggcaggacaagtgggtgaatggcaagacagccttccaccaggagcagggccaccagctgctgaagaagcacctggacaccttcctgaagggcaagagcggcctgcgggtcttcttccccctgtgtgggaaggctgtggagatgaagtggtttgctgaccggggccacagcgtggtgggcgtggagatcagcgagctgggcatccaggagttcttcacagagcagaacctgagctacagcgaggagcccatcacagagatccctggcaccaaggtgttcaagagcagcagcggcaacatcagcctgtactgctgcagcatctttgacctgcccaggaccaacatcggcaagtttgacatgatctgggacagaggagccctggtggccatcaaccctggggacaggaagtgctatgctgacaccatgttcagcctgctgggcaagaagttccagtacctgctgtgtgtgctgtcctatgaccccaccaagcaccctggcccccccttctacgtgccccacgccgagattgaaagactctttgggaagatctgcaacatccgctgcctggagaaggtggatgcctttgaggagcggcacaagtcctggggcatcgactgcctgtttgagaagctgtacctgctgacagagaagtag

SEQ ID NO: 173144 - DNA, 519 bp, Artificial Sequence
  Description of Artificial Sequence: Synthetic coding sequence
atggagacccggccccggctgggcgccacctgcctgctgggcttctccttcctgctgctggtgatcagcagtgatggccacaacggcctgggcaagggctttggagaccacatccactggaggaccctggaggatggcaagaaggaggccgccgccagcggcctgcccctgatggtgatcatccacaagtcctggtgtggggcctgcaaggccctgaagcccaagtttgctgagagcacagagatcagcgagctgagccacaactttgtgatggtgaacctggaggatgaggaggagcccaaggatgaggacttctccccagatggcggctacatcccccgcatcctcttcctggaccccagcggcaaggtgcaccctgagatcatcaatgaaaatggaaaccccagctacaagtacttctacgtgtctgctgagcaggtggtgcagggcatgaaggaggcccaggagcggctgactggagatgccttcaggaagaagcacctggaggatgagctgtag

SEQ ID NO: 173145 - DNA, 1767 bp, Artificial Sequence
  Description of Artificial Sequence: Synthetic coding sequence
atggccagcaagaagcgggaggtgcagctgcagaccgtcatcaacaaccagagcctgtgggatgagatgctgcagaacaagggcctgactgtgattgatgtgtaccaggcctggtgtggcccctgccgggccatgcagcccctcttcaggaagctgaagaatgagctgaatgaagatgagatcctgcactttgctgtggccgaggccgacaacatcgtgaccctgcagcccttccgggacaagtgtgagcccgtcttcctgttctctgtgaatggcaagatcatcgagaagatccagggcgccaatgcccccctggtgaacaagaaggtgatcaacctgattgatgaggagaggaagattgctgctggggagatggcccggccccagtacccagagatccccctggtggacagcgacagcgaggtgtctgaggagagcccctgtgagagcgtgcaggagctgtacagcatcgccatcatcaagccagatgctgtgatcagcaagaaggtgctggagatcaagaggaagatcaccaaggccggcttcatcatcgaggccgagcacaagacagtgctgacagaggagcaggtggtgaacttctacagcagaattgctgaccagtgtgactttgaggagtttgtgtccttcatgaccagcggcctgagctacatcctggtggtgtcccagggcagcaagcacaaccccccatctgaggagacagagccccagacagacacagagcccaatgaaagaagtgaggaccagcctgaggtggaggcccaggtgaccccaggcatgatgaagaacaagcaggacagcctgcaggagtacctggagcggcagcacctggcccagctgtgtgacattgaagaagatgctgccaacgtggccaagttcatggatgccttcttcccagacttcaagaagatgaagtccatgaagctggagaagaccctggccctgctgcggcccaacctcttccacgagaggaaggatgatgtgctgcgcatcatcaaggatgaggacttcaagatcctggagcagaggcaggtggtgctgtctgagaaggaggcccaggccctgtgcaaggagtatgaaaatgaagactacttcaacaagctgattgagaacatgaccagcggccccagcctggccctggtgctgctgcgggacaatggcctgcagtactggaagcagctgctgggccccaggacagtggaggaggccatcgagtacttccctgagagcctgtgtgcccagtttgccatggacagcctgcctgtgaaccagctgtatggcagtgacagcctggagacagctgagcgggagatccagcacttcttccccctgcagagcaccctgggcctcatcaagccccacgccaccagcgagcagcgggagcagatcctgaagatcgtgaaggaggccggctttgacctgacccaggtgaagaagatgttcctgaccccagagcagatcgagaagatctaccccaaggtgacaggcaaggacttctacaaggacctgctggagatgctgtctgtgggccccagcatggtgatgatcctgaccaagtggaatgctgtggccgagtggaggcggctgatgggccccacagatcctgaggaggccaagctgctgagcccagacagcatccgggcccagtttggcatcagcaagctgaagaacatcgtgcacggggccagcaatgcctatgaggccaaggaggtggtgaacagactctttgaagatcctgaagaaaattag

SEQ ID NO: 173146 - DNA, 1767 bp, Artificial Sequence; identical to SEQ ID NO: 173145
  Description of Artificial Sequence: Synthetic coding sequence

SEQ ID NO: 173147 - DNA, 681 bp, Artificial Sequence
  Description of Artificial Sequence: Synthetic coding sequence
atggaggctgatgcctctgtggacatgttcagcaaggtgctggagcaccagctgctgcagaccaccaagctggtggaggagcacctggacagcgagatccagaagctggaccagatggatgaagatgagctggagcggctgaaggagaagaggctgcaggccctgaggaaggcccagcagcagaagcaggagtggctgagcaagggccacggggagtaccgggagatccccagcgagcgggacttcttccaggaggtgaaggagagtgaaaatgtggtgtgccacttctacagagacagcaccttccgctgcaagatcctggacagacacctggccatcctgagcaagaagcacctggagaccaagttcctgaagctgaatgtggagaaggcccccttcctgtgtgagcggctgcacatcaaggtgatccccaccctggccctgctgaaggatggcaagacccaggactatgtggtgggcttcacagacctgggcaacacagatgacttcaccacagagaccctggagtggaggctgggcagcagtgacatcctgaactacagcggcaacctgatggagccccccttccagaaccagaagaagtttggcaccaacttcaccaagctggagaagaagaccatccggggcaagaagtatgacagcgacagtgatgatgactag

SEQ ID NO: 173148 - DNA, 408 bp, Artificial Sequence
  Description of Artificial Sequence: Synthetic coding sequence
atggaggctgatgcctctgtggacatgttcagcaaggtgctggagcaccagctgctgcagaccaccaagctggtggaggagcacctggacagcgagatccagaagctggaccagatggatgaagatgagctggagcggctgaaggagaagaggctgcaggccctgaggaaggcccagcagcagaagcaggagtggctgagcaagggccacggggagtaccgggagatccccagcgagcgggacttcttccaggaggtgaaggagagtgaaaatgtggtgtgccacttctacagagacagcaccttccgctgcaagatcctggacagacacctggccatcctgagcaagaagcacctggagaccaagttcctgaagctgaatgtggagaaggcccccttcctgtgctag

SEQ ID NO: 173149 - DNA, 627 bp, Artificial Sequence
  Description of Artificial Sequence: Synthetic coding sequence
atgagccagaagagcctggccccccggctgaacagcgtgccctttggaaggatggaggctgatgcctctgtggacatgttcagcaaggtgctggagcaccagctgctgcagaccaccaagctggtggaggagcacctggacagcgagatccagaagctggaccagatggatgaagatgagctggagcggctgaaggagaagaggctgcaggccctgaggaaggcccagcagcagaagcaggagtggctgagcaaaggacatggagagtaccgggagatccccagcgagcgggacttcttccaggaggtgaaggagagtgaaaatgtggtgtgccacttctacagagacagcaccttccgctgcaagatcctggacagacacctggccatcctgagcaagaagcacctggagaccaagttcctgaagctgaatgtggagaaggcccccttcctgtgtgagcggctgcacatcaaggtgatccccaccctggccctgctgaaggatggcaagacccaggactatgtggtgggcttcacagacctgggcaacacagatgacttcaccacagagaccctggagtggaggctgggcagcagtgacatcctgaactaccgctggtggccctag

SEQ ID NO: 173150 - DNA, 1017 bp, Artificial Sequence
  Description of Artificial Sequence: Synthetic coding sequence
atggccgccatggctgtggccctgcggggcctgggcggccgcttccgctggaggacccaggccgtggccggcggcgtgagaggagctgcccggggagctgctgctggccagagggactatgacctgctggtggtgggcggcggcagcggcggcctggcctgtgccaaggaggccgcccagctgggcaggaaggtggccgtggtggactatgtggagcccagcccccagggcacccgctggggcctgggcggcacctgtgtgaatgtgggctgcatccccaagaagctgatgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccaccggcggccggccccgctaccccacccacatcgagggcgccctggagtatggcatcaccagtgatgacatcttctggctgaaggagagccctgggaagaccctggtggtgggcgccagctatgtggccctggagtgtgccggcttcctgaccggcatcggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcgccccctgcatcagcgcctgcctgcccaccaccgtgggccatgctgggaagaaccagaggcgggactag

SEQ ID NO: 173151 - DNA, 1479 bp, Artificial Sequence
  Description of Artificial Sequence: Synthetic coding sequence
atggaggaccaggccggccagagggactatgacctgctggtggtgggcggcggcagcggcggcctggcctgtgccaaggaggccgcccagctgggcaggaaggtggccgtggtggactatgtggagcccagcccccagggcacccgctggggcctgggcggcacctgtgtgaatgtgggctgcatccccaagaagctgatgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccaccggcggccggccccgctaccccacccacatcgagggcgccctggagtatggcatcaccagtgatgacatcttctggctgaaggagagccctgggaagaccctggtggtgggcgccagctatgtggccctggagtgtgccggcttcctgaccggcatcggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcggccgggtgcctgacaccaggagcctgaacctggagaaggccggcgtggacaccagcccagacacccagaagatcctggtggacagccgggaggccacctctgtgccccacatctatgccatcggagatgtggtggagggccggcctgagctgacccccatcgccatcatggccggccgcctgctggtgcagaggctgtttggaggcagcagtgacctgatggactatgacaacgtgcccaccaccgtcttcacccccctggagtatggctgtgtgggcctgtctgaggaggaggccgtggcccggcacggccaggagcacgtggaggtgtaccacgcccactacaagcccctggagttcaccgtggccggcagagatgccagccagtgctacgtgaagatggtgtgcctgcgggagcccccccagctggtgctgggcctgcacttcctgggccccaatgctggggaggtgacccagggctttgccctgggcatcaagtgtggggccagctatgcccaggtgatgaggacagtgggcatccaccccacctgcagcgaggaggtggtgaagctgcgcatcagcaagaggagcggcctggaccccaccgtgacaggctgctag

SEQ ID NO: 173152 - DNA, 1569 bp, Artificial Sequence
  Description of Artificial Sequence: Synthetic coding sequence
atggccgccatggctgtggccctgcggggcctgggcggccgcttccgctggaggacccaggccgtggccggcggcgtgagaggagctgcccggggagctgctgctggccagagggactatgacctgctggtggtgggcggcggcagcggcggcctggcctgtgccaaggaggccgcccagctgggcaggaaggtggccgtggtggactatgtggagcccagcccccagggcacccgctggggcctgggcggcacctgtgtgaatgtgggctgcatccccaagaagctgatgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccaccggcggccggccccgctaccccacccacatcgagggcgccctggagtatggcatcaccagtgatgacatcttctggctgaaggagagccctgggaagaccctggtggtgggcgccagctatgtggccctggagtgtgccggcttcctgaccggcatcggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcggccgggtgcctgacaccaggagcctgaacctggagaaggccggcgtggacaccagcccagacacccagaagatcctggtggacagccgggaggccacctctgtgccccacatctatgccatcggagatgtggtggagggccggcctgagctgacccccatcgccatcatggccggccgcctgctggtgcagaggctgtttggaggcagcagtgacctgatggactatgacaacgtgcccaccaccgtcttcacccccctggagtatggctgtgtgggcctgtctgaggaggaggccgtggcccggcacggccaggagcacgtggaggtgtaccacgcccactacaagcccctggagttcaccgtggccggcagagatgccagccagtgctacgtgaagatggtgtgcctgcgggagcccccccagctggtgctgggcctgcacttcctgggccccaatgctggggaggtgacccagggctttgccctgggcatcaagtgtggggccagctatgcccaggtgatgaggacagtgggcatccaccccacctgcagcgaggaggtggtgaagctgcgcatcagcaagaggagcggcctggaccccaccgtgacaggctgctag

SEQ ID NO: 173153 - DNA, 1566 bp, Artificial Sequence
  Description of Artificial Sequence: Synthetic coding sequence
atggccgccatggctgtggccctgcggggcctgggcggccgcttccgctggaggacccaggccgtggccggcggcgtgagaggagctgcccggggagctgctggccagagggactatgacctgctggtggtgggcggcggcagcggcggcctggcctgtgccaaggaggccgcccagctgggcaggaaggtggccgtggtggactatgtggagcccagcccccagggcacccgctggggcctgggcggcacctgtgtgaatgtgggctgcatccccaagaagctgatgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccactggaggccggccccgctaccccacccacattgaaggagccctggagtatggcatcaccagtgatgacatcttctggctgaaggagagccctgggaagaccctggtggtgggcgccagctatgtggccctggagtgtgccggcttcctgactggaattggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcggccgggtgcctgacaccaggagcctgaacctggagaaggccggcgtggacaccagcccagacacccagaagatcctggtggacagccgggaggccacctctgtgccccacatctatgccatcggagatgtggtggagggccggcctgagctgacccccatcgccatcatggccggccgcctgctggtgcagaggctgtttggaggcagcagtgacctgatggactatgacaacgtgcccaccaccgtcttcacccccctggagtatggctgtgtgggcctgtctgaggaggaggccgtggcccggcacggccaggagcacgtggaggtgtaccacgcccactacaagcccctggagttcaccgtggccggcagagatgccagccagtgctacgtgaagatggtgtgcctgcgggagcccccccagctggtgctgggcctgcacttcctgggccccaatgctggggaggtgacccagggctttgccctgggcatcaagtgtggggccagctatgcccaggtgatgaggacagtgggcatccaccccacctgcagcgaggaggtggtgaagctgcgcatcagcaagaggagcggcctggaccccaccgtgacaggctgctag

SEQ ID NO: 173154 - DNA, 1569 bp, Artificial Sequence
  Description of Artificial Sequence: Synthetic coding sequence
atggccgccatggctgtggccctgcggggcctgggcggccgcttccgctggaggacccaggccgtggccggcggcgtgagaggagctgcccggggagctgctgctggccagagggactatgacctgctggtggtgggcggcggcagcggcggcctggcctgtgccaaggaggccgcccagctgggcaggaaggtggccgtggtggactatgtggagcccagcccccagggcacccgctggggcctgggcggcacctgtgtgaatgtgggctgcatccccaagaagctgatgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccaccggcggccggccccgctaccccacccacatcgagggcgccctggagtatggcatcaccagtgatgacatcttctggctgaaggagagccctgggaagaccctgcctgtgtctgtgtcctatgtggccctggagtgtgccggcttcctgaccggcatcggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcggccgggtgcctgacaccaggagcctgaacctggagaaggccggcgtggacaccagcccagacacccagaagatcctggtggacagccgggaggccacctctgtgccccacatctatgccatcggagatgtggtggagggccggcctgagctgacccccatcgccatcatggccggccgcctgctggtgcagaggctgtttggaggcagcagtgacctgatggactatgacaacgtgcccaccaccgtcttcacccccctggagtatggctgtgtgggcctgtctgaggaggaggccgtggcccggcacggccaggagcacgtggaggtgtaccacgcccactacaagcccctggagttcaccgtggccggcagagatgccagccagtgctacgtgaagatggtgtgcctgcgggagcccccccagctggtgctgggcctgcacttcctgggccccaatgctggggaggtgacccagggctttgccctgggcatcaagtgtggggccagctatgcccaggtgatgaggacagtgggcatccaccccacctgcagcgaggaggtggtgaagctgcgcatcagcaagaggagcggcctggaccccaccgtgacaggctgctag

SEQ ID NO: 173155 - DNA, 1281 bp, Artificial Sequence
  Description of Artificial Sequence: Synthetic coding sequence
atgcaccaggccgccctgctgggcggcctcatccaggatgcccccaactacggctgggaggtggcccagcctgtgccccatgactggaggaagatggccgaggccgtgcagaaccacgtgaagagcctgaactggggccaccgggtgcagctgcaggacaggaaggtgaagtacttcaacatcaaggccagctttgtggatgagcacacagtgtgtggggtggccaagggcggcaaggagatcctgctgtctgctgaccacatcatcatcgccaccggcggccggccccgctaccccacccacatcgagggcgccctggagtatggcatcaccagtgatgacatcttctggctgaaggagagccctgggaagacctgtgtggtggcccacgcctacgtggccctggagtgtgccggcttcctgaccggcatcggcctggacaccaccatcatgatgaggagcatccccctgcggggctttgaccagcagatgagctccatggtgattgagcacatggccagccacggcacccgcttcctgcggggctgtgcccccagccgggtgcggcggctgcctgatggccagctgcaggtgacctgggaggacagcaccaccgggaaggaggacaccggcacctttgacacagtgctgtgggccatcggccgggtgcctgacaccaggagcctgaacctggagaaggccggcgtggacaccagcccagacacccagaagatcctggtggacagccgggaggccacctctgtgccccacatctatgccatcggagatgtggtggagggccggcctgagctgacccccatcgccatcatggccggccgcctgctggtgcagaggctgtttggaggcagcagtgacctgatggactatgacaacgtgcccaccaccgtcttcacccccctggagtatggctgtgtgggcctgtctgaggaggaggccgtggcccggcacggccaggagcacgtggaggtgtaccacgcccactacaagcccctggagttcaccgtggccggcagagatgccagccagtgctacgtgaagatggtgtgcctgcgggagcccccccagctggtgctgggcctgcacttcctgggccccaatgctggggaggtgacccagggctttgccctgggcatcaagtgtggggccagctatgcccaggtgatgaggacagtgggcatccaccccacctgcagcgaggaggtggtgaagctgcgcatcagcaagaggagcggcctggaccccaccgtgacaggctgctag

SEQ ID NO: 173156 - DNA, 1479 bp, Artificial Sequence; identical to SEQ ID NO: 173151
  Description of Artificial Sequence: Synthetic coding sequence

SEQ ID NO: 173157 - DNA, 429 bp, Artificial Sequence
  Description of Artificial Sequence: Synthetic coding sequence
atgagctacatgctgccccacctgcacaacggctggcaggtggaccaggccatcctgtctgaggaggacagagtggtggtgatccgcttcggccatgactgggaccccacctgcatgaagatggatgaggtgctgtacagcattgctgagaaggtgaagaactttgctgtgatctacctggtggacatcacagaggtgcctgacttcaacaagatgtatgagctgtatgacccctgcaccgtgatgttcttcttcaggaacaagcacatcatgattgacctgggcaccggcaacaacaacaagatcaactgggccatggaggacaagcaggagatggtggacatcatcgagaccgtgtacagaggagccaggaagggccggggcctggtggtgagccccaaggactacagcaccaagtaccgctactag

SEQ ID NO: 173158 - DNA, 276 bp, Artificial Sequence
  Description of Artificial Sequence: Synthetic coding sequence
atgagctacatgctgccccacctgcacaacggctggcaggtggaccaggccatcctgtctgaggaggacagagtggtggtgatccgcttcggccatgactgggaccccacctgcatgaagatggatgaggtgctgtacagcattgctgagaaggtgaagaactttgctgtgatctacctggtggacatcacagaggtgcctgacttcaacaagatgtatgagctgtatgacccctgcaccgtgatgttcttcttctcctaccaccggggctggtag

SEQ ID NO: 173159 - DNA, 894 bp, Artificial Sequence
  Description of Artificial Sequence: Synthetic coding sequence
atggtgcaccaggtgctgtaccgggccctggtgtccaccaagtggctggccgagagcatcagaacaggcaagctgggccctggcctgcgggtgctggatgcctcctggtacagccctggcacccgggaggccaggaaggagtacctggagcggcacgtgcctggggccagcttctttgatattgaagaatgtcgggacacagccagcccctatgagatgatgctgcccagcgaggccggctttgctgaatatgtgggccgcctgggcatcagcaaccacacccacgtggtggtgtatgatggagagcacctgggcagcttctacgccccccgggtgtggtggatgttccgggtgtttggccacaggacagtgtctgtgctgaatggaggcttcaggaactggctgaaggagggccaccctgtgaccagcgagcccagcaggcctgagcctgctgtgttcaaggccaccctggacaggagcctgctgaagacctatgagcaggtgctggagaacctggagagcaagcgcttccagctggtggacagccgcagccagggccgcttcctgggcacagagcctgagccagatgctgtgggcctggacagcggccacatcagaggagctgtgaacatgcccttcatggacttcctgacagaagatggctttgagaagggccctgaggagctgcgggccctcttccagaccaagaaggtggacctgagccagcccctgattgccacctgcaggaagggcgtgacagcctgccacgtggccctggccgcctacctgtgtgggaagccagatgtggccgtgtatgatggctcctggagcgagtggttcagaagagcccctcctgagagccgggtgtcccagggcaagtctgagaaggcctag

SEQ ID NO: 173160 - DNA, 894 bp, Artificial Sequence; identical to SEQ ID NO: 173159
  Description of Artificial Sequence: Synthetic coding sequence

SEQ ID NO: 173161 - DNA, 735 bp, Artificial Sequence
  Description of Artificial Sequence: Synthetic coding sequence
atggtgcaccaggtgctgtaccgggccctggtgtccaccaagtggctggccgagagcatcagaacaggcaagctgggccctggcctgcgggtgctggatgcctcctggtacagccctggcacccgggaggccaggaaggagtacctggagcggcacgtgcctggggccagcttctttgatattgaagaatgtcgggacacagccagcccctatgagatgatgctgcccagcgaggccggctttgctgaatatgtgggccgcctgggcatcagcaaccacacccacgtggtggtgtatgatggagagcacctgggcagcttctacgccccccgggtgtggtggatgttccgggtgtttggccacaggacagtgtctgtgctgaatggaggcttcaggaactggctgaaggagggccaccctgtgaccagcgagcccagcaggcctgagcctgctgtgttcaaggccaccctggacaggagcctgctgaagacctatgagcaggtgctggagaacctggagagcaagcgcttccagctggtggacagccgcagccagggccgcttcctgggcacagagcctgagccagatgctgtgggcctggacagcggccacatcagaggagctgtgaacatgcccttcatggacttcctgacagaagatggctcctggagcgagtggttccggcgggcccctcctgagagccgggtgtcccagggcaagtctgagaaggcctag

SEQ ID NO: 173162 - DNA, 375 bp, Artificial Sequence
  Description of Artificial Sequence: Synthetic coding sequence
atggtgcaccaggtgctgtaccgggccctggtgtccaccaagtggctggccgagagcatcagaacaggcaagctgggccctggcctgcgggtgctggatgcctcctggtacagccctggcacccgggaggccaggaaggagtacctggagcggcacgtgcctggggccagcttctttgatattgaagaatgtcgggacacagccagcccctatgagatgatgctgcccagcgaggccggctttgctgaatatgtgggccgcctgggcatcagcaaccacacccacgtggtggtgtatgatggagagcacctgggcagcttctacgccccccgggtgtggtggatgttccgggtgtttggccacaggacagtgtag

SEQ ID NO: 173163 - DNA, 1974 bp, Artificial Sequence
  Description of Artificial Sequence: Synthetic coding sequence
atgagccccaccccacccctcttcagcctgcctgaggcccggacccgcttcaccaagagcacccgggaggccctgaacaacaagaacatcaagcccctgctgagcaccttcagccaggtgcccggctctgaaaatgagaagaagtgcaccctggaccaggccttccggggcatcctggaggaggagatcatcaaccacagcagctgtgaaaatgtgctggccatcatcagcctggccatcggcggcgtgacagagggcatctgcacagccagcaccccatttgtgctgctgggagatgtgctggactgcctgcccctggaccagtgtgacaccatcttcacctttgtggagaagaatgtggccacctggaagagcaacaccttctacagcgctgggaagaactacctgctgaggatgtgcaatgacctgctgcggcggctgagcaagagccagaacacagtgttctgtggccgcatccagctgttcctggcccggctcttccccctgtctgagaagagcggcctgaacctgcagagccagttcaacctggagaatgtgacagtgttcaacaccaatgagcaggagagcaccctgggccagaagcacacagaggaccgggaggagggcatggatgtggaggagggggagatgggagatgaggaggcccccaccacctgcagcatccccatcgactacaacctgtacaggaagttctggagcctgcaggactacttcaggaaccctgtgcagtgctatgagaagatctcctggaagaccttcctgaagtacagcgaggaggtgctggccgtgttcaagagctacaagctggatgacacccaggccagcaggaagaagatggaggagctgaagacaggaggagaacatgtgtactttgccaagttcctgaccagcgagaagctgatggacctgcagctgagtgacagcaacttccgccgccacatcctgctgcagtacctgatcctcttccagtacctgaagggccaggtgaagttcaagagcagcaactacgtgctgacagatgagcagagcctgtggattgaggacaccaccaagtctgtgtaccagctgctgtctgagaaccccccagatggagagcgcttcagcaagatggtggagcacatcctgaacacagaggagaactggaacagctggaagaatgaaggctgccccagctttgtgaaggagaggaccagtgacaccaagcccacccgcatcatcaggaagaggacagcccctgaggacttcctgggcaagggccccaccaagaagatcctgatgggaaatgaggagctgacccggctgtggaacctgtgcccagacaacatggaggcctgcaagtctgagacccgggagcacatgcccaccctggaggagttctttgaggaggccatcgagcaggccgaccctgagaacatggtggagaatgagtacaaggctgtgaacaacagcaactacggctggagggccctgcggctgctggcccggcgcagcccccacttcttccagcccaccaaccagcagttcaagagcctgcctgagtacctggagaacatggtgatcaagctggccaaggagctgcccccaccttctgaggagatcaagacaggagaagatgaagatgaagaagataatgatgccctgctgaaggaaaatgaatctccagatgtgcggcgggacaagcctgtgactggagagcagatcgaggtgtttgccaacaagctgggggagcagtggaagatcctggccccctacctggagatgaaggacagcgagatccggcagattgaatgtgacagcgaggacatgaagatgagggccaagcagctgctggtggcctggcaggaccaggagggcgtgcacgccaccccagaaaatctcatcaatgccctgaacaagagcggcctgagtgacctggccgagagcctgaccaatgacaatgagaccaacagctag

SEQ ID NO: 173164 - DNA, 4782 bp, Artificial Sequence
  Description of Artificial Sequence: Synthetic coding sequence
atggctgctgctgctgtggtggtgcctgctgagtggatcaagaactgggagaagagcggccgcggggagttcctgcacctgtgccgcatcctgtctgagaacaagagccatgacagcagcacctacagagacttccagcaggccctgtatgagctgagctaccacgtgatcaagggcaacctgaagcatgagcaggccagcaatgtgctgagtgacatcagcgagttccgggaggacatgcccagcatcctggctgatgtgttctgcatcctggacatcgagaccaactgcctggaggagaagagcaagagggactacttcacccagctggtgctggcctgcctgtacctggtgtctgacacagtgctgaaggagcggctggaccctgagaccctggagagcctgggcctcatcaagcagagccagcagttcaaccagaagtctgtgaagatcaagaccaagctgttctacaagcagcagaagttcaacctgctgcgggaggagaatgaaggctacgccaagctgattgctgagctgggccaggacctgagcggcagcatcaccagtgacctgatcctggagaacatcaagagcctcatcggctgcttcaacctggaccccaacagagtgctggatgtgatcctggaggtgtttgaatgtagacctgagcatgatgacttcttcatcagcctgctggagagctacatgtccatgtgtgagccccagaccctgtgccacatcctgggcttcaagttcaagttctaccaggagcccaatggagagacccccagcagcctgtacagagtggccgctgtgctgctgcagttcaacctgattgacctggatgacctgtatgtgcacctgctgcctgctgacaactgcatcatggatgagcacaagcgggagattgctgaggccaagcagatcgtgaggaagctgaccatggtggtgctgagcagcgagaagatggatgagcgggagaaggagaaggagaaggaggaggagaaggtggagaagcccccagacaaccagaagctgggcctgctggaggccctgctgaagattggagactggcagcacgcccagaacatcatggaccagatgccaccctactatgctgccagccacaagctgattgccctggccatctgcaagctgatccacatcaccatcgagcccctgtaccgccgggtgggcgtgcccaagggggccaagggcagccctgtgaatgccctgcagaacaagagggcccccaagcaggccgagagctttgaggacctgcggagagatgtgttcaacatgttctgctacctgggcccccacctgagccatgaccccatcctgtttgccaaggtggtgagaattggcaagagcttcatgaaggagttccagagtgatggcagcaagcaggaggacaaggagaagacagaggtgatcctgagctgcctgctgagcatcacagaccaggtgctgctgcccagcctgagcctgatggactgcaatgcctgcatgtctgaggagctgtggggcatgttcaagaccttcccctaccagcaccgctaccgcctgtatggccagtggaagaatgagacctacaacagccaccccctgctggtgaaggtgaaggcccagaccatcgaccgggccaagtacatcatgaagaggctgaccaaggaaaatgtgaagcccagcggccggcagatcggcaagctgagccacagcaaccccaccatcctgtttgactacatcctgagccagatccagaagtatgacaacctgatcacccctgtggtggacagcctgaagtacctgaccagcctgaactatgatgtgctggcctactgcatcatcgaggccctggccaaccctgagaaggagaggatgaagcatgatgacaccaccatcagctcctggctgcagagcctggccagcttctgtggggctgtgttcaggaagtaccccatcgacctggccggcctgctgcagtatgtggccaaccagctgaaggccggcaagagctttgacctgctgatcctgaaggaggtggtgcagaagatggccggcatcgagatcacagaggagatgaccatggagcagctggaggccatgactggaggagagcagctgaaggccgagggcggctacttcggccagatccggaacaccaagaagagcagccagaggctgaaggatgccctgctggaccatgacctggccctgcccctgtgcctgctgatggcccagcagagaaatggagtcatcttccaggagggcggggagaagcacctgaagctggtgggcaagctgtatgaccagtgccacgacaccctggtgcagtttggaggcttcctggccagcaacctgagcacagaggactacatcaagagggtgcccagcattgatgtgctgtgcaatgagttccacacccctcatgatgctgccttcttcctgagccggcccatgtatgcccaccacatcagcagcaaatatgatgagctgaagaagtctgagaagggcagcaagcagcagcacaaggtgcacaagtacatcaccagctgtgagatggtgatggcccctgtgcatgaagctgtggtgtccctgcacgtgtccaaggtgtgggatgacatcagcccccagttctacgccaccttctggagcctgaccatgtatgacctggccgtgccccacaccagctatgagcgggaggtgaacaagctgaaggtgcagatgaaggccattgatgacaaccaggagatgccacccaacaagaagaagaaggagaaggagcgctgcacagccctgcaggacaagctgctggaggaggagaagaagcagatggagcacgtgcagagggtgctgcagaggctgaagctggagaaggacaactggctgctggccaagagcaccaagaatgagaccatcaccaagttcctgcagctgtgcatcttcccccgctgcatcttcagcgccattgatgctgtgtactgtgccaggtttgtggagctggtgcaccagcagaagacccccaacttcagcaccctgctgtgctatgacagagtcttcagtgacatcatctacacagtggccagctgcacagaaaatgaggccagccgctatggccgcttcctgtgctgcatgctggagaccgtgacccgctggcacagcgaccgggccacctatgagaaggaatgtggcaactacccaggcttcctgaccatcctgcgggccactggatttgatggcggcaacaaggctgaccagctggactatgagaacttcagacatgtggtgcacaagtggcactacaagctgaccaaggcctctgtgcactgcctggagaccggggagtacacccacatccggaacatcctgattgtgctgaccaagatcctgccctggtaccccaaggtgctgaacctgggccaggccctggagcggcgggtgcacaagatctgccaggaggagaaggagaagaggccagacctgtatgccctggccatgggctacagcggccagctgaagagcaggaagagctacatgatcccagaaaatgagttccaccacaaggaccccccaccaagaaatgctgtggcctctgtgcagaatggacctgggggcggccccagcagcagcagcatcggcagcgccagcaagagtgatgagagcagcacagaggagacagacaagagccgggagaggagccagtgtggggtgaaggctgtgaacaaggccagcagcaccacccccaagggcaacagcagcaatggaaacagcggcagcaacagcaacaaggctgtgaaggaaaatgacaaggagaagggcaaggagaaggagaaggagaagaaggagaagaccccagccaccaccccagaggcccgggtgctgggcaaggatggcaaggagaagcccaaggaggagcggcccaacaaggatgagaaggcccgggagaccaaggagaggacccccaagagtgacaaggagaaggagaagttcaagaaggaggagaaggccaaggatgagaagttcaagaccaccgtgcccaatgctgagagcaagagcacccaggagcgggagcgggagaaggagcccagccgggagcgggacatcgccaaggagatgaagagcaaagaaaatgtgaagggcggggagaagacccctgtgtctggcagcctgaagagccctgtgcccaggagtgacatccctgagcctgagcgggagcagaagaggaggaagattgacacccaccccagccccagccacagcagcacagtgaaggacagcctgattgagctgaaggagagcagcgccaagctgtacatcaaccacaccccaccacccctgagcaagagcaaggagcgggagatggacaagaaggacctggacaagagccgggagaggagccgggagcgggagaagaaggatgagaaggacaggaaggagaggaagagggaccacagcaacaatgaccgggaggtgcccccagacctgaccaagaggaggaaggaggagaatggcaccatgggcgtgtccaagcacaagtctgagagcccctgtgagagcccctacccaaatgagaaggacaaggagaagaacaagagcaagagcagcggcaaggagaagggcagtgacagcttcaagtctgagaagatggacaagatcagcagcggcggcaagaaggagagcagacatgacaaggagaagattgagaagaaggagaagagggacagcagcggcggcaaggaggagaagaagcaccacaagagcagtgacaagcacaggtag

SEQ ID NO: 173165 - DNA, 4782 bp, Artificial Sequence; identical to SEQ ID NO: 173164
  Description of Artificial Sequence: Synthetic coding sequence

SEQ ID NO: 173166 - DNA, 2547 bp, Artificial Sequence
  Description of Artificial Sequence: Synthetic coding sequence
atgcccagcatcctggctgatgtgttctgcatcctggacatcgagaccaactgcctggaggagaagagcaagagggactacttcacccagctggtgctggcctgcctgtacctggtgtctgacacagtgctgaaggagcggctggaccctgagaccctggagagcctgggcctcatcaagcagagccagcagttcaaccagaagtctgtgaagatcaagaccaagctgttctacaagcagcagaagttcaacctgctgcgggaggagaatgaaggctacgccaagctgattgctgagctgggccaggacctgagcggcagcatcaccagtgacctgatcctggagaacatcaagagcctgattggctgcttcaacctggaccccaacagagtgctggatgtgatcctggaggtgtttgagtgcaggcctgagcatgatgacttcttcatcagcctgctggagagctacatgtccatgtgtgagccccagaccctgtgccacatcctgggcttcaagttcaagttctaccaggagcccaacggggagacccccagcagcctgtacagagtggccgctgtgctgctgcagttcaacctgattgacctggatgacctgtatgtgcacctgctgcctgctgacaactgcatcatggatgagcacaagcgggagattgctgaggccaagcagatcgtgaggaagctgaccatggtggtgctgagcagcgagaagatggatgagcgggagaaggagaaggagaaggaggaggagaaggtggagaagcccccagacaaccagaagctgggcctgctggaggccctgctgaagatcggggactggcagcacgcccagaacatcatggaccagatgccaccctactatgctgccagccacaagctgattgccctggccatctgcaagctgatccacatcaccatcgagcccctgtacagaagagtgggcgtgcccaagggggccaagggcagccctgtgaatgccctgcagaacaagagggcccccaagcaggccgagagctttgaggacctgcggagagatgtgttcaacatgttctgctacctgggcccccacctgagccatgaccccatcctgtttgccaaggtggtgcgcatcggcaagagcttcatgaaggagttccagagtgatggcagcaagcaggaggacaaggagaagacagaggtgatcctgagctgcctgctgagcatcacagaccaggtgctgctgcccagcctgagcctgatggactgcaatgcctgcatgtctgaggagctgtggggcatgttcaagaccttcccctaccagcaccgctaccgcctgtatggccagtggaagaatgagacctacaacagccaccccctgctggtgaaggtgaaggcccagaccatcgaccgggccaagtacatcatgaagaggctgaccaaggaaaatgtgaagcccagcggccggcagatcggcaagctgagccacagcaaccccaccatcctgtttgattatgtgtgctttgagatcctgagccagatccagaagtatgacaacctgatcacccctgtggtggacagcctgaagtacctgaccagcctgaactatgatgtgctggcctactgcatcatcgaggccctggccaaccctgagaaggagaggatgaagcatgatgacaccaccatcagctcctggctgcagagcctggccagcttctgtggggctgtgttcaggaagtaccccatcgacctggccggcctgctgcagtatgtggccaaccagctgaaggccggcaagagctttgacctgctgatcctgaaggaggtggtgcagaagatggccggcatcgagatcacagaggagatgaccatggagcagctggaggccatgactggaggagagcagctgaaggccgagggcggctacttcggccagatccggaacaccaagaagagcagccagaggctgaaggatgccctgctggaccatgacctggccctgcccctgtgcctgctgatggcccagcagagaaatggagtcatcttccaggagggcggggagaagcacctgaagctggtgggcaagctgtatgaccagtgccacgacaccctggtgcagtttggaggcttcctggccagcaacctgagcacagaggactacatcaagagggtgcccagcattgatgtgctgtgcaatgagttccacacccctcatgatgctgccttcttcctgagccggcccatgtatgcccaccacatcagcagcaaatatgatgagctgaagaagtctgagaagggcagcaagcagcagcacaaggtgcacaagtacatcaccagctgtgagatggtgatggcccctgtgcatgaggccgtggtgtccctgcacgtgtccaaggtgtgggatgacatcagcccccagttctacgccaccttctggagcctgaccatgtatgacctggccgtgccccacaccagctatgaaagagaggtgaacaagctgaaggtgcagatgaaggccattgatgacaaccaggagatgatccccccccagtag

SEQ ID NO: 173167 - DNA, 570 bp, Artificial Sequence
  Description of Artificial Sequence: Synthetic coding sequence
tgagagcagaagaggaggaagattgacacccaccccagccccagccacagcagcacagtgaaggacagcctgattgagctgaaggagagcagcgccaagctgtacatcaaccacaccccaccacccctgagcaagagcaaggagcgggagatggacaagaaggacctggacaagagccgggagaggagccgggagcgggagaagaaggatgagaaggacaggaaggagaggaagagggaccacagcaacaatgaccgggaggtgcccccagacctgaccaagaggaggaaggaggagaatggcaccatgggcgtgtccaagcacaagtctgagagcccctgtgagagcccctacccaaatgagaaggacaaggagaagaacaagagcaagagcagcggcaaggagaagggcagtgacagcttcaagtctgagaagatggacaagatcagcagcggcggcaagaaggagagcagacatgacaaggagaagattgagaagaaggagaagagggacagcagcggcggcaaggaggagaagaagcaccacaagagcagtgacaagcacaggtag

SEQ ID NO: 173168 - DNA, 1056 bp, Artificial Sequence
  Description of Artificial Sequence: Synthetic coding sequence
atggctgtgcctgctgctgccatgggccccagcgccctgggccagagcggccctggctccatggccccctggtgcagcgtgagcagcggccccagccgctacgtgctgggcatgcaggagctgttccggggccacagcaagacccgggagttcctggcccacagcgccaaggtgcacagcgtggcctggagctgtgatggccggcggctggccagcggcagctttgacaagacagccagcgtcttcctgctggagaaggaccggctggtgaaggagaacaactaccggggccacggggacagcgtggaccagctgtgctggcaccccagcaacccagacctgtttgtgacagccagcggggacaagaccatccgcatctgggatgtgaggaccaccaagtgcatcgccaccgtgaacaccaagggggagaacatcaacatctgctggagcccagatggccagaccatcgctgtgggcaacaaggatgatgtggtgaccttcattgatgccaagacccacaggagcaaggccgaggagcagttcaagtttgaggtgaatgagatctcctggaacaatgacaacaacatgttcttcctgaccaatggaaatggctgcatcaacatcctgagctacccagagctgaagcctgtgcagagcatcaatgcccaccccagcaactgcatctgcatcaagtttgaccccatgggcaagtactttgccactggatctgcagatgccctggtgtccctgtgggatgtggatgagctggtgtgtgtgcgctgcttcagccggctggactggcctgtgaggaccctgtccttcagccatgatggcaagatgctggccagcgccagcgaggaccacttcatcgacattgctgaggtggagactggagacaagctgtgggaggtgcagtgtgagagccccaccttcaccgtggcctggcaccccaagaggcccctgctggcctttgcctgtgatgacaaggatggcaagtatgacagcagccgggaggccggcaccgtgaagctgtttggcctgcccaatgacagctag

SEQ ID NO: 173169 - DNA, 2052 bp, Artificial Sequence
  Description of Artificial Sequence: Synthetic coding sequence
atgagcagcgagagcagcaagaagaggaagcccaaggtgatccgcagtgatggagccccagctgagggcaagaggaacagaagtgacacagagcaggagggcaagtactacagcgaggaggccgaggtggacctgcgggaccccggccgggactatgagctgtacaagtacacctgccaggagctgcagaggctgatggccgagatccaggacctgaagagccggggcggcaaggatgtggccatcgagattgaggagcggcgcatccagagctgtgtgcacttcatgaccctgaagaagctgaaccggctggcccacatccggctgaagaagggccgggaccagacccatgaggccaagcagaaggtggatgcctaccacctgcagctgcagaacctgctgtatgaggtgatgcacctgcagaaggagatcaccaagtgcctggagttcaagagcaagcatgaggagattgacctggtgtccctggaggagttctacaaggaggcccccccagacatcagcaaggccgaggtgaccatgggagacccccaccagcagaccctggcccggctggactgggagctggagcagaggaagaggctggccgagaagtacagagaatgtctgagcaacaaggagaagatcctgaaggagattgaggtgaagaaggagtacctgagcagcctgcagccccggctgaacagcatcatgcaggccagcctgcctgtgcaggagtacctgttcatgccctttgaccaggcccacaagcagtatgaaacagcccggcacctgcccccacccctgtatgtgctgtttgtgcaggccacagcctacggccaggcctgtgacaagaccctgtctgtggccatcgagggctctgtggatgaggccaaggccctcttcaagcccccagaggacagccaggatgatgaaagtgacagtgatgctgaggaggagcagaccaccaagagaagaagacccaccctgggcgtgcagctggatgacaagaggaaggagatgctgaagaggcaccccctgtctgtgatgctggacctgaagtgcaaggatgacagcgtgctgcacctgaccttctactacctgatgaacctgaacatcatgacagtgaaggccaaggtgaccacagccatggagctgatcacccccatctctgctggggacctgctgagcccagattctgtgctgagctgcctgtacccaggggaccacggcaagaagacccccaacccagccaaccagtaccagtttgacaaggtgggcatcctgaccctgagtgactatgtgctggagctgggccacccctacctgtgggtgcagaagctgggcggcctgcacttccccaaggagcagccccagcagacagtgattgctgaccacagcctgagcgccagccacatggagaccaccatgaagctgctgaagaccagggtgcagagccggctggccctgcacaagcagtttgccagcctggagcacggcatcgtgcctgtgaccagtgactgccagtacctgtttcctgccaaggtggtgtcccggctggtgaagtgggtgacagtggcccacgaggactacatggagctgcacttcaccaaggacatcgtggatgctggcctggccggggacaccaacctgtactacatggccctgattgaaagaggaacagccaagctgcaggccgctgtggtgctgaaccctggctacagcagcatcccccctgtgttccagctgtgcctgaactggaagggggagaagaccaacagcaatgatgacaacatccgggccatggagggggaggtgaatgtgtgctacaaggagctgtgtggcccctggcccagccaccagctgctgaccaaccagctgcagaggctgtgtgtgctgctggatgtgtacctggagacagagagccatgatgattctgtggagggccccaaggagttcccccaggagaagatgtgcctgcggctcttccggggccccagcaggatgaagcccttcaagtacaaccacccccagggcttcttcagccacaggtag

SEQ ID NO: 173170 - DNA, 2052 bp, Artificial Sequence; identical to SEQ ID NO: 173169
  Description of Artificial Sequence: Synthetic coding sequence

SEQ ID NO: 173171 - DNA, 2052 bp, Artificial Sequence; identical to SEQ ID NO: 173169
  Description of Artificial Sequence: Synthetic coding sequence

SEQ ID NO: 173172 - DNA, 282 bp, Artificial Sequence
  Description of Artificial Sequence: Synthetic coding sequence
atgagcagcgagagcagcaagaagaggaagcccaaggtgatccgcagtgatggagccccagctgagggcaagaggaacagaagtgacacagagcaggagggcaagtactacagcgaggaggccgaggtggacctgcgggaccccggccgggactatgagctgtacaagtacacctgccaggagctgcagaggctgatggccgagatccaggacctgaagagccggggcggcaaggatgtggccatcgagattgaggagcggcgcatccagagctgtgtgtag

SEQ ID NO: 173173 - DNA, 486 bp, Artificial Sequence
  Description of Artificial Sequence: Synthetic coding sequence
atgagcagcgagagcagcaagaagaggaagcccaaggtgatccgcagtgatggagccccagctgagggcaagaggaacagaagtgacacagagcaggagggcaagtactacagcgaggaggccgaggtggacctgcgggaccccggccgggactatgagctgtacaagtacacctgccaggagctgcagaggctgatggccgagatccaggacctgaagagccggggcggcaaggatgtggccatcgagattgaggagcggcgcatccagagctgtgtgcacttcatgaccctgaagaagctgaaccggctggcccacatccggctgaagaagggccgggaccagacccatgaggccaagcagaaggtggatgcctaccacctgcagctgcagaacctgctgtatgaggtgatgcacctgcagaaggagatcaccaagtgcctggagttcaagagcaagcatgaggagattgacctggtgtcctag

SEQ ID NO: 173174 - DNA, 672 bp, Artificial Sequence
  Description of Artificial Sequence: Synthetic coding sequence
atgagcagcgagagcagcaagaagaggaagcccaaggtgatccgcagtgatggagccccagctgagggcaagaggaacagaagtgacacagagcaggagggcaagtactacagcgaggaggccgaggtggacctgcgggaccccggccgggactatgagctgtacaagtacacctgccaggagctgcagaggctgatggccgagatccaggacctgaagagccggggcggcaaggatgtggccatcgagattgaggagcggcgcatccagagctgtgtgcacttcatgaccctgaagaagctgaaccggctggcccacatccggctgaagaagggccgggaccagacccatgaggccaagcagaaggtggatgcctaccacctgcagctgcagaacctgctgtatgaggtgatgcacctgcagaaggagatcaccaagtgcctggagttcaagagcaagcatgaggagattgacctggtgtccctggaggagttctacaaggaggcccccccagacatcagcaaggccgaggtgaccatgggagacccccaccagcagaccctggcccggctggactgggagctggagcagaggaagaggctggccgagaagtacagagaatgtctgagcaacaaggagaagatcctgaaggagattgaggtgaagaagtag

SEQ ID NO: 173175 - DNA, 2052 bp, Artificial Sequence; identical to SEQ ID NO: 173169
  Description of Artificial Sequence: Synthetic coding sequence

SEQ ID NO: 173176 - DNA, 615 bp, Artificial Sequence
  Description of Artificial Sequence: Synthetic coding sequence
atgggcgctgtgacagatgatgaagtcatcaggaagaggctgctgattgatggagatggagctggagatgaccggcgcatcaacctgctggtgaagagcttcatcaagtggtgcaacagcggcagccaggaggagggctacagccagtaccagaggatgctgagcaccctgagccagtgtgagttctccatgggcaagaccctgctggtgtatgacatgaacctgcgggagatggagaactatgagaagatctacaaggagattgaatgttccattgctggggcccacgagaagattgctgagtgcaagaagcagatcctgcaggccaagaggatcaggaagaaccggcaggagtatgatgccctggccaaggtgatccagcaccacccagacagacatgagaccctgaaggagctggaggccctgggcaaggagctggagcacctgagccacatcaaggagagcgtggaggacaagctggagctgcggaggaagcagttccacgtgctgctgagcaccatccacgagctgcagcagaccctggagaatgatgagaagctgtctgaggtggaggaggcccaggaggcctccatggagacagaccccaagccctag

SEQ ID NO: 173177 - DNA, 711 bp, Artificial Sequence
  Description of Artificial Sequence: Synthetic coding sequence
atgtctgaggcccccagggctgagacctttgtgttcctggacctggaggccaccggcctgcccagcgtggagcctgagattgctgagctgagcctgtttgctgtgcacaggagcagcctggagaaccctgagcatgatgagagcggggccctggtgctgccccgggtgctggacaagctgaccctgtgcatgtgcccagagcggcccttcaccgccaaggccagcgagatcaccggcctgagcagcgagggcctggcccgctgcaggaaggccggctttgatggagctgtggtgaggaccctgcaggccttcctgagccggcaggccggccccatctgcctggtggcccacaacggctttgattatgacttccccctgctgtgtgccgagctgcggcggctgggcgcccggctgccccgggacacagtgtgcctggacaccctgcctgccctgcggggcctggaccgggcccacagccacggcacccgggcccggggccggcagggctacagcctgggcagcctcttccaccgctacttccgggcagagcccagcgctgcccacagcgcagaaggagatgtgcacaccctgctgctgatcttcctgcacagagctgctgagctgctggcctgggcagatgagcaggcccggggctgggcccacatcgagcccatgtacctgcccccagatgaccccagcctggaggcctag

SEQ ID NO: 173178 - DNA, 840 bp, Artificial Sequence
  Description of Artificial Sequence: Synthetic coding sequence
atgggccgggccggcagccccctgcccaggagctcctggcccaggatggatgactgtggcagccgcagccgctgcagccccaccctgtgcagcagcctgcggacctgctacccccggggcaacatcaccatgtctgaggcccccagggctgagacctttgtgttcctggacctggaggccaccggcctgcccagcgtggagcctgagattgctgagctgagcctgtttgctgtgcacaggagcagcctggagaaccctgagcatgatgaaagtggggccctggtgctgccccgggtgctggacaagctgaccctgtgcatgtgcccagagcggcccttcaccgccaaggccagcgagatcaccggcctgagcagcgagggcctggcccgctgcaggaaggccggctttgatggagctgtggtgaggaccctgcaggccttcctgagccggcaggccggccccatctgcctggtggcccacaatggatttgattatgacttccccctgctgtgtgccgagctgcggcggctgggcgcccggctgccccgggacacagtgtgcctggacaccctgcctgccctgcggggcctggaccgggcccacagccacggcacccgggcccggggccggcagggctacagcctgggcagcctcttccaccgctacttccgggcagagcccagcgctgcccacagcgcagaaggagatgtgcacaccctgctgctgatcttcctgcacagagctgctgagctgctggcctgggcagatgagcaggcccggggctgggcccacatcgagcccatgtacctgcccccagatgaccccagcctggaggcctag

SEQ ID NO: 173179 - DNA, 711 bp, Artificial Sequence; identical to SEQ ID NO: 173177
  Description of Artificial Sequence: Synthetic coding sequence

SEQ ID NO: 173180 - DNA, 711 bp, Artificial Sequence; identical to SEQ ID NO: 173177
  Description of Artificial Sequence: Synthetic coding sequence

SEQ ID NO: 173181 - DNA, 840 bp, Artificial Sequence; identical to SEQ ID NO: 173178
  Description of Artificial Sequence: Synthetic coding sequence

SEQ ID NO: 173182 - DNA, 711 bp, Artificial Sequence; identical to SEQ ID NO: 173177
  Description of Artificial Sequence: Synthetic coding sequence

SEQ ID NO: 173183 - DNA, 840 bp, Artificial Sequence; identical to SEQ ID NO: 173178
  Description of Artificial Sequence: Synthetic coding sequence

SEQ ID NO: 173184 - DNA, 837 bp, Artificial Sequence
  Description of Artificial Sequence: Synthetic coding sequence
atgattgtggccgctgaggccgtggccgccccccgctgtgccctggtgggggacagaagtggagcagatgccccccgggccaagggccacagcctgcggacctgctacccccggggcaacatcaccatgtctgaggcccccagggctgagacctttgtgttcctggacctggaggccaccggcctgcccagcgtggagcctgagattgctgagctgagcctgtttgctgtgcacaggagcagcctggagaaccctgagcatgatgagagcggggccctggtgctgccccgggtgctggacaagctgaccctgtgcatgtgcccagagcggcccttcaccgccaaggccagcgagatcaccggcctgagcagcgagggcctggcccgctgcaggaaggccggctttgatggagctgtggtgaggaccctgcaggccttcctgagccggcaggccggccccatctgcctggtggcccacaacggctttgattatgacttccccctgctgtgtgccgagctgcggcggctgggcgcccggctgccccgggacacagtgtgcctggacaccctgcctgccctgcggggcctggaccgggcccacagccacggcacccgggcccggggccggcagggctacagcctgggcagcctcttccaccgctacttccgggcagagcccagcgctgcccacagcgcagaaggagatgtgcacaccctgctgctgatcttcctgcacagagctgctgagctgctggcctgggcagatgagcaggcccggggctgggcccacatcgagcccatgtacctgcccccagatgaccccagcctggaggcctag

SEQ ID NO: 173185 - DNA, 2172 bp, Artificial Sequence
  Description of Artificial Sequence: Synthetic coding sequence
atgtttgaggagaaggccagcagccccagcggcaagatgggcggggaggagaagcccatcggggccggggaggagaagcagaaggagggcggcaagaagaagaacaaggagggcagcggagatggcggccgggcagagctgaacccctggccagagtacatctacacccggctggagatgtacaacatcctgaaggccgagcatgacagcatcctggccgagaaggccgagaaggacagcaagcccatcaaggtgaccctgcctgatggcaagcaggtggatgctgagagctggaagaccaccccctaccagatcgcctgtggcatcagccagggcctggccgacaacacagtgattgccaaggtgaacaacgtggtgtgggacctggaccggcccctggaggaggactgcaccctggagctgctgaagtttgaagatgaggaggcccaggccgtgtactggcacagcagcgcccacatcatgggagaggccatggagcgggtgtatggaggctgcctgtgctacggcccccccattgaaaatggcttctactatgacatgtacctggaggagggcggcgtgagcagcaatgacttcagcagcctggaggccctgtgcaagaagatcatcaaggagaagcaggcctttgagcggctggaggtgaagaaggagaccctgctggccatgttcaagtacaacaagttcaagtgccgcatcctgaatgagaaggtgaacacccccaccaccaccgtgtaccgctgtggccccctgattgacctgtgccggggcccccacgtgcgccacacaggcaagatcaaggccctgaagatccacaagaacagcagcacctactgggagggcaaggctgacatggagaccctgcagaggatctacggcatctccttcccagaccccaagatgctgaaggagtgggagaagttccaggaggaggccaagaacagagaccacaggaagattggccgggaccaggagctgtacttcttccacgagctgagccctggcagctgcttcttcctgcccaagggggcctacatctacaatgccctgattgagttcatccgctctgagtacaggaagaggggcttccaggaggtggtgacccccaacatcttcaacagccggctgtggatgaccagcggccactggcagcactacagcgagaacatgttctcctttgaggtggagaaggagctgtttgccctgaagcccatgaactgccccggccactgcctgatgtttgaccaccggcccaggtcctggagggagctgcccctgcggctggccgactttggagtgctgcacagaaatgagctgagcggggccctgaccggcctgaccagggtgcggcgcttccagcaggatgatgcccacatcttctgtgccatggagcagattgaagatgagatcaagggctgcctggacttcctgaggacagtgtacagcgtgtttggcttctccttcaagctgaacctgagcaccaggcctgagaagttcctgggggacatcgaggtgtgggaccaggccgagaagcagctggagaacagcctgaatgaatttggagagaagtgggagctgaacagcggagatggagccttctacggccccaagattgacatccagatcaaggatgccatcggccgctaccaccagtgtgccaccatccagctggacttccagctgcccatccgcttcaacctgacctacgtgtcccatgatggagatgacaagaagaggcctgtgattgtgcaccgggccatcctgggctctgtggagaggatgattgccatcctgacagagaactacggcggcaagtggcccttctggctgagcccccggcaggtgatggtggtgcctgtgggccccacctgtgatgaatatgcccagaaggtgcggcagcagttccatgatgccaagttcatggctgacatcgacctggaccccggctgcaccctgaacaagaagatcagaaatgcccagctggcccagtacaacttcatcctggtggtgggggagaaggagaagatctctggaacagtgaacatccgcacccgggacaacaaggtgcacggggagaggaccatcagcgagaccatcgagcggctgcagcagctgaaggagttccgcagcaagcaggccgaggaggagttctag

SEQ ID NO: 173186 - DNA, 1809 bp, Artificial Sequence
  Description of Artificial Sequence: Synthetic coding sequence
atgatccccttctggcagaagaggcagaagaagatcgccagccagctgaagagcctgtgcctgatggtgaaccggctgatgaggaacctgggcaagctgcaccacatcaagctgcctgtggagctggccatggagcgggtgtatggaggctgcctgtgctacggcccccccattgaaaatggcttctactatgacatgtacctggaggagggcggcgtgagcagcaatgacttcagcagcctggaggccctgtgcaagaagatcatcaaggagaagcaggcctttgagcggctggaggtgaagaaggagaccctgctggccatgttcaagtacaacaagttcaagtgccgcatcctgaatgagaaggtgaacacccccaccaccaccgtgtaccgctgtggccccctgattgacctgtgccggggcccccacgtgcgccacacaggcaagatcaaggccctgaagatccacaagaacagcagcacctactgggagggcaaggctgacatggagaccctgcagaggatctacggcatctccttcccagaccccaagatgctgaaggagtgggagaagttccaggaggaggccaagaacagagaccacaggaagattggccgggaccaggagctgtacttcttccacgagctgagccctggcagctgcttcttcctgcccaagggggcctacatctacaatgccctgattgagttcatccgctctgagtacaggaagaggggcttccaggaggtggtgacccccaacatcttcaacagccggctgtggatgaccagcggccactggcagcactacagcgagaacatgttctcctttgaggtggagaaggagctgtttgccctgaagcccatgaactgccccggccactgcctgatgtttgaccaccggcccaggtcctggagggagctgcccctgcggctggccgactttggagtgctgcacagaaatgagctgagcggggccctgaccggcctgaccagggtgcggcgcttccagcaggatgatgcccacatcttctgtgccatggagcagattgaagatgagatcaagggctgcctggacttcctgaggacagtgtacagcgtgtttggcttctccttcaagctgaacctgagcaccaggcctgagaagttcctgggggacatcgaggtgtgggaccaggccgagaagcagctggagaacagcctgaatgaatttggagagaagtgggagctgaacagcggagatggagccttctacggccccaagattgacatccagatcaaggatgccatcggccgctaccaccagtgtgccaccatccagctggacttccagctgcccatccgcttcaacctgacctacgtgtcccatgatggagatgacaagaagaggcctgtgattgtgcaccgggccatcctgggctctgtggagaggatgattgccatcctgacagaaaattatggaggcaagtggcccttctggctgagcccccggcaggtgatggtggtgcctgtgggccccacctgtgatgaatatgcccagaaggtgcggcagcagttccatgatgccaagttcatggctgacatcgacctggaccccggctgcaccctgaacaagaagatcagaaatgcccagctggcccagtacaacttcatcctggtggtgggggagaaggagaagatcagcggcaccgtgaacatccgcacccgggacaacaaggtgcatggagagaggaccatcagcgagaccatcgagcggctgcagcagctgaaggagttccgcagcaagcaggccgaggaggagttctag

SEQ ID NO: 173187 - DNA, 2271 bp, Artificial Sequence
  Description of Artificial Sequence: Synthetic coding sequence
atgtttgaggagaaggccagcagccccagcggcaagatgggcggggaggagaagcccatcggggccggggaggagaagcagaaggagggcggcaagaagaagaacaaggagggcagcggagatggcggccgggcagagctgaacccctggccagagtacatctacacccggctggagatgtacaacatcctgaaggccgagcatgacagcatcctggccgagaaggccgagaaggacagcaagcccatcaaggtgaccctgcctgatggcaagcaggtggatgctgagagctggaagaccaccccctaccagatcgcctgtggcatcagccacacagccagctgcaagaacctgagcagcctggccagcctgctggcctctgtggccatccccagcagcggcatgccctggccacccctcttcttcctgcagggcctggccgacaacacagtcatcgccaaggtgaacaacgtggtgtgggacctggaccggcccctggaggaggactgcaccctggagctgctgaagtttgaagatgaggaggcccaggccgtgtactggcacagcagcgcccacatcatgggagaggccatggagcgggtgtatggaggctgcctgtgctacggcccccccattgaaaatggcttctactatgacatgtacctggaggagggcggcgtgagcagcaatgacttcagcagcctggaggccctgtgcaagaagatcatcaaggagaagcaggcctttgagcggctggaggtgaagaaggagaccctgctggccatgttcaagtacaacaagttcaagtgccgcatcctgaatgagaaggtgaacacccccaccaccaccgtgtaccgctgtggccccctgattgacctgtgccggggcccccacgtgcgccacacaggcaagatcaaggccctgaagatccacaagaacagcagcacctactgggagggcaaggctgacatggagaccctgcagaggatctacggcatctccttcccagaccccaagatgctgaaggagtgggagaagttccaggaggaggccaagaacagagaccacaggaagattggccgggaccaggagctgtacttcttccacgagctgagccctggcagctgcttcttcctgcccaagggggcctacatctacaatgccctgattgagttcatccgctctgagtacaggaagaggggcttccaggaggtggtgacccccaacatcttcaacagccggctgtggatgaccagcggccactggcagcactacagcgagaacatgttctcctttgaggtggagaaggagctgtttgccctgaagcccatgaactgccccggccactgcctgatgtttgaccaccggcccaggtcctggagggagctgcccctgcggctggccgactttggagtgctgcacagaaatgagctgagcggggccctgaccggcctgaccagggtgcggcgcttccagcaggatgatgcccacatcttctgtgccatggagcagattgaagatgagatcaagggctgcctggacttcctgaggacagtgtacagcgtgtttggcttctccttcaagctgaacctgagcaccaggcctgagaagttcctgggggacatcgaggtgtgggaccaggccgagaagcagctggagaacagcctgaatgaatttggagagaagtgggagctgaacagcggagatggagccttctacggccccaagattgacatccagatcaaggatgccatcggccgctaccaccagtgtgccaccatccagctggacttccagctgcccatccgcttcaacctgacctacgtgtcccatgatggagatgacaagaagaggcctgtgattgtgcaccgggccatcctgggctctgtggagaggatgattgccatcctgacagaaaattatggaggcaagtggcccttctggctgagcccccggcaggtgatggtggtgcctgtgggccccacctgtgatgaatatgcccagaaggtgcggcagcagttccatgatgccaagttcatggctgacatcgacctggaccccggctgcaccctgaacaagaagatcagaaatgcccagctggcccagtacaacttcatcctggtggtgggggagaaggagaagatcagcggcaccgtgaacatccgcacccgggacaacaaggtgcatggagagaggaccatcagcgagaccatcgagcggctgcagcagctgaaggagttccgcagcaagcaggccgaggaggagttctag

SEQ ID NO: 173188 - DNA, 2172 bp, Artificial Sequence; identical to SEQ ID NO: 173185
  Description of Artificial Sequence: Synthetic coding sequence

SEQ ID NO: 173189 - DNA, 390 bp, Artificial Sequence
  Description of Artificial Sequence: Synthetic coding sequence
atgtttgaggagaaggccagcagccccagcggcaagatgggcggggaggagaagcccatcggggccggggaggagaagcagaaggagggcggcaagaagaagaacaaggagggcagcggagatggcggccgggcagagctgaacccctggccagagtacatctacacccggctggagatgtacaacatcctgaaggccgagcatgacagcatcctggccgagaaggccgagaaggacagcaagcccatcaaggtgaccctgcctgatggcaagcaggtggatgctgagagctggaagaccaccccctaccagatcgcctgtggcatcagccagggcctggccgacaacacagtgattgccaaggtgaacaacgtggtgtgggacctgtag

SEQ ID NO: 173190 - DNA, 1860 bp, Artificial Sequence
  Description of Artificial Sequence: Synthetic coding sequence
atggaggtggagctgagccagggcctggccgacaacacagtgattgccaaggtgaacaacgtggtgtgggacctggaccggcccctggaggaggactgcaccctggagctgctgaagtttgaagatgaggaggcccaggccgtgtactggcacagcagcgcccacatcatgggagaggccatggagcgggtgtatggaggctgcctgtgctacggcccccccattgaaaatggcttctactatgacatgtacctggaggagggcggcgtgagcagcaatgacttcagcagcctggaggccctgtgcaagaagatcatcaaggagaagcaggcctttgagcggctggaggtgaagaaggagaccctgctggccatgttcaagtacaacaagttcaagtgccgcatcctgaatgagaaggtgaacacccccaccaccaccgtgtaccgctgtggccccctgattgacctgtgccggggcccccacgtgcgccacacaggcaagatcaaggccctgaagatccacaagaacagcagcacctactgggagggcaaggctgacatggagaccctgcagaggatctacggcatctccttcccagaccccaagatgctgaaggagtgggagaagttccaggaggaggccaagaacagagaccacaggaagattggccgggaccaggagctgtacttcttccacgagctgagccctggcagctgcttcttcctgcccaagggggcctacatctacaatgccctgattgagttcatccgctctgagtacaggaagaggggcttccaggaggtggtgacccccaacatcttcaacagccggctgtggatgaccagcggccactggcagcactacagcgagaacatgttctcctttgaggtggagaaggagctgtttgccctgaagcccatgaactgccccggccactgcctgatgtttgaccaccggcccaggtcctggagggagctgcccctgcggctggccgactttggagtgctgcacagaaatgagctgagcggggccctgaccggcctgaccagggtgcggcgcttccagcaggatgatgcccacatcttctgtgccatggagcagattgaagatgagatcaagggctgcctggacttcctgaggacagtgtacagcgtgtttggcttctccttcaagctgaacctgagcaccaggcctgagaagttcctgggggacatcgaggtgtgggaccaggccgagaagcagctggagaacagcctgaatgaatttggagagaagtgggagctgaacagcggagatggagccttctacggccccaagattgacatccagatcaaggatgccatcggccgctaccaccagtgtgccaccatccagctggacttccagctgcccatccgcttcaacctgacctacgtgtcccatgatggagatgacaagaagaggcctgtgattgtgcaccgggccatcctgggctctgtggagaggatgattgccatcctgacagagaactacggcggcaagtggcccttctggctgagcccccggcaggtgatggtggtgcctgtgggccccacctgtgatgaatatgcccagaaggtgcggcagcagttccatgatgccaagttcatggctgacatcgacctggaccccggctgcaccctgaacaagaagatcagaaatgcccagctggcccagtacaacttcatcctggtggtgggggagaaggagaagatctctggaacagtgaacatccgcacccgggacaacaaggtgcacggggagaggaccatcagcgagaccatcgagcggctgcagcagctgaaggagttccgcagcaagcaggccgaggaggagttctag

SEQ ID NO: 173191 - DNA, 1332 bp, Artificial Sequence
  Description of Artificial Sequence: Synthetic coding sequence
atggagcacaaccccctgcccaccagccctgctgaccagttcaacacaggccgctactgcagcggccccagcacagaatatggcttctaccatgacttcttcctgggcaaggagcgctgtggcaccctggtggacctgtgccagggcccccacctgcggcacacaggccagatcggcggcctgaagctgctgtctgcagaatatgcccaccggggcttcagcgaggtgaagacccccaccctcttcagcaccaagctgtgggagcagagcggccactgggagcactaccaggaggacatgtttgctgtgcagcccccaggcagtgacaggcctcccagcagccagagtgatgacagcaccaggcacatcacagacaccctggccctgaagcccatgaactgcccagcccactgcctgatgtttgcccaccggcccaggtcctggagggagctgcccctgcggctggccgactttggagccctgcacagagctgaggccagcggcggcctgggcggcctgacccggctgcgctgcttccagcaggatgatgcccacatcttctgcaccacagaccagctggaggccgagatccagagctgcctggacttcctgcggtctgtgtatgctgtgctgggcttctccttccggctggccctgagcacccggcccagcggcttcctgggggacccctgcctgtgggaccaggccgagcaggtgctgaagcaggccctgaaggagtttggagagccctgggacctgaacagcggagatggagccttctacggccccaagattgatgtgcacctgcatgatgccctgggccggccccaccagtgtggcaccatccagctggacttccagctgcccctgcgctttgacctgcagtacaagggccaggccggggccctggagaggcctgtgctgatccacagagctgtgctgggctctgtggagcggctgctgggcgtgctggccgagagctgtggcggcaagtggcccctgtggctgagccccttccaggtggtggtgattcctgtgggcagcgagcaggaggagtatgccaaggaggcccagcagagcctgcgggccgccggcctggtgtctgacctggatgctgacagcggcctgaccctgagccgccgcatcagaagagcccagctggcccactacaacttccagtttgtggtgggccagaaggagcagagcaagaggacagtgaacatccgcacccgggacaacagaaggctgggggagtgggacctgcctgaggccgtgcagaggctggtggagctgcagaacaccagggtgcccaatgctgaggagatcttctag

SEQ ID NO: 173192 - DNA, 1332 bp, Artificial Sequence
  Description of Artificial Sequence: Synthetic coding sequence
atggagcacaaccccctgcccaccagccctgctgaccagttcaacacaggccgctactgccggggccccagcacagaatatggcttctaccatgacttcttcctgggcaaggagcgctgtggcaccctggtggacctgtgccagggcccccacctgcggcacacaggccagatcggcggcctgaagctgctgtctgcagaatatgcccaccggggcttcagcgaggtgaagacccccaccctcttcagcaccaagctgtgggagcagagcggccactgggagcactaccaggaggacatgtttgctgtgcagcccccaggcagtgacaggcctcccagcagccagagtgatgacagcaccaggcacatcacagacaccctggccctgaagcccatgaactgcccagcccactgcctgatgtttgcccaccggcccaggtcctggagggagctgcccctgcggctggccgactttggagccctgcacagagctgaggccagcggcggcctgggcggcctgacccggctgcgctgcttccagcaggatgatgcccacatcttctgcaccacagaccagctggaggccgagatccagagctgcctggacttcctgcggtctgtgtatgctgtgctgggcttctccttccggctggccctgagcacccggcccagcggcttcctgggggacccctgcctgtgggaccaggccgagcaggtgctgaagcaggccctgaaggagtttggagagccctgggacctgaacagcggagatggagccttctacggccccaagattgatgtgcacctgcatgatgccctgggccggccccaccagtgtggcaccatccagctggacttccagctgcccctgcgctttgacctgcagtacaagggccaggccggggccctggagaggcctgtgctgatccacagagctgtgctgggctctgtggagcggctgctgggcgtgctggccgagagctgtggcggcaagtggcccctgtggctgagccccttccaggtggtggtgattcctgtgggcagcgagcaggaggagtatgccaaggaggcccagcagagcctgcgggccgccggcctggtgtctgacctggatgctgacagcggcctgaccctgagccgccgcatcagaagagcccagctggcccactacaacttccagtttgtggtgggccagaaggagcagagcaagaggacagtgaacatccgcacccgggacaacagaaggctgggggagtgggacctgcctgaggccgtgcagaggctggtggagctgcagaacaccagggtgcccaatgctgaggagatcttctag

SEQ ID NO: 173193 - DNA, 537 bp, Artificial Sequence
  Description of Artificial Sequence: Synthetic coding sequence
atggccctgtaccagcgctggcgctgcctgcggctgcagggcctgcaggcctgccgcctgcacacagctgtggtgtccaccccaccccgctggctggccgagcggctgggcctgtttgaggagctgtgggccgcccaggtgaagaggctggcctccatggcccagaaggagcccaggaccatcaagatcagcctgcccggcggccagaagattgatgctgtggcctggaacaccaccccctaccagctggcccggcagatcagcagcaccctggccgacacagctgtggccgcccaggtgaatggagagccctatgacctggagcggcccctggagacagacagcgacctgcgcttcctgacctttgacagccctgagggcaaggctgtgtccttcttcctgatccggaacacagtgaccaccaagccccgggacatcgaggccggcaacagcaacatcctcttcttctgccgctccttcagcatctgctcctgggagggggacctgccccagacagtgctgaccatctctggatag

SEQ ID NO: 173194 - DNA, 1767 bp, Artificial Sequence
  Description of Artificial Sequence: Synthetic coding sequence
atggccctgtaccagcgctggcgctgcctgcggctgcagggcctgcaggcctgccgcctgcacacagctgtggtgtccaccccaccccgctggctggccgagcggctgggcctgtttgaggagctgtgggccgcccaggtgaagaggctggcctccatggcccagaaggagcccaggaccatcaagatcagcctgcccggcggccagaagattgatgctgtggcctggaacaccaccccctaccagctggcccggcagatcagcagcaccctggccgacacagctgtggccgcccaggtgaatggagagccctatgacctggagcggcccctggagacagacagcgacctgcgcttcctgacctttgacagccctgagggcaaggctgtgttctggcacagcagcacccacgtgctgggcgctgctgctgagcagttcctgggcgctgtgctgtgccggggccccagcacagaatatggcttctaccatgacttcttcctgggcaaggagaggaccatccggggcagcgagctgcctgtgctggagcgcatctgccaggagctgacagctgctgcccggcccttccggcggctggaggccagccgggaccagctgcggcagctgttcaaggccgagtatgcccaccggggcttcagcgaggtgaagacccccaccctcttcagcaccaagctgtgggagcagagcggccactgggagcactaccaggaggacatgtttgctgtgcagcccccaggcagtgaccggccccccagcagccagagtgatgacagcaccaggcacatcacagacaccctggccctgaagcccatgaactgcccagcccactgcctgatgtttgcccaccggcccaggtcctggagggagctgcccctgcggctggccgactttggagccctgcacagagctgaggccagcggcggcctgggcggcctgacccggctgcgctgcttccagcaggatgatgcccacatcttctgcaccacagaccagctggaggccgagatccagagctgcctggacttcctgcggtctgtgtatgctgtgctgggcttctccttccggctggccctgagcacccggcccagcggcttcctgggggacccctgcctgtgggaccaggccgagcaggtgctgaagcaggccctgaaggagtttggagagccctgggacctgaacagcggagatggagccttctacggccccaagattgatgtgcacctgcatgatgccctgggccggccccaccagtgtggcaccatccagctggacttccagctgcccctgcgctttgacctgcagtacaagggccaggccggggccctggagaggcctgtgctgatccacagagctgtgctgggctctgtggagcggctgctgggcgtgctggccgagagctgtggcggcaagtggcccctgtggctgagccccttccaggtggtggtgattcctgtgggcagcgagcaggaggagtatgccaaggaggcccagcagagcctgcgggctgctggcctggtgtctgacctggatgctgacagcggcctgaccctgagccgccgcatccggcgggcccagctggcccactacaacttccagtttgtggtgggccagaaggagcagagcaagaggacagtgaacatccgcacccgggacaacagaaggctgggggagtgggacctgcctgaggccgtgcagaggctggtggagctgcagaacaccagggtgcccaatgctgaggagatcttctag

SEQ ID NO: 173195 - DNA, 2157 bp, Artificial Sequence
  Description of Artificial Sequence: Synthetic coding sequence
atggccctgtaccagcgctggcgctgcctgcggctgcagggcctgcaggcctgccgcctgcacacagctgtggtgtccaccccaccccgctggctggccgagcggctgggcctgtttgaggagctgtgggccgcccaggtgaagaggctggcctccatggcccagaaggagcccaggaccatcaagatcagcctgcccggcggccagaagattgatgctgtggcctggaacaccaccccctaccagctggcccggcagatcagcagcaccctggccgacacagctgtggccgcccaggtgaatggagagccctatgacctggagcggcccctggagacagacagcgacctgcgcttcctgacctttgacagccctgagggcaaggctgtgttctggcacagcagcacccacgtgctgggcgctgctgctgagcagttcctgggcgctgtgctgtgccggggccccagcacagaatatggcttctaccatgacttcttcctgggcaaggagaggaccatccggggcagcgagctgcctgtgctggagcgcatctgccaggagctgacagctgctgcccggcccttccggcggctggaggccagccgggaccagctgcggcagctgttcaaggacaaccccttcaagctgcacctgattgaggagaaggtgacaggccccacagccaccgtgtatggctgcggcaccctggtggacctgtgccagggcccccacctgcggcacacaggccagattggaggcctgaagctgctgagcaacagcagcagcctgtggaggagcagcggggcccctgagaccctgcagagggtgtctggcatctccttccccaccacagagctgctgcgggtgtgggaggcctggagggaggaggccgagctgcgggaccacagaagaattggcaaggagcaggagctgttcttcttccacgagctgagccctggcagctgcttcttcctgccccggggcaccagggtgtacaatgccctggtggccttcatccgggcagaatatgcccaccggggcttcagcgaggtgaagacccccaccctcttcagcaccaagctgtgggagcagagcggccactgggagcactaccaggaggacatgtttgctgtgcagcccccaggcagtgaccggccccccagcagccagagtgatgacagcaccaggcacatcacagacaccctggccctgaagcccatgaactgcccagcccactgcctgatgtttgcccaccggcccaggtcctggagggagctgcccctgcggctggccgactttggagccctgcacagagctgaggccagcggcggcctgggcggcctgacccggctgcgctgcttccagcaggatgatgcccacatcttctgcaccacagaccagctggaggccgagatccagagctgcctggacttcctgcggtctgtgtatgctgtgctgggcttctccttccggctggccctgagcacccggcccagcggcttcctgggggacccctgcctgtgggaccaggccgagcaggtgctgaagcaggccctgaaggagtttggagagccctgggacctgaacagcggagatggagccttctacggccccaagattgatgtgcacctgcatgatgccctgggccggccccaccagtgtggcaccatccagctggacttccagctgcccctgcgctttgacctgcagtacaagggccaggccggggccctggagaggcctgtgctgatccacagagctgtgctgggctctgtggagcggctgctgggcgtgctggccgagagctgtggcggcaagtggcccctgtggctgagccccttccaggtggtggtgattcctgtgggcagcgagcaggaggagtatgccaaggaggcccagcagagcctgcgggctgctggcctggtgtctgacctggatgctgacagcggcctgaccctgagccgccgcatccggcgggcccagctggcccactacaacttccagtttgtggtgggccagaaggagcagagcaagaggacagtgaacatccgcacccgggacaacagaaggctgggggagtgggacctgcctgaggccgtgcagaggctggtggagctgcagaacaccagggtgcccaatgctgaggagatcttctag

SEQ ID NO: 173196 - DNA, 510 bp, Artificial Sequence
  Description of Artificial Sequence: Synthetic coding sequence
atggccctgtaccagcgctggcgctgcctgcggctgcagggcctgcaggcctgccgcctgcacacagctgtggtgtccaccccaccccgctggctggccgagcggctgggcctgtttgaggagctgtgggccgcccaggtgaagaggctggcctccatggcccagaaggagcccaggaccatcaagatcagcctgcccggcggccagaagattgatgctgtggcctggaacaccaccccctaccagctggcccggcagatcagcagcaccctggccgacacagctgtggccgcccaggtgaatggagagccctatgacctggagcggcccctggagacagacagcgacctgcgcttcctgacctttgacagccctgagggcaaggctgacaaccctggcctgcgggccgcctgctttggagctgacctgcccggcacctacagctgctgcagcaccctgcctgaggcccggggcttcaccggcagcgccagccctgtggtgcagggctag

SEQ ID NO: 173197 - DNA, 4974 bp, Artificial Sequence
  Description of Artificial Sequence: Synthetic coding sequence
atgggcctgcaggcccggcgctgggccagcggcagcagaggagctgctggccccaggagaggagtgctgcagctgctgcccctgcccctgcccctgcccctgctgctgctgctgctgctgcggcctggggccggccgggccgccgcccagggcgaggccgaggcccccaccctgtacctgtggaagacaggcccctggggccgctgcatgggagatgaatgtggccctgggggcatccagaccagggctgtgtggtgtgcccacgtggagggctggaccaccctgcacaccaactgcaagcaggccgagcggcccaacaaccagcagaactgcttcaaggtgtgtgactggcacaaggagctgtatgactggaggctgggcccctggaaccagtgccagcccgtcatcagcaagagcctggagaagcccctggagtgcatcaagggggaggagggcatccaggtgcgggagatcgcctgcatccagaaggacaaggacatcccagctgaggacatcatctgtgagtactttgagcccaagcccctgctggagcaggcctgcctgatcccctgccagcaggactgcatcgtgtctgagttcagcgcctggagcgaatgttccaagacctgtggcagcggcctgcagcacaggaccaggcatgtggtggccccaccccagtttggaggcagcggctgccccaacctgacagagttccaggtgtgccagagcagcccctgtgaggccgaggagctgcgctacagcctgcacgtgggcccctggagcacctgcagcatgccccacagccggcaggtgcggcaggcccggcggcggggcaagaacaaggagcgggagaaggacaggagcaaaggagtgaaggaccctgaggcccgggagctgatcaagaagaagaggaacagaaaccggcagaaccggcaggagaacaagtactgggacatccagatcggctaccagacccgggaggtgatgtgcatcaacaagacaggcaaggctgctgacctgtccttctgccagcaggagaagctgcccatgaccttccagagctgtgtgatcaccaaggagtgccaggtgtctgagtggagcgagtggagcccctgcagcaagacctgccacgacatggtgtccccagctggcaccagggtgaggaccaggaccatccggcagttccccatcggcagcgagaaggagtgcccagagtttgaggagaaggagccctgcctgagccagggagatggagtggtgccctgtgccacctacggctggaggaccacagagtggacagagtgccgggtggaccccctgctgagccagcaggacaagagaagaggcaaccagacagccctgtgtggcggcggcatccagacccgggaggtgtactgtgtgcaggccaatgaaaacctgctgagccagctgagcacccacaagaacaaggaggccagcaagcccatggacctgaagctgtgcaccggccccatccccaacaccacccagctgtgccacatcccctgccccacagaatgtgaggtgagcccctggagcgcctggggcccctgcacctatgagaactgcaatgaccagcagggcaagaagggcttcaagctgaggaagaggcgcatcaccaatgagcccaccggcggcagcggcgtgacaggcaactgcccccacctgctggaggccatcccctgtgaggagcccgcctgctatgactggaaggctgtgcggctgggcaactgtgagccagacaacgggaaggaatgtggccctggcacccaggtgcaggaggtggtgtgcatcaacagtgatggagaggaggtggaccggcagctgtgcagagatgccatcttccccatccctgtggcctgtgatgccccctgccccaaggactgtgtgctgagcacctggagcacctggagcagctgcagccacacctgcagcggcaagaccacagagggcaagcagatccgggcccggagcatcctggcctatgctggggaggagggcggcatccgctgccccaacagcagcgccctgcaggaggtgcgcagctgcaatgagcacccctgcaccgtgtaccactggcagacaggcccctggggccagtgcatcgaggacacctctgtgtcctccttcaacaccaccaccacctggaatggagaggccagctgcagcgtgggcatgcagaccaggaaggtgatctgtgtgcgggtgaatgtgggccaggtgggccccaagaagtgcccagagagcctgcggcctgagaccgtgcggccctgcctgctgccctgcaagaaggactgcatcgtgaccccctacagcgactggaccagctgccccagcagctgcaaggagggggacagcagcatcaggaagcagagccgccacagggtcatcatccagctgcctgccaatggaggccgggactgcacagaccccctgtatgaggagaaggcctgtgaggccccccaggcctgccagagctaccgctggaagacccacaagtggaggcgctgccagctggtgccctggagcgtgcagcaggacagccctggggcccaggagggctgcggccctggccggcaggcccgggccatcacctgcaggaagcaggacggcggccaggccggcatccacgagtgcctgcagtatgccggccctgtgcctgccctgacccaggcctgccagatcccctgccaggatgactgccagctgacctcctggagcaagttcagcagctgcaatggagactgtggggctgtgaggaccaggaagaggaccctggtgggcaagagcaagaagaaggagaagtgcaagaacagccacctgtaccccctgattgagacccagtactgcccctgtgacaagtacaatgcccagcctgtgggcaactggagcgactgcatcctgcctgagggcaaggtggaggtgctgctgggcatgaaggtgcagggcgacatcaaggaatgtggccagggctaccgctaccaggccatggcctgctatgaccagaatggccgcctggtggagaccagccgctgcaacagccacggctacatcgaggaggcctgcatcatcccctgccccagcgactgcaagctgtctgagtggagcaactggagccgctgcagcaagagctgtggcagcggcgtgaaggtgcgcagcaagtggctgcgggagaagccctacaacggcggccggccctgccccaagctggaccacgtgaaccagttccaggtgtatgaggtggtgccctgccacagcgactgcaaccagtacctgtgggtgacagagccctggagcatctgcaaggtgacctttgtgaacatgagggagaactgtggggagggcgtgcagaccaggaaggtgcgctgcatgcagaacacagcagatggccccagcgagcacgtggaggactacctgtgtgaccctgaggagatgcccctgggcagccgggtgtgcaagctgccctgcccagaggactgtgtgatcagcgagtggggcccctggacccagtgtgtgctgccctgcaaccagagcagcttccggcagaggtctgctgaccccatccggcagcctgcagatgagggccgcagctgccccaatgctgtggagaaggagccctgcaacctgaacaagaactgctaccactatgactacaacgtgacagactggagcacctgccagctgtctgagaaggctgtgtgtggaaatggcatcaagaccaggatgctggactgtgtgcggagtgatggcaagtctgtggacctgaagtactgtgaggccctgggcctggagaagaactggcagatgaacaccagctgcatggtggagtgccctgtgaactgccagctgagtgactggagcccctggagcgaatgttcccagacctgtggcctgaccgggaagatgatcagaagaagaacagtgacccagcccttccagggagatggccggccctgccccagcctgatggaccagagcaagccctgccctgtgaagccctgctaccgctggcagtatggccagtggagcccctgccaggtgcaggaggcccagtgtggggagggcaccaggaccaggaacatcagctgtgtggtgtctgatggcagcgcagatgacttcagcaaggtggtggatgaggagttctgtgccgacatcgagctgatcattgatggcaacaagaacatggtgctggaggagagctgcagccagccctgccctggggactgctacctgaaggactggagctcctggagcctgtgccagctgacctgtgtgaatggagaggacctgggctttggaggcatccaggtgcgcagcaggcctgtgatcatccaggagctggagaaccagcacctgtgcccagagcagatgctggagaccaagagctgctatgatggccagtgctatgagtacaagtggatggccagcgcctggaagggcagcagcaggacagtgtggtgccagaggagtgatggcatcaacgtgactggaggctgcctggtgatgagccagccagatgctgacaggagctgcaaccccccctgcagccagccccacagctactgcagcgagaccaagacctgccactgtgaggagggctacacagaggtgatgagcagcaacagcaccctggagcagtgcaccctcatccctgtggtggtgctgcccaccatggaggacaagagaggagatgtgaagaccagcagagctgtgcaccccacccagcccagcagcaacccagctggccggggccgcacctggttcctgcagcccttcggcccagatggccgcctgaagacctgggtgtatggagtggccgccggggcctttgtgctgctgatcttcatcgtgtccatgatctacctggcctgcaagaagcccaagaagccccagaggcggcagaacaaccggctgaagcccctgaccctggcctatgatggagatgctgacatgtag

SEQ ID NO: 173198 - DNA, 4974 bp, Artificial Sequence
  Description of Artificial Sequence: Synthetic coding sequence
atgggcctgcaggcccggcgctgggccagcggcagcagaggagctgctggccccaggagaggagtgctgcagctgctgcccctgcccctgcccctgcccctgctgctgctgctgctgctgcggcctggggccggccgggccgccgcccagggcgaggccgaggcccccaccctgtacctgtggaagacaggcccctggggccgctgcatgggagatgaatgtggccctgggggcatccagaccagggctgtgtggtgtgcccacgtggagggctggaccaccctgcacaccaactgcaagcaggccgagcggcccaacaaccagcagaactgcttcaaggtgtgtgactggcacaaggagctgtatgactggaggctgggcccctggaaccagtgccagcccgtcatcagcaagagcctggagaagcccctggagtgcatcaagggggaggagggcatccaggtgcgggagatcgcctgcatccagaaggacaaggacatcccagctgaggacatcatctgtgagtactttgagcccaagcccctgctggagcaggcctgcctgatcccctgccagcaggactgcatcgtgtctgagttcagcgcctggagcgaatgttccaagacctgtggcagcggcctgcagcacaggaccaggcatgtggtggccccaccccagtttggaggcagcggctgccccaacctgacagagttccaggtgtgccagagcagcccctgtgaggccgaggagctgcgctacagcctgcacgtgggcccctggagcacctgcagcatgccccacagccggcaggtgcggcaggcccggcggcggggcaagaacaaggagcgggagaaggacaggagcaaaggagtgaaggaccctgaggcccgggagctgatcaagaagaagaggaacagaaaccggcagaaccggcaggagaacaagtactgggacatccagatcggctaccagacccgggaggtgatgtgcatcaacaagacaggcaaggctgctgacctgtccttctgccagcaggagaagctgcccatgaccttccagagctgtgtgatcaccaaggagtgccaggtgtctgagtggagcgagtggagcccctgcagcaagacctgccacgacatggtgtccccagctggcaccagggtgaggaccaggaccatccggcagttccccatcggcagcgagaaggagtgcccagagtttgaggagaaggagccctgcctgagccagggagatggagtggtgccctgtgccacctacggctggaggaccacagagtggacagagtgccgggtggaccccctgctgagccagcaggacaagagaagaggcaaccagacagccctgtgtggcggcggcatccagacccgggaggtgtactgtgtgcaggccaatgaaaacctgctgagccagctgagcacccacaagaacaaggaggccagcaagcccatggacctgaagctgtgcaccggccccatccccaacaccacccagctgtgccacatcccctgccccacagaatgtgaggtgagcccctggagcgcctggggcccctgcacctatgagaactgcaatgaccagcagggcaagaagggcttcaagctgaggaagaggcgcatcaccaatgagcccaccggcggcagcggcgtgacaggcaactgcccccacctgctggaggccatcccctgtgaggagcccgcctgctatgactggaaggctgtgcggctgggcaactgtgagccagacaacgggaaggaatgtggccctggcacccaggtgcaggaggtggtgtgcatcaacagtgatggagaggaggtggaccggcagctgtgcagagatgccatcttccccatccctgtggcctgtgatgccccctgccccaaggactgtgtgctgagcacctggagcacctggagcagctgcagccacacctgcagcggcaagaccacagagggcaagcagatccgggcccggagcatcctggcctatgctggggaggagggcggcatccgctgccccaacagcagcgccctgcaggaggtgcgcagctgcaatgagcacccctgcaccgtgtaccactggcagacaggcccctggggccagtgcatcgaggacacctctgtgtcctccttcaacaccaccaccacctggaatggagaggccagctgcagcgtgggcatgcagaccaggaaggtgatctgtgtgcgggtgaatgtgggccaggtgggccccaagaagtgcccagagagcctgcggcctgagaccgtgcggccctgcctgctgccctgcaagaaggactgcatcgtgaccccctacagcgactggaccagctgccccagcagctgcaaggagggggacagcagcatcaggaagcagagccgccacagggtcatcatccagctgcctgccaatggaggccgggactgcacagaccccctgtatgaggagaaggcctgtgaggccccccaggcctgccagagctaccgctggaagacccacaagtggaggcgctgccagctggtgccctggagcgtgcagcaggacagccctggggcccaggagggctgcggccctggccggcaggcccgggccatcacctgcaggaagcaggacggcggccaggccggcatccacgagtgcctgcagtatgccggccctgtgcctgccctgacccaggcctgccagatcccctgccaggatgactgccagctgacctcctggagcaagttcagcagctgcaatggagactgtggggctgtgaggaccaggaagaggaccctggtgggcaagagcaagaagaaggagaagtgcaagaacagccacctgtaccccctgattgagacccagtactgcccctgtgacaagtacaatgcccagcctgtgggcaactggagcgactgcatcctgcctgagggcaaggtggaggtgctgctgggcatgaaggtgcagggcgacatcaaggaatgtggccagggctaccgctaccaggccatggcctgctatgaccagaatggccgcctggtggagaccagccgctgcaacagccacggctacatcgaggaggcctgcatcatcccctgccccagcgactgcaagctgtctgagtggagcaactggagccgctgcagcaagagctgtggcagcggcgtgaaggtgcgcagcaagtggctgcgggagaagccctacaacggcggccggccctgccccaagctggaccacgtgaaccaggcccaggtgtatgaggtggtgccctgccacagcgactgcaaccagtacctgtgggtgacagagccctggagcatctgcaaggtgacctttgtgaacatgagggagaactgtggggagggcgtgcagaccaggaaggtgcgctgcatgcagaacacagcagatggccccagcgagcacgtggaggactacctgtgtgaccctgaggagatgcccctgggcagccgggtgtgcaagctgccctgcccagaggactgtgtgatcagcgagtggggcccctggacccagtgtgtgctgccctgcaaccagagcagcttccggcagaggtctgctgaccccatccggcagcctgcagatgagggccgcagctgccccaatgctgtggagaaggagccctgcaacctgaacaagaactgctaccactatgactacaacgtgacagactggagcacctgccagctgtctgagaaggctgtgtgtggaaatggcatcaagaccaggatgctggactgtgtgcggagtgatggcaagtctgtggacctgaagtactgtgaggccctgggcctggagaagaactggcagatgaacaccagctgcatggtggagtgccctgtgaactgccagctgagtgactggagcccctggagcgaatgttcccagacctgtggcctgaccgggaagatgatcagaagaagaacagtgacccagcccttccagggagatggccggccctgccccagcctgatggaccagagcaagccctgccctgtgaagccctgctaccgctggcagtatggccagtggagcccctgccaggtgcaggaggcccagtgtggggagggcaccaggaccaggaacatcagctgtgtggtgtctgatggcagcgcagatgacttcagcaaggtggtggatgaggagttctgtgccgacatcgagctgatcattgatggcaacaagaacatggtgctggaggagagctgcagccagccctgccctggggactgctacctgaaggactggagctcctggagcctgtgccagctgacctgtgtgaatggagaggacctgggctttggaggcatccaggtgcgcagcaggcctgtgatcatccaggagctggagaaccagcacctgtgcccagagcagatgctggagaccaagagctgctatgatggccagtgctatgagtacaagtggatggccagcgcctggaagggcagcagcaggacagtgtggtgccagaggagtgatggcatcaacgtgactggaggctgcctggtgatgagccagccagatgctgacaggagctgcaaccccccctgcagccagccccacagctactgcagcgagaccaagacctgccactgtgaggagggctacacagaggtgatgagcagcaacagcaccctggagcagtgcaccctcatccctgtggtggtgctgcccaccatggaggacaagagaggagatgtgaagaccagcagagctgtgcaccccacccagcccagcagcaacccagctggccggggccgcacctggttcctgcagcccttcggcccagatggccgcctgaagacctgggtgtatggagtggccgccggggcctttgtgctgctgatcttcatcgtgtccatgatctacctggcctgcaagaagcccaagaagccccagaggcggcagaacaaccggctgaagcccctgaccctggcctatgatggagatgctgacatgtag

SEQ ID NO: 173199 - DNA, 2010 bp, Artificial Sequence
  Description of Artificial Sequence: Synthetic coding sequence
atgtctgccctgctgagcctgtgctttgtgctgcccctggccgcccctggccacggcacccagggctgggagccctgcacagacctgcggcccctggacatcctggccgaggtggtgcccagtgatggagccaccagcggcatccgcatcgtgcaggtgcacggggcccggggcctgcagctgtctgtggccgcccccaggaccatgtccttccctgccagccgcatcttcagccagtgtgacctcttccctgaggagttcagcatcgtggtgaccctgcgggtgcccaacctgccccccaagagaaatgagtacctgctgactgtggtggccgaggagagtgacctgctgctgctgggcctgcggctgagccctgcccagctgcacttcctgttcctgcgggaggacacagctggggcctggcagaccagggtgtccttccgcagccctgccctggtggatggccgctggcacaccctggtgctggccgtgtctgctggggtcttcagcctgaccacagactgtggcctgcctgtggacatcatggctgatgtgcccttccctgccaccctgtctgtgaagggggcccgcttctttgtgggcagcagaagaagagccaagggcctcttcatgggcctggtgcggcagctggtgctgctgcccggcagtgatgccaccccccggctgtgccccagcagaaatgcccccctggccgtgctgagcatcccccgggtgctgcaggccctgaccgggaagccagaggacaatgaggtgctgaagtacccctatgagaccaacatccgggtgaccctgggcccccagcccccctgcacagaggtggaggatgcccagttctggtttgatgccagcaggaagggcctgtacctgtgtgtgggcaatgagtgggtgtctgtgctggccgccaaggagcggctggactatgtggaggagcaccagaacctgagcaccaacagcgagaccctgggcatcgaggtgttccgcatcccccaggtgggcctgtttgtggccacagccaacaggaaggccaccagcgctgtgtacaagtggacagaggagaagtttgtgtcctaccagaacatccccacccaccaggcccaggcctggaggcacttcaccatcggcaagaagatcttcctggccgtggccaactttgagccagatgagaagggccaggagttcagcgtcatctacaagtggagccacaggaagctgaagttcaccccctaccagagcatcgccacccacagcgcccgggactgggaggcctttgaggtggatggagagcacttcctggccgtggccaaccaccgggagggggacaaccacaacattgattctgtcatctacaagtggaacccagccacccggctgtttgaggccaaccagaccatcgccaccagcggggcctatgactgggagttcttctctgtgggcccctacagcttcctggtggtggccaacaccttcaacggcaccagcaccaaggtgcacagccacctgtacatccggctgctgggcagcttccagctgttccagagcttccccaccttcggggctgctgactgggaggtgttccagatcggggagcgcatcttcctggccgtggccaacagccacagctatgatgtggagatgcaggtgcagaatgacagctatgtgatcaacagcgtcatctatgagctgaatgtgacagcccaggcctttgtgaagttccaggacatcctgacctgcagcgccctggactgggagttcttctctgtgggggaggactacttcctggtggtggccaacagctttgatggccgcaccttctctgtgaacagcatcatctaccgctggcagggctatgagggctttgtggccgtgcacagcctgcccaccgtgggctgccgggactgggaggccttcagcaccacagctggggcctacctgatctacagcagcgccaaggagcccctgagccgggtgctgcggctgcggaccaggtag

SEQ ID NO: 173200 - DNA, 1800 bp, Artificial Sequence
  Description of Artificial Sequence: Synthetic coding sequence
atgtctgccctgctgagcctgtgctttgtgctgcccctggccgcccctggccacggcacccagggctgggagccctgcacagacctgcggcccctggacatcctggccgaggtggtgcccagtgatggagccaccagcggcatccgcatcgtgcaggtgcacggggcccggggcctgcagctgtctgtggccgcccccaggaccatgtccttccctgccagccgcatcttcagccagtgtgacctcttccctgaggagttcagcatcgtggtgaccctgcgggtgcccaacctgccccccaagagaaatgagtacctgctgactgtggtggccgaggagagtgacctgctgctgctgggcctgcggctgagccctgcccagctgcacttcctgttcctgcgggaggacacagctggggcctggcagaccagggtgtccttccgcagccctgccctggtggatggccgctggcacaccctggtgctggccgtgtctgctggggtcttcagcctgaccacagactgtggcctgcctgtggacatcatggctgatgtgcccttccctgccaccctgtctgtgaagggggcccgcttctttgtgggcagcagaagaagagccaagggcctcttcatgggcctggtgcggcagctggtgctgctgcccggcagtgatgccaccccccggctgtgccccagcagaaatgcccccctggccgtgctgagcatcccccgggtgctgcaggccctgaccgggaagccagaggacaatgaggtgctgaagtacccctatgagaccaacatccgggtgaccctgggcccccagcccccctgcacagaggtggaggatgcccagttctggtttgatgccagcaggaagggcctgtacctgtgtgtgggcaatgagtgggtgtctgtgctggccgaggccaaggagcggctggactatgtggaggagcaccagaacctgagcaccaacagcgagaccctgggcatcgaggtgttccgcatcccccaggtgggcctgtttgtggccacagccaacaggaaggccaccagcgctgtgtacaagtggacagaggagaagtttgtgtcctaccagaacatccccacccaccaggcccaggcctggaggcacttcaccatcggcaagaagatcttcctggccgtggccaactttgagccagatgagaagggccaggagttcagcgtcatctacaagtggagccacaggaagctgaagttcaccccctaccagagcatcgccacccacagcgcccgggactgggaggcctttgaggtggatggagagcacttcctggccgtggccaaccaccgggagggggacaaccacaacatcgacagcgtcatctacaagtggaacccagccacccggctgtttgaggccaaccagaccatcgccaccagcggggcctatgactgggagttcttctctgtgggcccctacagcttcctggtggtggccaacaccttcaacggcaccagcaccaaggtgcacagccacctgtacatccggctgctgggcagcttccagctgttccagagcttccccacctttggagctgctgactgggaggtgttccagattggagagcgcatcttcctggccgtggccaacagccacagctatgatgtggagatgcaggtgcagaatgacagctatgtgatcaacagcgtcatctatgagctgaatgtgacagcccaggcctttgtgaagttccaggacatcctgacctgcagcggcggcagaagaggcctgcacgccaggagagctgagggctag

SEQ ID NO: 173201 - DNA, 1569 bp, Artificial Sequence
  Description of Artificial Sequence: Synthetic coding sequence
atgtctgccctgctgagcctgtgctttgtgctgcccctggccgcccctggccacggcacccagggctgggagccctgcacagacctgcggcccctggacatcctggccgaggtggtgcccagtgatggagccaccagcggcatccgcatcgtgcaggtgcacggggcccggggcctgcagctgtctgtggccgcccccaggaccatgtccttccctgccagccgcatcttcagccagtgtgacctcttccctgaggagttcagcatcgtggtgaccctgcgggtgcccaacctgccccccaagagaaatgagtacctgctgactgtggtggccgaggagagtgacctgctgctgctgggcctgcggctgagccctgcccagcccccctgcacagaggtggaggatgcccagttctggtttgatgccagcaggaagggcctgtacctgtgtgtgggcaatgagtgggtgtctgtgctggccgccaaggagcggctggactatgtggaggagcaccagaacctgagcaccaacagcgagaccctgggcatcgaggtgttccgcatcccccaggtgggcctgtttgtggccacagccaacaggaaggccaccagcgctgtgtacaagtggacagaggagaagtttgtgtcctaccagaacatccccacccaccaggcccaggcctggaggcacttcaccatcggcaagaagatcttcctggccgtggccaactttgagccagatgagaagggccaggagttcagcgtcatctacaagtggagccacaggaagctgaagttcaccccctaccagagcatcgccacccacagcgcccgggactgggaggcctttgaggtggatggagagcacttcctggccgtggccaaccaccgggagggggacaaccacaacatcgacagcgtcatctacaagtggaacccagccacccggctgtttgaggccaaccagaccatcgccaccagcggggcctatgactgggagttcttctctgtgggcccctacagcttcctggtggtggccaacaccttcaacggcaccagcaccaaggtgcacagccacctgtacatccggctgctgggcagcttccagctgttccagagcttccccacctttggagctgctgactgggaggtgttccagattggagagcgcatcttcctggccgtggccaacagccacagctatgatgtggagatgcaggtgcagaatgacagctatgtgatcaacagcgtcatctatgagctgaatgtgacagcccaggcctttgtgaagttccaggacatcctgacctgcagcgccctggactgggagttcttctctgtgggggaggactacttcctggtggtggccaacagctttgatggccgcaccttctctgtgaacagcatcatctaccgctggcagggctatgagggctttgtggccgtgcacagcctgcccaccgtgggctgccgggactgggaggccttcagcaccacagctggggcctacctgatctacagcagcgccaaggagcccctgagccgggtgctgcggctgcggaccaggtag

SEQ ID NO: 173202 - DNA, 1605 bp, Artificial Sequence
  Description of Artificial Sequence: Synthetic coding sequence
atgatggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgtttattgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtcatcgccctgcgggaccagcaggccgctgaggagcggcggcgggacttcctgcagatggtgctggatgcccggcacagcgccagccccatgggcgtgcaggactttgacatcgtgagagatgtgttcagcagcacaggctgcaagcccaaccccagccggcagcaccagcccagccccatggcccggcccctgactgtggatgagatcgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgcttcaccgctgaggcccggcagcagcaccggcccttcacctacctgccctttggagctggccccaggagctgcctgggcgtgcggctgggcctgctggaggtgaagctgaccctgctgcacgtgctgcacaagttccgcttccaggcctgcccagagacccaggtgcccctgcagctggagagcaagagcgccctgggccccaagaatggagtgtacatcaagatcgtgtccaggtag

SEQ ID NO: 173203 - DNA, 1602 bp, Artificial Sequence
  Description of Artificial Sequence: Synthetic coding sequence
atggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgttcatcgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtgattgccctgcgggaccagcaggccgctgaggagaggagaagagacttcctgcagatggtgctggatgcccggcacagcgccagccccatgggcgtgcaggactttgatattgtgagagatgtgttcagcagcacaggctgcaagcccaaccccagccggcagcaccagcccagccccatggcccggcccctgactgtggatgaaattgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgcttcaccgctgaggcccggcagcagcaccggcccttcacctacctgccctttggagctggccccaggagctgcctgggcgtgcggctgggcctgctggaggtgaagctgaccctgctgcacgtgctgcacaagttccgcttccaggcctgcccagagacccaggtgcccctgcagctggagagcaagagcgccctgggccccaagaatggagtgtacatcaagatcgtgtccaggtag

SEQ ID NO: 173204 - DNA, 1380 bp, Artificial Sequence
  Description of Artificial Sequence: Synthetic coding sequence
atggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgttcatcgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtgattgccctgcgggaccagcaggccgctgaggagaggagaagagacttcctgcagatggtgctggatgcccggcacagcgccagccccatgggcgtgcaggactttgatattgtgagagatgtgttcagcagcacaggctgcaagcccaaccccagccggcagcaccagcccagccccatggcccggcccctgactgtggatgaaattgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgctaccgctgcagctag

SEQ ID NO: 173205 - DNA, 1383 bp, Artificial Sequence
  Description of Artificial Sequence: Synthetic coding sequence
atgatggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgtttattgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtcatcgccctgcgggaccagcaggccgctgaggagcggcggcgggacttcctgcagatggtgctggatgcccggcacagcgccagccccatgggcgtgcaggactttgacatcgtgagagatgtgttcagcagcacaggctgcaagcccaaccccagccggcagcaccagcccagccccatggcccggcccctgactgtggatgagatcgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgctaccgctgcagctag

SEQ ID NO: 173206 - DNA, 1743 bp, Artificial Sequence
  Description of Artificial Sequence: Synthetic coding sequence
atgatggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgtttattgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagctgggcctgctgatcatgcaggagcgcatcaagggccacatgggcggccagcaggccccccagagaattcctcccacccggctgagcaagcccagcggcatctacgtgaacctgcactacgccaccctgcccttctgcatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtcatcgccctgcgggaccagcaggccgctgaggagcggcggcgggacttcctgcagatggtgctggatgcccggcacagcgccagccccatgggcgtgcaggactttgacatcgtgagagatgtgttcagcagcacaggctgcaagcccaaccccagccggcagcaccagcccagccccatggcccggcccctgactgtggatgagatcgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgcttcaccgctgaggcccggcagcagcaccggcccttcacctacctgccctttggagctggccccaggagctgcctgggcgtgcggctgggcctgctggaggtgaagctgaccctgctgcacgtgctgcacaagttccgcttccaggcctgcccagagacccaggtgcccctgcagctggagagcaagagcgccctgggccccaagaatggagtgtacatcaagatcgtgtccaggtag

SEQ ID NO: 173207 - DNA, 1605 bp, Artificial Sequence; identical to SEQ ID NO: 173202
  Description of Artificial Sequence: Synthetic coding sequence

SEQ ID NO: 173208 - DNA, 453 bp, Artificial Sequence
  Description of Artificial Sequence: Synthetic coding sequence
atggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgttcatcgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgaatag

SEQ ID NO: 173209 - DNA, 1602 bp, Artificial Sequence; identical to SEQ ID NO: 173203
  Description of Artificial Sequence: Synthetic coding sequence

SEQ ID NO: 173210 - DNA, 459 bp, Artificial Sequence
  Description of Artificial Sequence: Synthetic coding sequence
atgatggaggccctgggcttcctgaagctggaggtgaatggccccatggtgacagtggccctgtctgtggccctgctggccctgctgaagtggtacagcaccagcgccttcagccggctggagaagctgggcctgcggcaccccaagcccagccccttcatcggcaacctgaccttcttccggcagggcttctgggagagccagatggagctgaggaagctgtatggccccctgtgtggctactacctgggccgcaggatgtttattgtcatcagcgagccagacatgatcaagcaggtgctggtggagaacttcagcaacttcaccaacaggatgccccagagcatcatgcccaacagccgccaccacgtggccagccggggcatgtggccaggcggccggcggctggcctgctacctgcaccccttcaggatggccgagggcattgctgaggtgtag

SEQ ID NO: 173211 - DNA, 1401 bp, Artificial Sequence
  Description of Artificial Sequence: Synthetic coding sequence
atggagctgaggaagctgtatggccccctgtgtggctactacctgggccgcaggatgtttattgtcatcagcgagccagacatgatcaagcaggtgctggtggagaacttcagcaacttcaccaacaggatggccagcggcctggagttcaagtctgtggccgacagcgtgctcttcctgcgggacaagcgctgggaggaggtgcggggggccctgatgtctgccttcagccctgagaagctgaatgagatggtgcccctcatcagccaggcctgtgagctgctgctggcccacctgaagagatatgcagagagcggagatgcctttgacatccagcgctgctactgcaactacaccacagatgtggtggcctctgtggccttcggcacccctgtggacagctggcaggcccctgaggacccctttgtgaagcactgcaagcgcttctttgagttctgcatcccccggcccatcctggtgctgctgctgtccttccccagcatcatggtgcccctggcccgcatcctgcccaacaagaacagagatgagctgaatggcttcttcaacaagctgatcagaaatgtcatcgccctgcgggaccagcaggccgctgaggagcggcggcgggacttcctgcagatggtgctggatgcccggcacagcgccagccccatgggcgtgcaggactttgacatcgtgagagatgtgttcagcagcacaggctgcaagcccaaccccagccggcagcaccagcccagccccatggcccggcccctgactgtggatgagatcgtgggccaggccttcatcttcctgattgctggctatgagatcatcaccaacaccctgagctttgccacctacctgctggccaccaacccagactgccaggagaagctgctgcgggaggtggatgtgttcaaggagaagcacatggcccctgagttctgcagcctggaggagggcctgccctacctggacatggtgattgctgagaccctgaggatgtaccccccagccttccgcttcacccgggaggccgcccaggactgtgaggtgctgggccagaggatcccagctggagctgtgctggagatggctgtgggcgccctgcaccacgaccctgagcactggcccagccctgagaccttcaaccctgagcgcttcaccgctgaggcccggcagcagcaccggcccttcacctacctgccctttggagctggccccaggagctgcctgggcgtgcggctgggcctgctggaggtgaagctgaccctgctgcacgtgctgcacaagttccgcttccaggcctgcccagagacccaggtgcccctgcagctggagagcaagagcgccctgggccccaagaatggagtgtacatcaagatcgtgtccaggtag

SEQ ID NO: 173212 - DNA, 1032 bp, Artificial Sequence
  Description of Artificial Sequence: Synthetic coding sequence
atgtggcccaacggcagcagcctgggcccctgcttccggcccaccaacatcaccctggaggagcggcggctgattgccagcccctggtttgctgccagcttctgtgtggtgggcctggccagcaacctgctggccctgtctgtgctggccggggcccggcagggcggcagccacaccaggagcagcttcctgaccttcctgtgtggcctggtgctgacagacttcctgggcctgctggtgacaggcaccatcgtggtgtcccagcacgccgccctgtttgagtggcatgctgtggaccccggctgccgcctgtgccgcttcatgggcgtggtgatgatcttcttcggcctgagccccctgctgctgggcgccgccatggccagcgagcgctacctgggcatcacccggcccttcagcaggcctgctgtggccagccagaggcgggcctgggccaccgtgggcctggtgtgggccgccgccctggccctgggcctgctgcccctgctgggcgtgggccgctacacagtgcagtacccaggctcctggtgcttcctgaccctgggcgctgagagcggagatgtggccttcggcctgctcttctccatgctgggcggcctgtctgtgggcctgtccttcctgctgaacacagtgtctgtggccaccctgtgccacgtgtaccacggccaggaggccgcccagcagaggccccgggacagcgaggtggagatgatggcccagctgctgggcatcatggtggtggcctctgtgtgctggctgcccctgctggtgttcatcgcccagacagtgctgagaaatcctccagccatgagccctgctggccagctgagcaggaccacagagaaggagctgctgatctacctgcgggtggccacctggaaccagatcctggacccctgggtgtacatcctcttccggcgggctgtgctgcggcggctgcagccccggctgagcacccggcccaggagcctgagcctgcagccccagctgacccagaggagcggcctgcagtag

SEQ ID NO: 173213 - DNA, 1224 bp, Artificial Sequence
  Description of Artificial Sequence: Synthetic coding sequence
atgtggcccaacggcagcagcctgggcccctgcttccggcccaccaacatcaccctggaggagcggcggctgattgccagcccctggtttgctgccagcttctgtgtggtgggcctggccagcaacctgctggccctgtctgtgctggccggggcccggcagggcggcagccacaccaggagcagcttcctgaccttcctgtgtggcctggtgctgacagacttcctgggcctgctggtgacaggcaccatcgtggtgtcccagcacgccgccctgtttgagtggcatgctgtggaccccggctgccgcctgtgccgcttcatgggcgtggtgatgatcttcttcggcctgagccccctgctgctgggcgccgccatggccagcgagcgctacctgggcatcacccggcccttcagcaggcctgctgtggccagccagaggcgggcctgggccaccgtgggcctggtgtgggccgccgccctggccctgggcctgctgcccctgctgggcgtgggccgctacacagtgcagtacccaggctcctggtgcttcctgaccctgggcgctgagagcggagatgtggccttcggcctgctcttctccatgctgggcggcctgtctgtgggcctgtccttcctgctgaacacagtgtctgtggccaccctgtgccacgtgtaccacggccaggaggccgcccagcagaggccccgggacagcgaggtggagatgatggcccagctgctgggcatcatggtggtggcctctgtgtgctggctgcccctgctggtgttcatcgcccagacagtgctgagaaatcctccagccatgagccctgctggccagctgagcaggaccacagagaaggagctgctgatctacctgcgggtggccacctggaaccagatcctggacccctgggtgtacatcctcttccggcgggctgtgctgcggcggctgcagccccggctgagcacccggccccggcgcagcctgaccctgtggcccagcctggagtacagcggcaccatcagcgcccactgcaacctgcggctgcccggcagcagtgacagccgggccagcgccagcagagctgctggcatcaccggggtgagccactgtgcccggccctgcatgctgtttgatcctgagtttgacctgctggccggcgtgcagctgctgccctttgagcccccaacaggcaaggccctgagcaggaaggactag

SEQ ID NO: 173214 - DNA, 1422 bp, Artificial Sequence
  Description of Artificial Sequence: Synthetic coding sequence
atgagggaggtgcgggcccggctggccgccacccaggtggagtacatcagcggcaaggtgttcttcaccacctgcagcgacctgaacatgctgaagaagctgaagtctgctgagcggctcttcctgctgatcaagaagcagttccccctcatcatcagctctgtgtccaagggcaagatcttcaatgagatgcagaggctcatcaatgaagaccccggctcctggctgaatgccatcagcatctggaagaacctgctggagctggatgccaagaaggagaagctgagccagagagatgacaaccagctgaagaggaaggtgggagaaaatgagatcatcgccaagaagctgaagattgagcagatgcagaagattgaagaaaatagagactgccagctggagaagcagatcaaggaggagaccctggagcagagggacttcaccaccaagtctgagaagttccaggaggaggagttccagaatgacatcgagaaggccatcgacacccacaaccagaatgacctgaccttccgggtgtcctgccgctgcagcggcaccatcggcaaggccttcaccgcccaggaggtgggcaaggtgattggcatcgccatcatgaagcacttcggctggaaggctgacctgaggaacccccagctggagatcttcatccacctgaatgacatctacagcgtggtgggcatccctgtgttccgggtgtccctggccagccgggcctacatcaagacagctggcctgcggagcaccatcgcctgggccatggccagcctggccgacatcaaggccggggcctttgtgctggaccccatgtgtggcctgggcaccatcctgctggaggccgccaaggagtggccagatgtgtactacgtgggcgcagatgtgtctgacagccagctgctgggcacctgggacaacctgaaggctgctggcctggaggacaagattgagctgctgaagatctctgtgattgagctgcccctgcccagcgagagcgtggacatcatcatcagtgacatcccctttgggaagaagttcaagctgggcaaggacatcaagagcatcctgcaggagatggagcgggtgctgcacgtgggcggcaccatcgtgctgctgctgtctgaggaccaccaccggcggctgacagactgcaaggagagcaacatccccttcaacagcaaggacagccacacagatgagcccggcatcaagaagtgcctgaaccctgaggagaagacaggagccttcaagacagccagcaccagctttgaggccagcaaccacaagttcctggacaggatgagccccttcggcagcctggtgcctgtggagtgctacaaggtgtccctgggcaagacagatgccttcatctgcaagtacaagaagagccacagcagcggcctgtag

SEQ ID NO: 173215 - DNA, 873 bp, Artificial Sequence
  Description of Artificial Sequence: Synthetic coding sequence
atgagggaggtgcgggcccggctggccgccacccaggtggagtacatcagcggcaaggtgttcttcaccacctgcagcgacctgaacatgctgaagaagctgaagtctgctgagcggctcttcctgctgatcaagaagcagttccccctcatcatcagctctgtgtccaagggcaagatcttcaatgagatgcagaggctcatcaatgaagaccccggctcctggctgaatgccatcagcatctggaagaacctgctggagctggatgccaagaaggagaagctgagccagagagatgacaaccagctgaagaggaaggtgggagaaaatgagatcatcgccaagaagctgaagattgagcagatgcagaagattgaagaaaatagagactgccagctggagaagcagatcaaggaggagaccctggagcagagggacttcaccaccaagtctgagaagttccaggaggaggagttccagaatgacatcgagaaggccatcgacacccacaaccagaatgacctgaccttccgggtgtcctgccgctgcagcggcaccatcggcaaggccttcaccgcccaggtgctgtacatgggcctgagccctggcccccggctgcagatgcacatgaggagccagcagtgccgggaggagaggaccccccagacagtggccatcacccggccccaccagctggccctgaccaagttcagtgatgtgaagggccactggagcgagtacttcatcaacctgaagatcagccagaccctgaagggcggcaggaagagcaactggaactgctactatgagaccctgtggatggagagccggctggaggagagcaccatccgggacctgtacaccagcaagtag

SEQ ID NO: 173216 - DNA, 1512 bp, Artificial Sequence
  Description of Artificial Sequence: Synthetic coding sequence
atgtctgaggcccggggggagcccggcagcggccctgaggccggggcccgcttcttctgcacagctggccggggcctggagccctttgtgatgagggaggtgcgggcccggctggccgccacccaggtggagtacatcagcggcaaggtgttcttcaccacctgcagcgacctgaacatgctgaagaagctgaagtctgctgagcggctcttcctgctgatcaagaagcagttccccctcatcatcagctctgtgtccaagggcaagatcttcaatgagatgcagaggctcatcaatgaagaccccggctcctggctgaatgccatcagcatctggaagaacctgctggagctggatgccaagaaggagaagctgagccagagagatgacaaccagctgaagaggaaggtgggagaaaatgagatcatcgccaagaagctgaagattgagcagatgcagaagattgaagaaaatagagactgccagctggagaagcagatcaaggaggagaccctggagcagagggacttcaccaccaagtctgagaagttccaggaggaggagttccagaatgacatcgagaaggccatcgacacccacaaccagaatgacctgaccttccgggtgtcctgccgctgcagcggcaccatcggcaaggccttcaccgcccaggaggtgggcaaggtgattggcatcgccatcatgaagcacttcggctggaaggctgacctgaggaacccccagctggagatcttcatccacctgaatgacatctacagcgtggtgggcatccctgtgttccgggtgtccctggccagccgggcctacatcaagacagctggcctgcggagcaccatcgcctgggccatggccagcctggccgacatcaaggccggggcctttgtgctggaccccatgtgtggcctgggcaccatcctgctggaggccgccaaggagtggccagatgtgtactacgtgggcgcagatgtgtctgacagccagctgctgggcacctgggacaacctgaaggctgctggcctggaggacaagattgagctgctgaagatctctgtgattgagctgcccctgcccagcgagagcgtggacatcatcatcagtgacatcccctttgggaagaagttcaagctgggcaaggacatcaagagcatcctgcaggagatggagcgggtgctgcacgtgggcggcaccatcgtgctgctgctgtctgaggaccaccaccggcggctgacagactgcaaggagagcaacatccccttcaacagcaaggacagccacacagatgagcccggcatcaagaagtgcctgaaccctgaggagaagacaggagccttcaagacagccagcaccagctttgaggccagcaaccacaagttcctggacaggatgagccccttcggcagcctggtgcctgtggagtgctacaaggtgtccctgggcaagacagatgccttcatctgcaagtacaagaagagccacagcagcggcctgtag

SEQ ID NO: 173217 - DNA, 486 bp, Artificial Sequence
  Description of Artificial Sequence: Synthetic coding sequence
atgaacctggccatcagcatcgccctgctgctgactgtgctgcaggtgtcccggggccagaaggtgaccagcctgacagcctgcctggtggaccagagcctgcggctggactgcagacatgagaacaccagcagcagccccatccagtatgagttcagcctgacccgggagaccaagaagcacgtgctgtttggcaccgtgggcgtgcctgagcacacctaccgcagcaggaccaacttcaccagcaagtacaacatgaaggtgctgtacctgagcgccttcaccagcaaggatgagggcacctacacctgtgccctgcaccacagcggccacagcccccccatcagcagccagaatgtgacagtgctgcgggacaagctggtgaagtgtgagggcatcagcctgctggcccagaacacctcctggctgctgctgctgctgctgagcctgagcctgctgcaggccacagacttcatgagcctgtag

SEQ ID NO: 173218 - DNA, 486 bp, Artificial Sequence; identical to SEQ ID NO: 173217
  Description of Artificial Sequence: Synthetic coding sequence

SEQ ID NO: 173219 - DNA, 480 bp, Artificial Sequence
  Description of Artificial Sequence: Synthetic coding sequence
atgttcccctttgccctgctgtatgtgctgtctgtgtccttcaggaagatcttcatcctgcagctggtgggcctggtgctgacctatgacttcaccaactgtgactttgagaagatcaaggccgcctacctgagcaccatcagcaaggacctgatcacctacatgagcggcaccaagagcacagagttcaacaacacagtgtcctgcagcaaccggccccactgcctgacagagatccagagcctgaccttcaaccccacagctggctgtgccagcctggccaaggagatgtttgccatgaagaccaaggccgccctggccatctggtgccccggctacagcgagacccagatcaatgccacccaggccatgaagaagaggaggaagaggaaggtgaccaccaacaagtgcctggagcaggtgtcccagctgcagggcctgtggaggcgcttcaaccggcccctgctgaagcagcagtag

SEQ ID NO: 173220 - DNA, 192 bp, Artificial Sequence
  Description of Artificial Sequence: Synthetic coding sequence
atgtttgccatgaagaccaaggccgccctggccatctggtgccccggctacagcgagacccagatcaatgccacccaggccatgaagaagaggaggaagaggaaggtgaccaccaacaagtgcctggagcaggtgtcccagctgcagggcctgtggaggcgcttcaaccggcccctgctgaagcagcagtag

SEQ ID NO: 173221 - DNA, 705 bp, Artificial Sequence
  Description of Artificial Sequence: Synthetic coding sequence
atgagctgcatcaacctgcccaccgtgctgcccggcagccccagcaagacccggggccagatccaggtgatcctgggccccatgttcagcggcaagagcacagagctgatgagaagagtgcggcgcttccagatcgcccagtacaagtgcctggtgatcaagtatgccaaggacacccgctacagcagcagcttctgcacccatgacaggaacaccatggaggccctgcctgcctgcctgctgagagatgtggcccaggaggccctgggcgtggccgtcatcggcattgatgagggccagttcttcccagacatcgtggagttctgtgaggccatggccaatgccggcaagacagtcatcgtggccgccctggatggcaccttccagaggaagccctttggagccatcctgaacctggtgcccctggccgagagcgtggtgaagctgacagctgtgtgcatggagtgcttccgggaggccgcctacaccaagaggctgggcacagagaaggaggtggaggtgattggaggagctgacaagtaccacagcgtgtgccgcctgtgctacttcaagaaggccagcggccagcctgctggccctgacaacaaggagaactgccctgtgcctgggaagccaggagaggccgtggccgccaggaagctgtttgccccccagcagatcctgcagtgcagccctgccaactag

SEQ ID NO: 173222 - DNA, 705 bp, Artificial Sequence; identical to SEQ ID NO: 173221
  Description of Artificial Sequence: Synthetic coding sequence

SEQ ID NO: 173223 - DNA, 924 bp, Artificial Sequence
  Description of Artificial Sequence: Synthetic coding sequence
atgaggcctggcctcttcaagggccaggcccctggcagcagaagaagacccacagctggcctggccgtggtgcgggctgacagccacaagaaggagccccgggccagcggcagcgcccggcctgccatgctgctgtggcccctgcggggctgggccgcccgggccctgcgctgctttggacctggcagccggggcagccctgccagcggccctggcccccggcgggtgcagaggcgggcctggcccccagacaaggagcaggagaaggagaagaagagcgtcatctgtgtggagggcaacatcgccagcggcaagaccacctgcctggagttcttcagcaatgccacagatgtggaggtgctgacagagcctgtgtccaagtggagaaatgtgcggggccacaaccccctgggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtaccgcagcggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaagctgaccaccacatggagaggatgctggagctgtttgagcagaacagagaccgcatcctgaccccagaaaataggaagcactgcccctag

SEQ ID NO: 173224 - DNA, 744 bp, Artificial Sequence
  Description of Artificial Sequence: Synthetic coding sequence
atgctgctgtggcccctgcggggctgggccgcccgggccctgcgctgctttggacctggcagccggggcagccctgccagcggccctggcccccggcgggtgcagaggcgggcctggcccccagacaaggagcaggagaaggagaagaagagcgtcatctgtgtggagggcaacatcgccagcggcaagaccacctgcctggagttcttcagcaatgccacagatgtggagggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtaccgcagcggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaagctgaccaccacatggagaggatgctggagctgtttgagcagaacagagaccgcatcctgaccccagaaaataggaagcactgcccctag

SEQ ID NO: 173225 - DNA, 798 bp, Artificial Sequence
  Description of Artificial Sequence: Synthetic coding sequence
atgctgctgtggcccctgcggggctgggccgcccgggccctgcgctgctttggacctggcagccggggcagccctgccagcggccctggcccccggcgggtgcagaggcgggcctggcccccagacaaggagcaggagaaggagaagaagagcgtcatctgtgtggagggcaacatcgccagcggcaagaccacctgcctggagttcttcagcaatgccacagatgtggaggtgctgacagagcctgtgtccaagtggagaaatgtgcggggccacaaccccctgggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtaccgcagcggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaagctgaccaccacatggagaggatgctggagctgtttgagcagaacagagaccgcatcctgaccccagaaaataggaagcactgcccctag

SEQ ID NO: 173226 - DNA, 507 bp, Artificial Sequence
  Description of Artificial Sequence: Synthetic coding sequence
atgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtacagaagtggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaggccgaccaccacatggagaggatgctggagctgtttgagcagaacagagaccgcatcctgaccccagagaacaggaagcactgcccctag

SEQ ID NO: 173227 - DNA, 705 bp, Artificial Sequence
  Description of Artificial Sequence: Synthetic coding sequence
atgggcgccttctgccagaggcccagcagtgacaaggagcaggagaaggagaagaagagcgtcatctgtgtggagggcaacatcgccagcggcaagaccacctgcctggagttcttcagcaatgccacagatgtggaggtgctgacagagcctgtgtccaagtggagaaatgtgcggggccacaaccccctgggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtacagaagtggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaggccgaccaccacatggagaggatgctggagctgtttgagcagaacagagaccgcatcctgaccccagagaacaggaagcactgcccctag

SEQ ID NO: 173228 - DNA, 507 bp, Artificial Sequence; identical to SEQ ID NO: 173226
  Description of Artificial Sequence: Synthetic coding sequence

SEQ ID NO: 173229 - DNA, 651 bp, Artificial Sequence
  Description of Artificial Sequence: Synthetic coding sequence
atgaccagcatctgtgtggagggcaacatcgccagcggcaagaccacctgcctggagttcttcagcaatgccacagatgtggaggtgctgacagagcctgtgtccaagtggagaaatgtgcggggccacaaccccctgggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtacagaagtggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaggccgaccaccacatggagaggatgctggagctgtttgagcagaacagagaccgcatcctgaccccagagaacaggaagcactgcccctag

SEQ ID NO: 173230 - DNA, 723 bp, Artificial Sequence
  Description of Artificial Sequence: Synthetic coding sequence
atgctgctgtggcccctgcggggctgggccgcccgggccctgcgctgctttggacctggcagccggggcagccctgccagcggccctggcccccggcgggtgcagaggcgggcctggcccccagacaaggagcaggagaaggagaagaagtctgtggtgctgacagagcctgtgtccaagtggagaaatgtgcggggccacaaccccctgggcctgatgtaccatgatgccagccgctggggcctgaccctgcagacctacgtgcagctgaccatgctggacagacacacccggccccaggtgtcctctgtgcggctgatggagaggagcatccacagcgcccgctacatctttgtggagaacctgtacagaagtggcaagatgcctgaggtggactatgtggtgctgtctgagtggtttgactggatcctgaggaacatggatgtgtctgtggacctgattgtgtacctgcggaccaaccctgagacctgctaccagaggctgaagaagcgctgccgggaggaggagaaggtgatccccctggagtacctggaggccatccaccacctgcacgaggagtggctgatcaagggcagcctcttccccatggccgcccctgtgctggtgattgaggccgaccaccacatggagaggatgctggagctgtttgagcagaacagagaccgcatcctgaccccagagaacaggaagcactgcccctag

SEQ ID NO: 173231 - DNA, 840 bp, Artificial Sequence
  Description of Artificial Sequence: Synthetic coding sequence
atgcctgtggccggcagcgagctgccccggcggcccctgcccccagctgcccaggagagagatgctgagccccggcccccccacggggagctgcagtacctgggccagatccagcacatcctgcgctgtggggtgaggaaggatgacagaactggaacaggcaccctgtctgtgtttggcatgcaggcccgctacagcctgagagatgagttccccctgctgaccaccaagagggtcttctggaagggcgtgctggaggagctgctgtggttcatcaagggcagcaccaatgccaaggagctgagcagcaagggcgtgaagatctgggatgccaacggcagccgggacttcctggacagcctgggcttcagcacccgggaggagggggacctgggccctgtgtatggcttccagtggaggcactttggagctgagtacagagacatggagagtgacctgcccctgatggccctgcccccctgccacgccctgtgccagttctacgtggtgaacagcgagctgagctgccagctgtaccagaggtctggggacatgggcctgggcgtgcccttcaacatcgccagctatgccctgctgacctacatgattgcccacatcaccggcctgaagccaggggacttcatccacaccctgggagatgcccacatctacctgaaccacatcgagcccctgaagatccagctgcagcgggagccccggcccttccccaagctgcgcatcctgaggaaggtggagaagattgatgacttcaaggccgaggacttccagatcgagggctacaacccccaccccaccatcaagatggagatggctgtgtag

SEQ ID NO: 173232 - DNA, 693 bp, Artificial Sequence
  Description of Artificial Sequence: Synthetic coding sequence
atgcctgtggccggcagcgagctgccccggcggcccctgcccccagctgcccaggagagagatgctgagccccggcccccccacggggagctgcagtacctgggccagatccagcacatcctgcgctgtggggtgaggaaggatgacagaactggaacaggcaccctgtctgtgtttggcatgcaggcccgctacagcctgcgggactacagcggccagggcgtggaccagctgcagagggtcatcgacaccatcaagaccaacccagatgaccggcgcatcatcatgtgtgcctggaacccccgggacctgcccctgatggccctgcccccctgccacgccctgtgccagttctacgtggtgaacagcgagctgagctgccagctgtaccagaggtctggggacatgggcctgggcgtgcccttcaacatcgccagctatgccctgctgacctacatgattgcccacatcaccggcctgaagccaggggacttcatccacaccctgggagatgcccacatctacctgaaccacatcgagcccctgaagatccagctgcagcgggagccccggcccttccccaagctgcgcatcctgaggaaggtggagaagattgatgacttcaaggccgaggacttccagatcgagggctacaacccccaccccaccatcaagatggagatggctgtgtag

SEQ ID NO: 173233 - DNA, 942 bp, Artificial Sequence
  Description of Artificial Sequence: Synthetic coding sequence
atgcctgtggccggcagcgagctgccccggcggcccctgcccccagctgcccaggagagagatgctgagccccggcccccccacggggagctgcagtacctgggccagatccagcacatcctgcgctgtggggtgaggaaggatgacagaactggaacaggcaccctgtctgtgtttggcatgcaggcccgctacagcctgagagatgagttccccctgctgaccaccaagagggtcttctggaagggcgtgctggaggagctgctgtggttcatcaagggcagcaccaatgccaaggagctgagcagcaagggcgtgaagatctgggatgccaacggcagccgggacttcctggacagcctgggcttcagcacccgggaggagggggacctgggccctgtgtatggcttccagtggaggcactttggagctgagtacagagacatggagagtgactacagcggccagggcgtggaccagctgcagagggtgattgacaccatcaagaccaacccagatgaccggcgcatcatcatgtgtgcctggaacccccgggacctgcccctgatggccctgcccccctgccacgccctgtgccagttctacgtggtgaacagcgagctgagctgccagctgtaccagaggtctggggacatgggcctgggcgtgcccttcaacatcgccagctatgccctgctgacctacatgattgcccacatcaccggcctgaagccaggggacttcatccacaccctgggagatgcccacatctacctgaaccacatcgagcccctgaagatccagctgcagcgggagccccggcccttccccaagctgcgcatcctgaggaaggtggagaagattgatgacttcaaggccgaggacttccagatcgagggctacaacccccaccccaccatcaagatggagatggctgtgtag

SEQ ID NO: 173234 - DNA, 678 bp, Artificial Sequence
  Description of Artificial Sequence: Synthetic coding sequence
atgagccggcccaggaagaggctggccggcaccagcggcagtgacaagggcctgagcggcaagaggaccaagacagagaacagcggggaggccctggccaaggtggaggacagcaacccccagaagaccagcgccaccaagaactgcctgaagaacctgagcagccactggctgatgaagtctgagcctgagagccggctggagaagggcgtggatgtgaagttcagcattgaggacctgaaggcccagcccaagcagaccacctgctgggatggagtgaggaactaccaggccaggaacttcctgcgggccatgaagctgggggaggaggccttcttctaccacagcaactgcaaggagcccggcattgctggcctgatgaagatcgtgaaggaggcctacccagaccacacccagtttgagaagaacaacccccactatgaccccagcagcaaagaagacaaccccaagtggagcatggtggatgtgcagtttgtgaggatgatgaagcgcttcatccccctggccgagctgaagagctaccaccaggcccacaaggccaccggcggccccctgaagaacatggtgctcttcacccggcagaggctgagcatccagcccctgacccaggaggagtttgattttgtgctgagcctggaggagaaggagcccagctag

SEQ ID NO: 173235 - DNA, 501 bp, Artificial Sequence
  Description of Artificial Sequence: Synthetic coding sequence
atgagccggcccaggaagaggctggccggcaccagcggcagtgacaagggcctgagcggcaagaggaccaagacagagaacagcggggaggccctggccaaggtggaggacagcaacccccagaagaccagcgccaccaagaactgcctgaagaacctgagcagccactggctgatgaagtctgagcctgagagccggctggagaagggcgtggatgtgaagttcagcattgaggacctgaaggcccagcccaagcagaccacctgctgggatggagtgaggaactaccaggccaggaacttcctgcgggccatgaagctgggggaggaggccttcttctaccacagcaactgcaaggagcccggcattgctggcctgatgaagatcgtgaaggaggcctacccagaccacacccagtttgagaagaacaacccccactatgaccccagcagcaaagaagacaaccccaagtggagcatgaagagcctcatcctcttctag

SEQ ID NO: 173236 - DNA, 678 bp, Artificial Sequence; identical to SEQ ID NO: 173234
  Description of Artificial Sequence: Synthetic coding sequence

SEQ ID NO: 173237 - DNA, 678 bp, Artificial Sequence; identical to SEQ ID NO: 173234
  Description of Artificial Sequence: Synthetic coding sequence

SEQ ID NO: 173238 - DNA, 1926 bp, Artificial Sequence
  Description of Artificial Sequence: Synthetic coding sequence
atggccctgagcctggaggagtttgtgcacagcctggacctgcggaccctgccccgggtgctggagatccaggccggcatctacctggagggcagcatctatgagatgtttggaaatgaatgctgcttcagcactggagaggtgatcaagatcaccggcctgaaggtgaagaagatcatcgccgagatctgtgagcagatcgagggctgtgagagcctgcagccctttgagctgcccatgaacttccctggcctcttcaagatcgtggccgacaagaccccctacctgaccatggaggagatcaccaggaccatccacatcggccccagccggctgggccacccctgcttctaccaccagaaggacatcaagctggagaacctgatcatcaagcagggcgagcagatcatgctgaacagcgtggaggagattgatggagagatcatggtgtcctgtgctgtggccaggaaccaccagacccacagcttcaacctgcccctgagccaggagggggagttctatgaatgtgaagatgagcgcatctacaccctgaaggagatcgtggagtggaagatccccaagaacagaaccaggacagtgaacctgacagacttcagcaacaagtgggacagcaccaaccccttccccaaggacttctacggcaccctcatcctgaagcctgtgtatgagatccagggcgtgatgaagttcaggaaggacatcatccgcatcctgcccagcctggatgtggaggtgaaggacatcacagacagctatgatgccaactggttcctgcagctgctgagcacagaggacctgtttgagatgaccagcaaggagttccccatcgtgacagaggtgattgaggcccctgagggcaaccacctgccccagagcatcctgcagcccgggaagaccatcgtcatccacaagaagtaccaggccagccgcatcctggccagcgagatccgcagcaacttccccaagaggcacttcctgatccccaccagctacaagggcaagttcaagaggcggccccgggagttccccacagcctatgacctggagatcgccaagtctgagaaggagcccctgcacgtggtggccaccaaggccttccacagcccccatgacaagctgagctctgtgtctgtgggggaccagttcctggtgcaccagagcgagaccacagaggtgctgtgtgagggcatcaagaaggtggtgaatgtgctggcctgtgagaagatcctgaagaagagctatgaagctgccctgctgcccctgtacatggagggcggctttgtggaggtgattcatgacaagaagcagtaccccatcagcgagctgtgcaagcagttccggctgcccttcaacgtgaaggtgtctgtgcgggacctgagcattgaggaggatgtgctggccgccaccccaggcctgcagctggaggaggacatcacagacagctacctgctgatcagtgactttgccaaccccacagagtgctgggagatccctgtgggccgcctgaacatgacagtgcagctggtgagcaacttcagcagagatgctgagcccttcctggtgaggaccctggtggaggagatcacagaggagcagtactacatgatgagaagatatgagagcagcgccagccaccccccacccaggcctcccaagcaccccagcgtggaggagaccaagctgaccctgctgaccctggccgaggagaggacagtggacctgcccaagagccccaagaggcaccacgtggacatcaccaagaagctgcaccccaaccaggccggcctggacagcaaggtgctgattggcagccagaatgacctggtggatgaggagaaggagaggagcaacagaggagccacagccatcgccgagaccttcaagaatgagaagcaccagaagtag

SEQ ID NO: 173239 - DNA, 1689 bp, Artificial Sequence
  Description of Artificial Sequence: Synthetic coding sequence
atgaacttccctggcctcttcaagatcgtggccgacaagaccccctacctgaccatggaggagatcaccaggaccatccacatcggccccagccggctgggccacccctgcttctaccaccagaaggacatcaagctggagaacctgatcatcaagcagggcgagcagatcatgctgaacagcgtggaggagattgatggagagatcatggtgtcctgtgctgtggccaggaaccaccagacccacagcttcaacctgcccctgagccaggagggggagttctatgaatgtgaagatgagcgcatctacaccctgaaggagatcgtggagtggaagatccccaagaacagaaccaggacagtgaacctgacagacttcagcaacaagtgggacagcaccaaccccttccccaaggacttctacggcaccctcatcctgaagcctgtgtatgagatccagggcgtgatgaagttcaggaaggacatcatccgcatcctgcccagcctggatgtggaggtgaaggacatcacagacagctatgatgccaactggttcctgcagctgctgagcacagaggacctgtttgagatgaccagcaaggagttccccatcgtgacagaggtgattgaggcccctgagggcaaccacctgccccagagcatcctgcagcccgggaagaccatcgtcatccacaagaagtaccaggccagccgcatcctggccagcgagatccgcagcaacttccccaagaggcacttcctgatccccaccagctacaagggcaagttcaagagaagaccccgggagttccccacagcctatgacctggagatcgccaagtctgagaaggagcccctgcacgtggtggccaccaaggccttccacagcccccatgacaagctgagctctgtgtctgtgggggaccagttcctggtgcaccagagcgagaccacagaggtgctgtgtgagggcatcaagaaggtggtgaatgtgctggcctgtgagaagatcctgaagaagagctatgaggccgccctgctgcccctgtacatggagggcggctttgtggaggtgattcatgacaagaagcagtaccccatcagcgagctgtgcaagcagttccggctgcccttcaacgtgaaggtgtctgtgcgggacctgagcattgaagaagatgtgctggccgccaccccaggcctgcagctggaggaggacatcacagacagctacctgctgatcagtgactttgccaaccccacagagtgctgggagatccctgtgggccgcctgaacatgacagtgcagctggtgagcaacttcagcagagatgctgagcccttcctggtgaggaccctggtggaggagatcacagaggagcagtactacatgatgagaagatatgagagcagcgccagccaccccccaccccggccccccaagcaccccagcgtggaggagaccaagctgaccctgctgaccctggccgaggagaggacagtggacctgcccaagagccccaagaggcaccacgtggacatcaccaagaagctgcaccccaaccaggccggcctggacagcaaggtgctgattggcagccagaatgacctggtggatgaggagaaggagaggagcaacagaggagccacagccatcgccgagaccttcaagaatgagaagcaccagaagtag

SEQ ID NO: 173240 - DNA, 372 bp, Artificial Sequence
  Description of Artificial Sequence: Synthetic coding sequence
atgaacttccctgtgaggaaggacatcatccgcatcctgcccagcctggatgtggaggtgaaggacatcacagacagctatgatgccaactggttcctgcagctgctgagcacagaggacctgtttgagatgaccagcaaggagttccccatcgtgacagaggtgattgaggcccctgagggcaaccacctgccccagagcatcctgcagcccgggaagaccatcgtcatccacaagaagtaccaggccagccgcatcctggccagcgagatccgcagcaacttccccaagaggcacttcctgatccccaccagctacaagggcaagttcaagaggcggccccgggagttccccacagcctatgacctgtag

SEQ ID NO: 173241 - DNA, 1821 bp, Artificial Sequence
  Description of Artificial Sequence: Synthetic coding sequence
atgtttggaaatgaatgctgcttcagcactggagaggtgatcaagatcaccggcctgaaggtgaagaagatcatcgccgagatctgtgagcagatcgagggctgtgagagcctgcagccctttgagctgcccatgaacttccctggcctcttcaagatcgtggccgacaagaccccctacctgaccatggaggagatcaccaggaccatccacatcggccccagccggctgggccacccctgcttctaccaccagaaggacatcaagctggagaacctgatcatcaagcagggcgagcagatcatgctgaacagcgtggaggagattgatggagagatcatggtgtcctgtgctgtggccaggaaccaccagacccacagcttcaacctgcccctgagccaggagggggagttctatgaatgtgaagatgagcgcatctacaccctgaaggagatcgtggagtggaagatccccaagaacagaaccaggacagtgaacctgacagacttcagcaacaagtgggacagcaccaaccccttccccaaggacttctacggcaccctcatcctgaagcctgtgtatgagatccagggcgtgatgaagttcaggaaggacatcatccgcatcctgcccagcctggatgtggaggtgaaggacatcacagacagctatgatgccaactggttcctgcagctgctgagcacagaggacctgtttgagatgaccagcaaggagttccccatcgtgacagaggtgattgaggcccctgagggcaaccacctgccccagagcatcctgcagcccgggaagaccatcgtcatccacaagaagtaccaggccagccgcatcctggccagcgagatccgcagcaacttccccaagaggcacttcctgatccccaccagctacaagggcaagttcaagagaagaccccgggagttccccacagcctatgacctggagatcgccaagtctgagaaggagcccctgcacgtggtggccaccaaggccttccacagcccccatgacaagctgagctctgtgtctgtgggggaccagttcctggtgcaccagagcgagaccacagaggtgctgtgtgagggcatcaagaaggtggtgaatgtgctggcctgtgagaagatcctgaagaagagctatgaggccgccctgctgcccctgtacatggagggcggctttgtggaggtgattcatgacaagaagcagtaccccatcagcgagctgtgcaagcagttccggctgcccttcaacgtgaaggtgtctgtgcgggacctgagcattgaagaagatgtgctggccgccaccccaggcctgcagctggaggaggacatcacagacagctacctgctgatcagtgactttgccaaccccacagagtgctgggagatccctgtgggccgcctgaacatgacagtgcagctggtgagcaacttcagcagagatgctgagcccttcctggtgaggaccctggtggaggagatcacagaggagcagtactacatgatgagaagatatgagagcagcgccagccaccccccaccccggccccccaagcaccccagcgtggaggagaccaagctgaccctgctgaccctggccgaggagaggacagtggacctgcccaagagccccaagaggcaccacgtggacatcaccaagaagctgcaccccaaccaggccggcctggacagcaaggtgctgattggcagccagaatgacctggtggatgaggagaaggagaggagcaacagaggagccacagccatcgccgagaccttcaagaatgagaagcaccagaagtag

SEQ ID NO: 173242 - DNA, 2043 bp, Artificial Sequence
  Description of Artificial Sequence: Synthetic coding sequence
atggccctgagcctggaggagtttgtgcacagcctggacctgcggaccctgccccgggtgctggagatccaggccggcatctacctggagggcagcatctatgagatgtttggaaatgaatgctgcttcagcactggagaggtgatcaagatcaccggcctgaaggtgaagaagatcatcgccgagatctgtgagcagatcgagggctgtgagagcctgcagccctttgagctgcccatgaacttccctggcctcttcaagatcgtggccgacaagaccccctacctgaccatggaggagatcaccaggaccatccacatcggccccagccggctgggccacccctgcttctaccaccagaaggacatcaagctggagaacctgatcatcaagcagggcgagcagatcatgctgaacagcgtggaggagattgatggagagatcatggtgtcctgtgctgtggccaggaaccaccagacccacagcttcaacctgcccctgagccaggagggggagttctatgaatgtgaagatgagcgcatctacaccctgaaggagatcgtggagtggaagatccccaagaacagaaccaggacagtgaacctgacagacttcagcaacaagtgggacagcaccaaccccttccccaaggacttctacggcaccctcatcctgaagcctgtgtatgagatccagggcgtgatgaagttcaggaaggacatcatccgcatcctgcccagcctggatgtggaggtgaaggacatcacagacagctatgatgccaactggttcctgcagctgctgagcacagaggacctgtttgagatgaccagcaaggagttccccatcgtgacagaggtgattgaggcccctgagggcaaccacctgccccagagcatcctgcagcccgggaagaccatcgtcatccacaagaagtaccaggccagccgcatcctggccagcgagatccgcagcaacttccccaagaggcacttcctgatccccaccagctacaagggcaagttcaagaggcggccccgggagttccccacagcctatgacctggagatcgccaagtctgagaaggagcccctgcacgtggtggccaccaaggccttccacagcccccatgacaagctgagctctgtgtctgtgggggaccagttcctggtgcaccagagcgagaccacagaggtgctgtgtgagggcatcaagaaggtggtgaatgtgctggcctgtgagaagatcctgaagaagagctatgaagctgccctgctgcccctgtacatggagggcggctttgtggaggtgattcatgacaagaagcagtaccccatcagcgagctgtgcaagcagttccggctgcccttcaacgtgaaggtgtctgtgcgggacctgagcattgaggaggatgtgctggccgccaccccaggcctgcagctggaggaggacatcacagacagctacctgctgatcagtgactttgccaaccccacagagtgctgggagatccctgtgggccgcctgaacatgacagtgcagctggtgagcaacttcagcagagatgctgagcccttcctggtgaggaccctggtggaggagatcacagaggagcagtactacatgatgagaagatatgagagcagcgccagccaccccccacccaggcctcccaagcaccccagcgtggaggagaccaagctgaccctgctgaccctggccgaggagaggacagtggacctgcccaagagccccaaggccggcgtgcagtggagggacctgggcagcctgcagcccctgcccccaggcttcaagcagttcagcgccagcgccagccacgtggccggcatcaccggcaccccccaccacgtgcagaggcaccacgtggacatcaccaagaagctgcaccccaaccaggccggcctggacagcaaggtgctgattggcagccagaatgacctggtggatgaggagaaggagaggagcaacagaggagccacagccatcgccgagaccttcaagaatgagaagcaccagaagtag

SEQ ID NO: 173243 - DNA, 1581 bp, Artificial Sequence
  Description of Artificial Sequence: Synthetic coding sequence
atggatgtgcgcttctacccacctccagcccagcctgctgctgccccagatgccccctgcctgggccccagcccctgcctggacccctactactgcaacaagtttgatggagagaacatgtacatgtccatgacagagcccagccaggactatgtgcctgccagccagagctacccaggccccagcctggagagcgaggacttcaacatcccccccatcaccccacccagcctgcctgaccacagcctggtgcacctgaatgaggtggagagcggctaccacagcctgtgccaccccatgaaccacaacggcctgctgcccttccacccccagaacatggacctgcctgagatcaccgtgagcaacatgctgggccaggacggcaccctgctgagcaacagcatctctgtgatgccagacatccggaaccctgagggcacccagtacagcagccacccccagatggccgccatgaggccccggggccagcctgctgacatccggcagcagcccggcatgatgccccacggccagctgaccaccatcaaccagagccagctgagcgcccagctgggcctgaacatgggcggcagcaatgtgccccacaacagccccagccccccaggcagcaagagcgccacccccagccccagcagctctgtgcatgaagatgaaggagatgacaccagcaagatcaatggaggagagaagaggcctgccagtgacatgggcaagaagcccaagacccccaagaagaagaagaagaaggaccccaatgagccccagaagcctgtgtctgcctatgccctcttcttccgggacacccaggccgccatcaagggccagaaccccaatgccaccttcggggaggtgtccaagatcgtggcctccatgtgggatggcctgggggaggagcagaagcaggtgtacaagaagaagacagaggccgccaagaaggagtacctgaagcagctggccgcctaccgggccagcctggtgtccaagagctacagcgagcctgtggatgtgaagaccagccagcccccccagctgatcaacagcaagcccagcgtcttccacggccccagccaggcccacagcgccctgtacctgagcagccactaccaccagcagcccggcatgaacccccacctgacagccatgcaccccagcctgcccaggaacatcgcccccaagcccaacaaccagatgcctgtgacagtgtccatcgccaacatggctgtgtccccacctccacccctgcagatcagcccccccctgcaccagcacctgaacatgcagcagcaccagcccctgaccatgcagcagcccctgggcaaccagctgcccatgcaggtgcagagcgccctgcacagccccaccatgcagcagggcttcaccctgcagcctgactaccagaccatcatcaaccccaccagcacagctgcccaggtggtgacccaggccatggagtatgtgcgcagcggctgcaggaaccccccaccccagcctgtggactggaacaatgactactgcagcagcggcggcatgcagagggacaaggccctgtacctgacctag

SEQ ID NO: 173244 - DNA, 831 bp, Artificial Sequence
  Description of Artificial Sequence: Synthetic coding sequence
atgggcaagaagcccaagacccccaagaagaagaagaagaaggaccccaatgagccccagaagcctgtgtctgcctatgccctcttcttccgggacacccaggccgccatcaagggccagaaccccaatgccaccttcggggaggtgtccaagatcgtggcctccatgtgggatggcctgggggaggagcagaagcaggtgtacaagaagaagacagaggccgccaagaaggagtacctgaagcagctggccgcctaccgggccagcctggtgtccaagagctacagcgagcctgtggatgtgaagaccagccagcccccccagctgatcaacagcaagcccagcgtcttccacggccccagccaggcccactaccaccagcagcccggcatgaacccccacctgacagccatgcaccccagcctgcccaggaacatcgcccccaagcccaacaaccagatgcctgtgacagtgtccatcgccaacatggctgtgtccccacctccacccctgcagatcagcccccccctgcaccagcacctgaacatgcagcagcaccagcccctgaccatgcagcagcccctgggcaaccagctgcccatgcaggtgcagagcgccctgcacagccccaccatgcagcagggcttcaccctgcagcctgactaccagaccatcatcaaccccaccagcacagctgcccaggtggtgacccaggccatggagtatgtgcgcagcggctgcaggaaccccccaccccagcctgtggactggaacaatgactactgcagcagcggcggcatgcagagggacaaggccctgtacctgacctag

SEQ ID NO: 173245 - DNA, 747 bp, Artificial Sequence
  Description of Artificial Sequence: Synthetic coding sequence
atgcctgagttcctggaggaccccagcgtgctgaccaaggacaagctgaagtctgagctggtggccaacaacgtgaccctgcctgctggggagcagaggaaggatgtgtatgtgcagctgtacctgcagcacctgacagccaggaacagaccacccctgcctgctggcaccaacagcaagggccccccagacttcagcagtgatgaggagcgggagcccacccctgtgctgggcagcggggctgctgctgctggccgcagcagagctgctgtgggcaggaaggccaccaagaagacagacaagccccggcaggaggacaaggatgacctggatgtgacagagctgaccaatgaagacctgctggaccagctggtgaagtatggagtgaaccctggccccatcgtgggcaccaccaggaagctgtatgagaagaagctgctgaagctgcgggagcagggcacagagagccgcagcagcacccccctgcccaccatcagcagcagcgctgagaacacccggcagaatggcagcaatgacagcgaccgctacagcgacaatgaggaggacagcaagattgagctgaagctggagaagcgggagcccctgaagggccgggccaagacccctgtgaccctgaagcagaggagagtggagcacaaccaggtgtccctggtgctgctgcccccctgcaccggcatcaacaacctgctgaccaccctcatccacgtgctggccttcaatggatag

SEQ ID NO: 173246 - DNA, 2085 bp, Artificial Sequence
  Description of Artificial Sequence: Synthetic coding sequence
atgcctgagttcctggaggaccccagcgtgctgaccaaggacaagctgaagtctgagctggtggccaacaacgtgaccctgcctgctggggagcagaggaaggatgtgtatgtgcagctgtacctgcagcacctgacagccaggaacagaccacccctgcctgctggcaccaacagcaagggccccccagacttcagcagtgatgaggagcgggagcccacccctgtgctgggcagcggggctgctgctgctggccgcagcagagctgctgtgggcaggaaggccaccaagaagacagacaagccccggcaggaggacaaggatgacctggatgtgacagagctgaccaatgaagacctgctggaccagctggtgaagtatggagtgaaccctggccccatcgtgggcaccaccaggaagctgtatgagaagaagctgctgaagctgcgggagcagggcacagagagccgcagcagcacccccctgcccaccatcagcagcagcgctgagaacacccggcagaatggcagcaatgacagcgaccgctacagcgacaatgaggagggcaagaagaaggagcacaagaaggtgaagagcacccgggacatcgtgcccttcagcgagctgggcaccacccccagcggcggcggcttcttccagggcatctccttccctgagatcagcaccaggcctcccctgggcagcacagagctgcaggccgccaagaaggtgcacaccagcaagggggacctgccccgggagcccctggtggccaccaacctgcccggccggggccagctgcagaagctggccagcgagaggaacctcttcatcagctgcaagagcagccatgaccgctgcctggagaagagcagcagcagcagcagccagcctgagcacagcgccatgctggtgtccacagctgccagccccagcctcatcaaggagaccaccaccggctactacaaggacatcgtggagaacatctgtggccgggagaagagcggcatccagcccctgtgcccagagaggagccacatcagtgaccagagccccctgagcagcaagaggaaggccctggaggagagcgagagcagccagctgatcagcccccccctggcccaggccatccgggactatgtgaacagcctgctggtgcagggcggcgtgggcagcctgcccggcaccagcaacagcatgccacccctggatgtggagaacatccagaagagaattgaccagagcaagttccaggagacagagttcctgagcccccccaggaaggtgccccggctgtctgagaagtctgtggaggagcgggacagcggcagctttgtggccttccagaacatccctggcagcgagctgatgagcagctttgccaagacagtggtgagccacagcctgaccaccctgggcctggaggtggccaagcagagccagcacgacaagattgatgccagcgagctgtccttccccttccacgagagcatcctgaaggtgattgaggaggagtggcagcaggtggaccggcagctgcccagcctggcctgcaagtaccctgtgagcagccgggaggccacccagatcctgtctgtgcccaaggtggatgatgagatcctgggcttcatcagcgaggccacccccctgggcggcatccaggccgccagcacagagagctgcaaccagcagctggacctggccctgtgccgggcctatgaagctgctgccagcgccctgcagatcgccacccacacagcctttgtggccaaggccatgcaggccgacatcagccaggccgcccagatcctgagcagtgaccccagcaggacccaccaggccctgggcatcctgagcaagacctatgatgctgccagctacatctgtgaggccgcctttgatgaggtgaagatggccgcccacaccatgggaaatgccaccgtgggccgccgctacctgtggctgaaggactgcaagatcaacctggccagcaagaacaagctggccagcacccccttcaagggcggcaccctgtttggaggagaggtgtgcaaggtgatcaagaagaggggcaacaagcactag

SEQ ID NO: 173247 - DNA, 1245 bp, Artificial Sequence
  Description of Artificial Sequence: Synthetic coding sequence
atgcctgagttcctggaggaccccagcgtgctgaccaaggacaagctgaagtctgagctggtggccaacaacgtgaccctgcctgctggggagcagaggaaggatgtgtatgtgcagctgtacctgcagcacctgacagccaggaacagaccacccctgcctgctggcaccaacagcaagggccccccagacttcagcagtgatgaggagcgggagcccacccctgtgctgggcagcggggctgctgctgctggccgcagcagagctgctgtgggcaggaaggccaccaagaagacagacaagccccggcaggaggacaaggatgacctggatgtgacagagctgaccaatgaagacctgctggaccagctggtgaagtatggagtgaaccctggccccatcgtgggcaccaccaggaagctgtatgagaagaagctgctgaagctgcgggagcagggcacagagagccgcagcagcacccccctgcccaccatcagcagcagcgctgagaacacccggcagaatggcagcaatgacagcgaccgctacagcgacaatgaggaggacagcaagattgagctgaagctggagaagcgggagcccctgaagggccgggccaagacccctgtgaccctgaagcagaggagagtggagcacaaccaggtggagaccagcgagcacttcagaattgatggccctgtgatcagcgagagcacccccatcgccgagaccatcatggccagcagcaatgaaagcctggtggtgaacagagtgactggaaacttcaagcacgccagccccatcctgcccatcacagagttcagtgacatcccccggcgggcccccaagaagcccctgaccagggctgaggtgggggagaagacagaggagcggcgggtggagcgggacatcctgaaggagatgttcccctatgaggccagcacccccaccggcatcagcgccagctgccggcggcccatcaagggagctgctggccggcccctggagctgagtgacttcaggatggaggagagcttcagcagcaaatatgtgcccaagtatgtgcccctggctgatgtgaagtctgagaagaccaagaagggccgcagcatccctgtgtggatcaagatcctgctgtttgtggtggtggccgtgttcctgttcctggtgtaccaggccatggagaccaaccaggtgaaccccttcagcaacttcctgcacgtggaccccaggaagagcaactag

SEQ ID NO: 173248 - DNA, 1038 bp, Artificial Sequence
  Description of Artificial Sequence: Synthetic coding sequence
atgcctgagttcctggaggaccccagcgtgctgaccaaggacaagctgaagtctgagctggtggccaacaacgtgaccctgcctgctggggagcagaggaaggatgtgtatgtgcagctgtacctgcagcacctgacagccaggaacagaccacccctgcctgctggcaccaacagcaagggccccccagacttcagcagtgatgaggagcgggagcccacccctgtgctgggcagcggggctgctgctgctggccgcagcagagctgctgtgggcaggaaggccaccaagaagacagacaagccccggcaggaggacaaggatgacctggatgtgacagagctgaccaatgaagacctgctggaccagctggtgaagtatggagtgaaccctggccccatcgtgggcaccaccaggaagctgtatgagaagaagctgctgaagctgcgggagcagggcacagagagccgcagcagcacccccctgcccaccatcagcagcagcgctgagaacacccggcagaatggcagcaatgacagcgaccgctacagcgacaatgaggaggacagcaagattgagctgaagctggagaagcgggagcccctgaagggccgggccaagacccctgtgaccctgaagcagaggagagtggagcacaaccaggtgggggagaagacagaggagaggagagtggagcgggacatcctgaaggagatgttcccctatgaggccagcacccccaccggcatcagcgccagctgcagaagacccatcaagggagctgctggccggcccctggagctgagtgacttcaggatggaggagagcttcagcagcaaatatgtgcccaagtatgtgcccctggctgatgtgaagtctgagaagaccaagaagggccgcagcatccctgtgtggatcaagatcctgctgtttgtggtggtggccgtgttcctgttcctggtgtaccaggccatggagaccaaccaggtgaaccccttcagcaacttcctgcacgtggaccccaggaagagcaactag

SEQ ID NO: 173249 - DNA, 1365 bp, Artificial Sequence
  Description of Artificial Sequence: Synthetic coding sequence
atgcctgagttcctggaggaccccagcgtgctgaccaaggacaagctgaagtctgagctggtggccaacaacgtgaccctgcctgctggggagcagaggaaggatgtgtatgtgcagctgtacctgcagcacctgacagccaggaacagaccacccctgcctgctggcaccaacagcaagggccccccagacttcagcagtgatgaggagcgggagcccacccctgtgctgggcagcggggctgctgctgctggccgcagcagagctgctgtgggcaggaaggccaccaagaagacagacaagccccggcaggaggacaaggatgacctggatgtgacagagctgaccaatgaagacctgctggaccagctggtgaagtatggagtgaaccctggccccatcgtgggcaccaccaggaagctgtatgagaagaagctgctgaagctgcgggagcagggcacagagagccgcagcagcacccccctgcccaccatcagcagcagcgctgagaacacccggcagaatggcagcaatgacagcgaccgctacagcgacaatgaggaggacagcaagattgagctgaagctggagaagcgggagcccctgaagggccgggccaagacccctgtgaccctgaagcagaggagagtggagcacaaccagagctacagccaggccggcatcacagaaacagagtggaccagcggcagcagcaaaggaggccccctgcaggccctgacccgggagagcacccggggcagcaggaggacccccaggaagagggtggagaccagcgagcacttcagaattgatggccctgtgatcagcgagagcacccccatcgccgagaccatcatggccagcagcaatgaaagcctggtggtgaacagagtgactggaaacttcaagcacgccagccccatcctgcccatcacagagttcagtgacatcccccggcgggcccccaagaagcccctgaccagggctgaggtgggggagaagacagaggagcggcgggtggagcgggacatcctgaaggagatgttcccctatgaggccagcacccccaccggcatcagcgccagctgccggcggcccatcaagggagctgctggccggcccctggagctgagtgacttcaggatggaggagagcttcagcagcaaatatgtgcccaagtatgtgcccctggctgatgtgaagtctgagaagaccaagaagggccgcagcatccctgtgtggatcaagatcctgctgtttgtggtggtggccgtgttcctgttcctggtgtaccaggccatggagaccaaccaggtgaaccccttcagcaacttcctgcacgtggaccccaggaagagcaactag

SEQ ID NO: 173250 - DNA, 135 bp, Artificial Sequence
  Description of Artificial Sequence: Synthetic coding sequence
atgtctgacaagccagacatggccgagattgagaagtttgacaagagcaagctgaagaagacagagacccaggagaagaaccccctgcccagcaaggagaccatcgagcaggagaagcaggccggggagagctag

SEQ ID NO: 173251 - DNA, 135 bp, Artificial Sequence; identical to SEQ ID NO: 173250
  Description of Artificial Sequence: Synthetic coding sequence

SEQ ID NO: 173252 - DNA, 135 bp, Artificial Sequence; identical to SEQ ID NO: 173250
  Description of Artificial Sequence: Synthetic coding sequence

SEQ ID NO: 173253 - DNA, 135 bp, Artificial Sequence; identical to SEQ ID NO: 173250
  Description of Artificial Sequence: Synthetic coding sequence

SEQ ID NO: 173254 - DNA, 135 bp, Artificial Sequence
  Description of Artificial Sequence: Synthetic coding sequence
atgtctgacaagccaggcatggccgagattgagaagtttgacaagagcaagctgaagaagacagagacccaggagaagaaccccctgagcagcaaggagaccatcgagcaggagcggcaggccggggagagctag

SEQ ID NO: 173255 - DNA, 1299 bp, Artificial Sequence
  Description of Artificial Sequence: Synthetic coding sequence
atgggccctgctggcagcctgctgggcagcggccagatgcagatcaccctgtggggcagcctggccgctgtggccatcttcttcgtcatcaccttcctgatcttcctgtgcagcagctgtgaccgggagaagaagccccggcagcacagcggggaccacgagaacctgatgaatgtgcccagcgacaaggagatgttcagccgctctgtgaccagcctggccacagatgccccagccagcagcgagcagaatggagccctgaccaatggagacatcctgtctgaggacagcaccctgacctgcatgcagcactatgaggaggtgcagaccagcgccagtgacctgctggacagccaggacagcacaggcaagcccaagtgccaccagagccgggagctgccccgcatccccccagagagcgctgtggacaccatgctgacagcccggtctgtggatggagaccagggcctgggcatggagggcccctatgaggtgctgaaggacagcagcagccaggagaacatggtggaggactgcctgtatgaaacagtgaaggagatcaaggaggtggccgctgctgcccacctggagaagggccacagcggcaaggccaagagcaccagcgccagcaaggagctgcccggcccccagacagagggcaaggccgagtttgctgaatatgcctctgtggacaggaacaagaagtgccggcagagcgtgaatgtggagagcatcctgggcaacagctgtgaccctgaggaggaggcccctcctcctgtgcctgtgaagctgctggatgaaaatgaaaacctgcaggagaaggagggcggggaggccgaggagagcgccacagacaccaccagcgagaccaacaagcgcttcagcagcctgagctacaagagccgggaggaggaccccaccctgacagaggaggagatcagcgccatgtacagctctgtgaacaagccaggccagctggtgaacaagagcggccagagcctgactgtgcctgagagcacctacaccagcatccagggcgacccccagaggagccccagcagctgcaatgacctgtatgccaccgtgaaggactttgagaagacccccaacagcaccctgcccccagctggccggcccagcgaggagcctgagccagactatgaggccatccagaccctgaaccgggaggaggagaaggccaccctgggcaccaacggccaccacggcctggtgcccaaggaaaatgactatgagagcatcagtgacctgcagcagggccgggacatcacccggctgtag

SEQ ID NO: 173256 - DNA, 8136 bp, Artificial Sequence
  Description of Artificial Sequence: Synthetic coding sequence
atggccctggtgctggagatcttcaccctgctggccagcatctgctgggtgtctgccaacatctttgagtaccaggtggatgcccagcccctgcggccctgtgagctgcagcgggagacagccttcctgaagcaggccgactatgtgccccagtgtgccgaggatggcagcttccagacagtgcagtgccagaatgatggccgcagctgctggtgtgtgggcgccaacggcagcgaggtgctgggcagccggcagcccggccggcctgtggcctgcctgtccttctgccagctgcagaagcagcagatcctgctgagcggctacatcaacagcacagacaccagctacctgccccagtgccaggacagcggggactatgcccctgtgcagtgtgatgtgcagcaggtgcagtgctggtgtgtggatgctgagggcatggaggtgtatggcacccggcagctgggccggcccaagcgctgccccaggagctgtgagatccggaacagaaggctgctgcatggagtgggggacaagagccccccccagtgcagcgctgagggggagttcatgcctgtgcagtgcaagtttgtgaacaccacagacatgatgatctttgacctggtgcacagctacaaccgcttcccagatgcctttgtgaccttcagcagcttccagaggcgcttccctgaggtgtctggctactgccactgtgccgacagccagggccgggagctggccgagaccggcctggagctgctgctggatgagatctatgacaccatctttgctggcctggacctgcccagcaccttcacagagaccaccctgtaccgcatcctgcagaggcgcttcctggccgtgcagagcgtcatcagcggccgcttccgctgccccaccaagtgtgaggtggagcgcttcaccgccaccagctttggccacccctacgtgcccagctgcagaagaaatggagactaccaggccgtgcagtgccagacagagggcccctgctggtgtgtggatgcccagggcaaggagatgcacggcacccggcagcagggcgagccccccagctgtgccgagggccagagctgtgccagcgagcggcagcaggccctgagccggctgtacttcggcaccagcggctacttcagccagcacgacctcttcagcagccctgagaagcgctgggccagcccccgggtggccaggtttgccaccagctgcccccccaccatcaaggagctgtttgtggacagcggcctgctgcggcccatggtggagggccagagccagcagttctctgtgtctgagaacctgctgaaggaggccatccgggccatcttccccagccggggcctggcccggctggccctgcagttcaccaccaaccccaagaggctgcagcagaacctgtttggaggcaagttcctggtgaatgtgggccagttcaacctgagcggggccctgggcacccggggcaccttcaacttcagccagttcttccagcagctgggcctggccagcttcctgaatggaggccggcaggaggacctggccaagcccctgtctgtgggcctggacagcaacagcagcacaggcaccccagaggccgccaagaaggatggcaccatgaacaagcccaccgtgggcagctttggatttgagatcaacctgcaggagaaccagaatgccctgaagttcctggccagcctgctggagctgcctgagttcctgctcttcctgcagcacgccatctctgtgcctgaagatgtggcccgggacctgggagatgtgatggagaccgtgctgagcagccagacctgtgagcagaccccagagcggctgtttgtgcccagctgcaccacagagggcagctatgaagatgtgcagtgcttctctggagagtgctggtgtgtgaacagctggggcaaggagctgcccggcagccgggtgcggggcggccagccccgctgccccacagactgtgagaagcagagggccaggatgcagagcctgatgggcagccagcctgctggcagcaccctgtttgtgcctgcctgcaccagcgagggccacttcctgcctgtgcagtgcttcaacagcgagtgctactgtgtggatgctgagggccaggccatccctggcaccaggtctgccatcggcaagcccaagaagtgccccaccccctgccagctgcagagcgagcaggccttcctgaggacagtgcaggccctgctgagcaacagctccatgctgcccaccctgagtgacacctacatcccccagtgcagcacagatggccagtggaggcaggtgcagtgcaatggacctcctgagcaggtgtttgagctgtaccagcgctgggaggcccagaacaagggccaggacctgaccccagccaagctgctggtgaagatcatgagctaccgggaggccgccagcggcaacttcagcctcttcatccagagcctgtatgaagctggccagcaggatgtgtttcctgtgctgagccagtaccccagcctgcaggatgtgcccctggccgccctggagggcaagaggccccagccccgggagaacatcctgctggagccctacctgttctggcagatcctgaatggccagctgagccagtacccaggcagctacagcgacttcagcacccccctggcccactttgacctgaggaactgctggtgtgtggatgaggccggccaggagctggagggcatgaggtctgagcccagcaagctgcccacctgccccggcagctgtgaggaggccaagctgcgggtgctgcagttcatccgggagacagaggagatcgtgtctgccagcaacagcagccgcttccccctgggggagagcttcctggtggccaagggcatccggctgagaaatgaagacctgggcctgcccccactcttccccccccgggaggcctttgctgagcagttcctgcggggcagtgactatgccatccggctggccgcccagagcaccctgtccttctaccagaggcggcgcttctccccagatgattctgctggggccagcgccctgctgcggagcggcccctacatgccccagtgtgatgccttcggctcctgggagcctgtgcagtgccacgccggcaccggccactgctggtgtgtggatgagaagggcggcttcatccctggcagcctgacagcccggagcctgcagatcccccagtgccccaccacctgtgagaagagcaggaccagcggcctgctgagctcctggaagcaggcccggagccaggagaaccccagccccaaggacctgtttgtgcctgcctgcctggagactggagaatatgcccggctgcaggccagcggggccggcacctggtgtgtggaccctgccagcggggaggagctgcggcccggcagcagcagcagcgcccagtgccccagcctgtgcaatgtgctgaagagcggcgtgctgagcagaagagtgtccccaggctacgtgcctgcctgcagagcagaagatggcggcttcagccctgtgcagtgtgaccaggcccagggcagctgctggtgtgtgatggacagcggggaggaggtgcccggcaccagggtgactggaggccagcctgcctgtgagagcccccgctgccccctgcccttcaatgccagcgaggtggtgggcggcaccatcctgtgtgagaccatcagcggccccaccggcagcgccatgcagcagtgccagctgctgtgccggcagggctcctggagcgtcttccccccaggccccctcatctgcagcctggagagcggccgctgggagagccagctgccccagccccgggcctgccagaggccccagctgtggcagaccatccagacccagggccacttccagctgcagctgcccccaggcaagatgtgcagcgctgactatgctgacctgctgcagaccttccaggtgttcatcctggatgagctgacagcccggggcttctgccagatccaggtgaagaccttcggcaccctggtgtccatccctgtgtgcaacaacagctctgtgcaggtgggctgcctgacccgggagcggctgggcgtgaatgtgacctggaagagccggctggaggacatccctgtggccagcctgcctgacctgcatgacatcgagcgggccctggtgggcaaggacctgctgggccgcttcacagacctgatccagagcggcagcttccagctgcacctggacagcaagaccttccctgctgagaccatccgcttcctgcagggcgaccacttcggcaccagccccaggacctggtttggctgcagcgagggcttctaccaggtgctgaccagcgaggccagccaggacggcctgggctgtgtgaagtgcccagagggcagctacagccaggatgaggagtgcatcccctgccctgtgggcttctaccaggagcaggccggcagcctggcctgtgtgccctgccctgtgggccgcaccaccatctctgctggggccttcagccagacccacctgatgcagaagtttgagaaggtgcctgagagcaaggtgatctttgatgccaatgcccctgtggccgtgcgcagcaaggtgcctgattctgagttccctgtgatgcagtgcctgacagactgcacagaagatgaggcctgcagcttcttcaccgtgtccaccacagagcctgagatcagctgtgacttctacgcctggaccagtgacaacgtggcctgcatgaccagtgaccagaagagagatgccctgggcaacagcaaggccaccagctttggcagcctgcgctgccaggtgaaggtgcgcagccacggccaggacagccctgctgtgtacctgaagaagggccagggcagcaccaccaccctgcagaagagatttgagcccaccggcttccagaacatgctgagcggcctgtacaaccccatcgtgttcagcgccagcggggccaacctgacagatgcccacctgttctgcctgctggcctgtgaccgggacctgtgctgtgatggctttgtgctgacccaggtgcagggcggggccatcatctgtggcctgctgagcagccccagcgtgctgctgtgcaatgtgaaggactggatggaccccagcgaggcctgggccaatgccacctgccctggggtgacctatgaccaggagagccaccaggtgatcctgcggctgggggaccaggagttcatcaagagcctgacccccctggagggcacccaggacaccttcaccaacttccagcaggtgtacctgtggaaggacagcgacatgggcagcaggcctgagagcatgggctgcaggaaggacacagtgcccaggcctgccagccccacagaggccggcctgaccacagagctgttcagccctgtggacctgaaccaggtgattgtgaatggaaaccagagcctgagcagccagaagcactggctgttcaagcacctgttcagcgcccagcaggccaacctgtggtgcctgagccgctgtgtgcaggagcacagcttctgccagctggccgagatcacagaaagtgccagcctgtacttcacctgcaccctgtacccagaggcccaggtgtgtgatgacatcatggagagcaatgcccagggctgccgcctcatcctgccccagatgcccaaggccctcttcaggaagaaggtgatcctggaggacaaggtgaagaacttctacacccggctgcccttccagaagctgatgggcatcagcatccggaacaaggtgcccatgtctgagaagagcatcagcaatggcttctttgaatgtgaaagaagatgtgatgctgacccctgctgcaccggcttcggcttcctgaatgtgtcccagctgaagggcggggaggtgacctgcctgaccctgaacagcctgggcatccagatgtgcagtgaagaaaatggaggagcctggaggatcctggactgtggcagcccagacatcgaggtgcacacctaccccttcggctggtaccagaagcccatcgcccagaacaatgcccccagcttctgccccctggtggtgctgcccagcctgacagagaaggtgtccctggacagctggcagagcctggccctgagctctgtggtggtggaccccagcatccgccactttgatgtggcccacgtgtccacagctgccaccagcaacttctctgctgtgcgggacctgtgcctgtctgagtgcagccagcacgaggcctgcctgatcaccaccctgcagacccagcccggggctgtgcgctgcatgttttatgctgacacccagagctgcacccacagcctgcagggccagaactgccgcctgctgctgcgggaggaggccacccacatctacaggaagccaggcatcagcctgctgtcctatgaggcctctgtgcccagcgtgcccatcagcacccacggccgcctgctgggccgcagccaggccatccaggtgggcacctcctggaagcaggtggaccagttcctgggcgtgccctatgctgccccacccctggccgagcggcgcttccaggcccctgagcccctgaactggacaggctcctgggatgccagcaagccccgggccagctgctggcagcccggcaccaggaccagcaccagccctggggtgtctgaggactgcctgtacctgaatgtgttcatcccccagaatgtggccccaaatgcctctgtgctggtgttcttccacaacaccatggaccgggaggagagcgagggctggccagccattgatggcagcttcctggccgctgtgggcaacctgattgtggtgacagccagctacagagtgggcgtgtttggcttcctgagcagcggcagcggggaggtgtctggcaactggggcctgctggaccaggtggccgccctgacctgggtgcagacccacatccggggctttggaggagaccccaggagagtgtccctggccgctgaccggggcggcgcagatgtggccagcatccacctgctgacagcccgggccaccaacagccagctgttcagaagagctgtgctgatgggcggcagcgccctgagccctgctgctgtgatcagccatgagcgggcccagcagcaggccatcgccctggccaaggaggtgtcctgccccatgagcagcagccaggaggtggtgtcctgcctgcggcagaagccagccaacgtgctgaatgatgcccagaccaagctgctggccgtgtctggccccttccactactggggccctgtgattgatggccacttcctgcgggagcccccagcccgggccctgaagaggagcctgtgggtggaggtggacctgctgattggcagcagccaggatgatggcctcatcaacagagccaaggctgtgaagcagtttgaggagagccggggccgcaccagcagcaagacagccttctaccaggccctgcagaacagcctgggcggagaagattctgatgcccgggtggaggccgccgccacctggtactacagcctggagcacagcacagatgattatgccagcttcagccgggccctggagaatgccacccgggactacttcatcatctgccccatcatcgacatggccagcgcctgggccaagagggcccggggaaatgtgttcatgtaccacgcccctgagaactacggccacggcagcctggagctgctggctgatgtgcagtttgccctgggcctgcccttctacccagcctatgagggccagttcagcctggaggagaagagcctgagcctgaagatcatgcagtacttcagccacttcatccgcagcggcaaccccaactacccctatgagttcagcaggaaggtgcccacctttgccaccccctggccagactttgtgcccagggctggaggagagaactacaaggagttcagcgagctgctgcccaaccggcagggcctgaagaaggctgactgcagcttctggagcaagtacatcagcagcctgaagaccagcgcagatggagccaagggcggccagagcgctgagagcgaggaggaggagctgacagctggcagcggcctgcgggaggacctgctgagcctgcaggagcccggcagcaagacctacagcaagtag

SEQ ID NO: 173257 - DNA, 2664 bp, Artificial Sequence
  Description of Artificial Sequence: Synthetic coding sequence
atggccctggtgctggagatcttcaccctgctggccagcatctgctgggtgtctgccaacatctttgagtaccaggtggatgcccagcccctgcggccctgtgagctgcagcgggagacagccttcctgaagcaggccgactatgtgccccagtgtgccgaggatggcagcttccagacagtgcagtgccagaatgatggccgcagctgctggtgtgtgggcgccaacggcagcgaggtgctgggcagccggcagcccggccggcctgtggcctgcctgtccttctgccagctgcagaagcagcagatcctgctgagcggctacatcaacagcacagacaccagctacctgccccagtgccaggacagcggggactatgcccctgtgcagtgtgatgtgcagcaggtgcagtgctggtgtgtggatgctgagggcatggaggtgtatggcacccggcagctgggccggcccaagcgctgccccaggagctgtgagatccggaacagaaggctgctgcatggagtgggggacaagagccccccccagtgcagcgctgagggggagttcatgcctgtgcagtgcaagtttgtgaacaccacagacatgatgatctttgacctggtgcacagctacaaccgcttcccagatgcctttgtgaccttcagcagcttccagaggcgcttccctgaggtgtctggctactgccactgtgccgacagccagggccgggagctggccgagaccggcctggagctgctgctggatgagatctatgacaccatctttgctggcctggacctgcccagcaccttcacagagaccaccctgtaccgcatcctgcagaggcgcttcctggccgtgcagagcgtcatcagcggccgcttccgctgccccaccaagtgtgaggtggagcgcttcaccgccaccagctttggccacccctacgtgcccagctgcagaagaaatggagactaccaggccgtgcagtgccagacagagggcccctgctggtgtgtggatgcccagggcaaggagatgcacggcacccggcagcagggcgagccccccagctgtgccgagggccagagctgtgccagcgagcggcagcaggccctgagccggctgtacttcggcaccagcggctacttcagccagcacgacctcttcagcagccctgagaagcgctgggccagcccccgggtggccaggtttgccaccagctgcccccccaccatcaaggagctgtttgtggacagcggcctgctgcggcccatggtggagggccagagccagcagttctctgtgtctgagaacctgctgaaggaggccatccgggccatcttccccagccggggcctggcccggctggccctgcagttcaccaccaaccccaagaggctgcagcagaacctgtttggaggcaagttcctggtgaatgtgggccagttcaacctgagcggggccctgggcacccggggcaccttcaacttcagccagttcttccagcagctgggcctggccagcttcctgaatggaggccggcaggaggacctggccaagcccctgtctgtgggcctggacagcaacagcagcacaggcaccccagaggccgccaagaaggatggcaccatgaacaagcccaccgtgggcagctttggatttgagatcaacctgcaggagaaccagaatgccctgaagttcctggccagcctgctggagctgcctgagttcctgctcttcctgcagcacgccatctctgtgcctgaagatgtggcccgggacctgggagatgtgatggagaccgtgctgagcagccagacctgtgagcagaccccagagcggctgtttgtgcccagctgcaccacagagggcagctatgaagatgtgcagtgcttctctggagagtgctggtgtgtgaacagctggggcaaggagctgcccggcagccgggtgcggggcggccagccccgctgccccacagactgtgagaagcagagggccaggatgcagagcctgatgggcagccagcctgctggcagcaccctgtttgtgcctgcctgcaccagcgagggccacttcctgcctgtgcagtgcttcaacagcgagtgctactgtgtggatgctgagggccaggccatccctggcaccaggtctgccatcggcaagcccaagaagtgccccaccccctgccagctgcagagcgagcaggccttcctgaggacagtgcaggccctgctgagcaacagctccatgctgcccaccctgagtgacacctatgagggccagttcagcctggaggagaagagcctgagcctgaagatcatgcagtacttcagccacttcatccgcagcggcaaccccaactacccctatgagttcagcaggaaggtgcccacctttgccaccccctggccagactttgtgcccagggctggaggagagaactacaaggagttcagcgagctgctgcccaaccggcagggcctgaagaaggctgactgcagcttctggagcaagtacatcagcagcctgaagaccagcgcagatggagccaagggcggccagagcgctgagagcgaggaggaggagctgacagctggcagcggcctgcgggaggacctgctgagcctgcaggagcccggcagcaagacctacagcaagtag

SEQ ID NO: 173258 - DNA, 3417 bp, Artificial Sequence
  Description of Artificial Sequence: Synthetic coding sequence
atgatgcagaagtttgagaaggtgcctgagagcaaggtgatctttgatgccaatgcccctgtggccgtgcgcagcaaggtgcctgacagcgagttccctgtgatgcagtgcctgacagactgcacagaagatgaggcctgcagcttcttcaccgtgtccaccacagagcctgagatcagctgtgacttctacgcctggaccagtgacaacgtggcctgcatgaccagtgaccagaagagagatgccctgggcaacagcaaggccaccagctttggcagcctgcgctgccaggtgaaggtgcgcagccacggccaggacagccctgctgtgtacctgaagaagggggccatcatctgtggcctgctgagcagccccagcgtgctgctgtgcaatgtgaaggactggatggaccccagcgaggcctgggccaatgccacctgccctggggtgacctatgaccaggagagccaccaggtgatcctgcggctgggggaccaggagttcatcaagagcctgacccccctggagggcacccaggacaccttcaccaacttccagcaggtgtacctgtggaaggacagcgacatgggcagcaggcctgagagcatgggctgcaggaaggacacagtgcccaggcctgccagccccacagaagctggcctgaccacagagctgttcagccctgtggacctgaaccaggtgattgtgaatggaaaccagagcctgagcagccagaagcactggctgttcaagcacctgttcagcgcccagcaggccaacctgtggtgcctgagccgctgtgtgcaggagcacagcttctgccagctggccgagatcacagagagcgccagcctgtacttcacctgcaccctgtacccagaggcccaggtgtgtgatgacatcatggagagcaatgcccagggctgccgcctcatcctgccccagatgcccaaggccctcttcaggaagaaggtgatcctggaggacaaggtgaagaacttctacacccggctgcccttccagaagctgatgggcatcagcatccggaacaaggtgcccatgtctgagaagagcatcagcaatggcttctttgaatgtgagcggcgctgtgatgctgacccctgctgcaccggcttcggcttcctgaatgtgtcccagctgaagggcggggaggtgacctgcctgaccctgaacagcctgggcatccagatgtgcagcgaggagaatggaggagcctggaggatcctggactgtggcagcccagacatcgaggtgcacacctaccccttcggctggtaccagaagcccatcgcccagaacaatgcccccagcttctgccccctggtggtgctgcccagcctgacagagaaggtgtccctggacagctggcagagcctggccctgagctctgtggtggtggaccccagcatccgccactttgatgtggcccacgtgtccacagctgccaccagcaacttctctgctgtgcgggacctgtgcctgtctgaatgttcccagcacgaggcctgcctgatcaccaccctgcagacccagcctggagctgtgcgctgcatgttttatgctgacacccagagctgcacccacagcctgcagggccagaactgccgcctgctgctgcgggaggaggccacccacatctacaggaagccaggcatcagcctgctgtcctatgaggcctctgtgcccagcgtgcccatcagcacccacggccgcctgctgggccgcagccaggccatccaggtgggcacctcctggaagcaggtggaccagttcctgggcgtgccctatgctgccccacccctggccgagcggcgcttccaggcccctgagcccctgaactggacaggctcctgggatgccagcaagccccgggccagctgctggcagcccggcaccaggaccagcaccagccctggggtgtctgaggactgcctgtacctgaatgtgttcatcccccagaatgtggccccaaatgcctctgtgctggtgttcttccacaacaccatggaccgggaggagagcgagggctggccagccattgatggcagcttcctggccgctgtgggcaacctgattgtggtgacagccagctacagagtgggcgtgtttggcttcctgagcagcggcagcggggaggtgtctggcaactggggcctgctggaccaggtggccgccctgacctgggtgcagacccacatccggggctttggaggagacccccggcgggtgtccctggccgctgacagaggaggagcagatgtggccagcatccacctgctgacagcccgggccaccaacagccagctgttccggcgggctgtgctgatgggcggcagcgccctgagccctgctgctgtgatcagccatgagcgggcccagcagcaggccatcgccctggccaaggaggtgtcctgccccatgagcagcagccaggaggtggtgtcctgcctgcggcagaagccagccaacgtgctgaatgatgcccagaccaagctgctggccgtgtctggccccttccactactggggccctgtgattgatggccacttcctgcgggagcccccagcccgggccctgaagaggagcctgtgggtggaggtggacctgctgattggcagcagccaggatgatggcctcatcaacagagccaaggctgtgaagcagtttgaggagagccggggccgcaccagcagcaagacagccttctaccaggccctgcagaacagcctgggcggggaggacagtgatgcccgggtggaggccgccgccacctggtactacagcctggagcacagcacagatgattatgccagcttcagccgggccctggagaatgccacccgggactacttcatcatctgccccatcatcgacatggccagcgcctgggccaagagggcccggggaaatgtgttcatgtaccacgccccagaaaattatggccacggcagcctggagctgctggctgatgtgcagtttgccctgggcctgcccttctacccagcctatgagggccagttcagcctggaggagaagagcctgagcctgaagatcatgcagtacttcagccacttcatccgcagcggcaaccccaactacccctatgagttcagcaggaaggtgcccacctttgccaccccctggccagactttgtgcccagggctggaggagagaactacaaggagttcagcgagctgctgcccaaccggcagggcctgaagaaggctgactgcagcttctggagcaagtacatcagcagcctgaagaccagcgcagatggagccaagggcggccagagcgctgagagcgaggaggaggagctgacagctggcagcggcctgcgggaggacctgctgagcctgcaggagcccggcagcaagacctacagcaagtag

SEQ ID NO: 173259 - DNA, 4725 bp, Artificial Sequence
  Description of Artificial Sequence: Synthetic coding sequence
atccccaggaagcccatcagcaagaggcctgtgcggcccagcctgcccaggagcccccgctgccccctgcccttcaatgccagcgaggtggtgggcggcaccatcctgtgtgagaccatcagcggccccaccggcagcgccatgcagcagtgccagctgctgtgccggcagggctcctggagcgtcttccccccaggccccctcatctgcagcctggagagcggccgctgggagagccagctgccccagccccgggcctgccagaggccccagctgtggcagaccatccagacccagggccacttccagctgcagctgcccccaggcaagatgtgcagcgctgactatgctgacctgctgcagaccttccaggtgttcatcctggatgagctgacagcccggggcttctgccagatccaggtgaagaccttcggcaccctggtgtccatccctgtgtgcaacaacagctctgtgcaggtgggctgcctgacccgggagcggctgggcgtgaatgtgacctggaagagccggctggaggacatccctgtggccagcctgcctgacctgcatgacatcgagcgggccctggtgggcaaggacctgctgggccgcttcacagacctgatccagagcggcagcttccagctgcacctggacagcaagaccttccctgctgagaccatccgcttcctgcagggcgaccacttcggcaccagccccaggacctggtttggctgcagcgagggcttctaccaggtgctgaccagcgaggccagccaggacggcctgggctgtgtgaagtgcccagagggcagctacagccaggatgaggagtgcatcccctgccctgtgggcttctaccaggagcaggccggcagcctggcctgtgtgccctgccctgtgggccgcaccaccatctctgctggggccttcagccagacccactgtgtgacagactgccagagaaatgaagctggcctgcagtgtgaccagaatggccagtaccgggccagccagaaggaccggggcagcggcaaggccttctgtgtggatggagagggccgccgcctgccctggtgggagacagaggcccccctggaggacagccagtgcctgatgatgcagaagtttgagaaggtgcctgagagcaaggtgatctttgatgccaatgcccctgtggccgtgcgcagcaaggtgcctgacagcgagttccctgtgatgcagtgcctgacagactgcacagaagatgaggcctgcagcttcttcaccgtgtccaccacagagcctgagatcagctgtgacttctacgcctggaccagtgacaacgtggcctgcatgaccagtgaccagaagagagatgccctgggcaacagcaaggccaccagctttggcagcctgcgctgccaggtgaaggtgcgcagccacggccaggacagccctgctgtgtacctgaagaagggccagggcagcaccaccaccctgcagaagagatttgagcccaccggcttccagaacatgctgagcggcctgtacaaccccatcgtgttttctgccagcggggccaacctgacagatgcccacctgttctgcctgctggcctgtgaccgggacctgtgctgtgatggctttgtgctgacccaggtgcagggcggggccatcatctgtggcctgctgagcagccccagcgtgctgctgtgcaatgtgaaggactggatggaccccagcgaggcctgggccaatgccacctgccctggggtgacctatgaccaggagagccaccaggtgatcctgcggctgggggaccaggagttcatcaagagcctgacccccctggagggcacccaggacaccttcaccaacttccagcaggtgtacctgtggaaggacagcgacatgggcagcaggcctgagagcatgggctgcaggaaggacacagtgcccaggcctgccagccccacagaagctggcctgaccacagagctgttcagccctgtggacctgaaccaggtgattgtgaatggaaaccagagcctgagcagccagaagcactggctgttcaagcacctgttcagcgcccagcaggccaacctgtggtgcctgagccgctgtgtgcaggagcacagcttctgccagctggccgagatcacagagagcgccagcctgtacttcacctgcaccctgtacccagaggcccaggtgtgtgatgacatcatggagagcaatgcccagggctgccgcctcatcctgccccagatgcccaaggccctcttcaggaagaaggtgatcctggaggacaaggtgaagaacttctacacccggctgcccttccagaagctgatgggcatcagcatccggaacaaggtgcccatgtctgagaagagcatcagcaatggcttctttgaatgtgagcggcgctgtgatgctgacccctgctgcaccggcttcggcttcctgaatgtgtcccagctgaagggcggggaggtgacctgcctgaccctgaacagcctgggcatccagatgtgcagcgaggagaatggaggagcctggaggatcctggactgtggcagcccagacatcgaggtgcacacctaccccttcggctggtaccagaagcccatcgcccagaacaatgcccccagcttctgccccctggtggtgctgcccagcctgacagagaaggtgtccctggacagctggcagagcctggccctgagctctgtggtggtggaccccagcatccgccactttgatgtggcccacgtgtccacagctgccaccagcaacttctctgctgtgcgggacctgtgcctgtctgaatgttcccagcacgaggcctgcctgatcaccaccctgcagacccagcctggagctgtgcgctgcatgttttatgctgacacccagagctgcacccacagcctgcagggccagaactgccgcctgctgctgcgggaggaggccacccacatctacaggaagccaggcatcagcctgctgtcctatgaggcctctgtgcccagcgtgcccatcagcacccacggccgcctgctgggccgcagccaggccatccaggtgggcacctcctggaagcaggtggaccagttcctgggcgtgccctatgctgccccacccctggccgagcggcgcttccaggcccctgagcccctgaactggacaggctcctgggatgccagcaagccccgggccagctgctggcagcccggcaccaggaccagcaccagccctggggtgtctgaggactgcctgtacctgaatgtgttcatcccccagaatgtggccccaaatgcctctgtgctggtgttcttccacaacaccatggaccgggaggagagcgagggctggccagccattgatggcagcttcctggccgctgtgggcaacctgattgtggtgacagccagctacagagtgggcgtgtttggcttcctgagcagcggcagcggggaggtgtctggcaactggggcctgctggaccaggtggccgccctgacctgggtgcagacccacatccggggctttggaggagacccccggcgggtgtccctggccgctgacagaggaggagcagatgtggccagcatccacctgctgacagcccgggccaccaacagccagctgttccggcgggctgtgctgatgggcggcagcgccctgagccctgctgctgtgatcagccatgagcgggcccagcagcaggccatcgccctggccaaggaggtgtcctgccccatgagcagcagccaggaggtggtgtcctgcctgcggcagaagccagccaacgtgctgaatgatgcccagaccaagctgctggccgtgtctggccccttccactactggggccctgtgattgatggccacttcctgcgggagcccccagcccgggccctgaagaggagcctgtgggtggaggtggacctgctgattggcagcagccaggatgatggcctcatcaacagagccaaggctgtgaagcagtttgaggagagccggggccgcaccagcagcaagacagccttctaccaggccctgcagaacagcctgggcggggaggacagtgatgcccgggtggaggccgccgccacctggtactacagcctggagcacagcacagatgattatgccagcttcagccgggccctggagaatgccacccgggactacttcatcatctgccccatcatcgacatggccagcgcctgggccaagagggcccggggaaatgtgttcatgtaccacgccccagaaaattatggccacggcagcctggagctgctggctgatgtgcagtttgccctgggcctgcccttctacccagcctatgagggccagttcagcctggaggagaagagcctgagcctgaagatcatgcagtacttcagccacttcatccgcagcggcaaccccaactacccctatgagttcagcaggaaggtgcccacctttgccaccccctggccagactttgtgcccagggctggaggagagaactacaaggagttcagcgagctgctgcccaaccggcagggcctgaagaaggctgactgcagcttctggagcaagtacatcagcagcctgaagaccagcgcagatggagccaagggcggccagagcgctgagagcgaggaggaggagctgacagctggcagcggcctgcgggaggacctgctgagcctgcaggagcccggcagcaagacctacagcaagtag

SEQ ID NO: 173260 - DNA, 1356 bp, Artificial Sequence
  Description of Artificial Sequence: Synthetic coding sequence
atggagcagaagcccagcaaggtggagtgtggcagtgaccctgaggagaacagcgcccggagcccagatggcaagaggaagaggaagaatggccagtgcagcctgaagacctccatgagcggctacatccccagctacctggacaaggatgagcagtgtgtggtgtgtggggacaaggccaccggctaccactaccgctgcatcacctgtgagggctgcaagggcttcttccggaggaccatccagaagaacctgcaccccacctacagctgcaagtatgacagctgctgcgtgattgacaagatcaccaggaaccagtgccagctgtgccgcttcaagaagtgcatcgctgtgggcatggccatggacctggtgctggatgacagcaagagggtggccaagaggaagctgattgagcagaaccgggagaggaggaggaaggaggagatgatccgcagcctgcagcagaggcctgagcccaccccagaggagtgggacctgatccacatcgccacagaggcccacaggagcaccaatgcccagggcagccactggaagcagaggaggaagttcctgcctgatgacatcggccagagccccatcgtgtccatgccagatggagacaaggtggacctggaggccttcagcgagttcaccaagatcatcaccccagccatcaccagggtggtggactttgccaagaagctgcccatgttcagcgagctgccctgtgaggaccagatcatcctgctgaagggctgctgcatggagatcatgagcctgcgggctgctgtgcgctatgaccctgagagtgacaccctgaccctgtctggagagatggctgtgaagcgggagcagctgaagaatggaggcctgggcgtggtgtctgatgccatctttgagctgggcaagagcctgagcgccttcaacctggatgacacagaggtggccctgctgcaggccgtgctgctgatgagcacagacaggagcggcctgctgtgtgtggacaagattgagaagagccaggaggcctacctgctggcctttgagcactacgtgaaccacaggaagcacaacatcccccacttctggcccaagctgctgatgaagggcccccaggtgcggcagctggagcagcagctgggggaggccggcagcctgcagggccctgtgctgcagcaccagagccccaagagcccccagcagaggctgctggagctgctgcacaggagcggcatcctgcacgcccgggctgtgtgtggggaggatgacagcagcgaggccgacagccccagcagcagcgaggaggagcctgaggtgtgtgaggacctggccggaaatgctgccagcccctag

SEQ ID NO: 173261 - DNA, 5940 bp, Artificial Sequence
  Description of Artificial Sequence: Synthetic coding sequence
atgagctcctggctgggcggcctgggcagcggcctgggccagagcctgggccaggtgggcggcagcctggccagcctgaccggccagatcagcaacttcaccaaggacatgctgatggagggcacagaggaggtggaggccgagctgcctgacagcaggaccaaggagattgaggccatccacgccatcctgcggagtgaaaatgaaaggctgaagaagctgtgcacagacctggaggagaagcatgaggccagcgagatccagatcaagcagcagagcaccagctacagaaaccagctgcagcagaaggaggtggagatcagccacctgaaggcccggcagatcgccctgcaggaccagctgctgaagctgcagagcgctgcccagagcgtgcccagcggggccggcgtgcctgccaccacagccagcagcagctttgcctacggcatcagccaccaccccagcgccttccatgatgatgacatggactttggagacatcatcagcagccagcaggagatcaaccggctgagcaatgaggtgtcccggctggagagcgaggtgggccactggaggcacatcgcccagaccagcaaggcccagggcacagacaacagcgaccagagcgagatctgcaagctgcagaacatcatcaaggagctgaagcagaacagaagccaggagattgatgaccaccagcacgagatgtctgtgctgcagaatgcccaccagcagaagctgacagagatcagccgccgccaccgggaggagctgagtgactatgaggagagaattgaggagctggagaacctgctgcagcagggcggcagcggggtcatcgagacagacctgagcaagatctatgagatgcagaagaccatccaggtgctgcagatcgagaaggtggagagcaccaagaagatggagcagctggaggacaagatcaaggacatcaacaagaagctgagcagcgcagaaaatgaccgggacatcctgcggcgggagcaggagcagctgaatgtggagaagaggcagatcatggaggagtgtgagaacctgaagctggagtgcagcaagctgcagcccagcgctgtgaagcagagcgacaccatgacagagaaggagcgcatcctggcccagagcgcctctgtggaggaggtgttccggctgcagcaggccctgagtgatgctgaaaatgagatcatgaggctgagcagcctgaaccaggacaacagcctggccgaggacaacctgaagctgaagatgagaattgaggtgctggagaaggagaagagcctgctgagccaggagaaggaggagctgcagatgagcctgctgaagctgaacaatgaatatgaggtgatcaagagcacagccacccgggacatcagcctggacagcgagctgcatgacctgcggctgaacctggaggccaaggagcaggagctgaaccagagcatcagcgagaaggagaccctgattgctgagattgaggagctggaccggcagaaccaggaggccaccaagcacatgatcctgatcaaggaccagctgagcaagcagcagaatgaaggagacagcatcatcagcaagctgaagcaggacctgaatgatgagaagaagagggtgcaccagctggaggatgacaagatggacatcaccaaggagctggatgtgcagaaggagaagctgatccagagcgaggtggccctgaatgacctgcacctgaccaagcagaagctggaggacaaggtggagaacctggtggaccagctgaacaagagccaggagagcaatgtgtccatccagaaggagaacctggagctgaaggagcacatccggcagaatgaggaggagctgagccgcatcagaaatgagctgatgcagagcctgaaccaggacagcaacagcaacttcaaggacaccctgctgaaggagcgggaggccgaggtgaggaacctgaagcagaacctgtctgagctggagcagctgaatgaaaacctgaagaaggtggcctttgatgtgaagatggagaatgagaagctggtgctggcctgtgaagatgtgcgccaccagctggaggagtgcctggccggcaacaaccagctgagcctggagaagaacaccatcgtggagaccctgaagatggagaagggggagattgaagctgagctgtgctgggccaagaagaggctgctggaggaggccaacaagtatgagaagaccatcgaggagctgagcaatgccaggaacctgaacaccagcgccctgcagctggagcacgagcacctgatcaagctgaaccagaagaaggacatggagattgctgagctgaagaagaacatcgagcagatggacacagaccacaaggagaccaaggatgtgctgagcagcagcctggaggagcagaagcagctgacccagctgatcaacaagaaggagatcttcatcgagaagctgaaggagaggagcagcaagctgcaggaggagctggacaagtacagccaggccctgaggaagaatgagatcctgcggcagaccatcgaggagaaggacaggagcctgggctccatgaaggaggagaacaaccacctgcaggaggagctggagcggctgcgggaggagcagagcaggacagcccctgtggccgaccccaagaccctggacagcgtgacagagctggccagcgaggtgtcccagctgaacaccatcaaggagcacctggaggaggagatcaagcaccaccagaagatcatcgaggaccagaaccagagcaagatgcagctgctgcagagcctgcaggagcagaagaaggagatggatgagttccgctaccagcacgagcagatgaatgccacccacacccagctgttcctggagaaggatgaggagatcaagagcctgcagaagaccatcgagcagatcaagacccagctgcacgaggagcggcaggacatccagacagacaacagcgacatcttccaggagaccaaggtgcagagcctgaacattgaaaatggcagcgagaagcatgacctgagcaaggccgagacagagcggctggtgaagggcatcaaggagcgggagctggagatcaagctgctgaatgagaagaacatcagcctgaccaagcagattgaccagctgagcaaggatgaggtgggcaagctgacccagatcatccagcagaaggacctggagatccaggccctgcacgcccgcatcagcagcaccagccacacccaggatgtggtgtacctgcagcagcagctgcaggcctatgccatggagcgggagaaggtgtttgctgtgctgaatgagaagacccgggagaacagccacctgaagacagagtaccacaagatgatggacatcgtggccgccaaggaggccgccctgatcaagctgcaggatgagaacaagaagctgagcaccaggtttgagagcagcggccaggacatgttccgggagaccatccagaacctgagccgcatcatccgggagaaggacattgaaattgatgccctgagccagaagtgccagaccctgctggccgtgctgcagaccagcagcactggaaatgaggccggcggcgtgaacagcaaccagtttgaggagctgctgcaggagcgggacaagctgaagcagcaggtgaagaagatggaggagtggaagcagcaggtgatgaccaccgtgcagaacatgcagcatgaaagtgcccagctgcaggaggagctgcaccagctgcaggcccaggtgctggtggacagcgacaacaacagcaagctgcaggtggactacacaggcctcatccagagctatgagcagaatgagaccaagctgaagaactttggccaggagctggcccaggtgcagcacagcatcggccagctgtgcaacaccaaggacctgctgctgggcaagctggacatcatcagcccccagctgagcagcgccagcctgctgaccccccagagcgctgagtgcctgcgggccagcaagtctgaggtgctgtctgagagcagcgagctgctgcagcaggagctggaggagctgaggaagagcctgcaggagaaggatgccaccatccgcaccctgcaggagaacaaccaccggctgagtgacagcattgctgccaccagcgagctggagaggaaggagcacgagcagacagattctgagatcaagcagctgaaggagaagcaggatgtgctgcagaagctgctgaaggagaaggacctgctgatcaaggccaagagtgaccagctgctgagcagcaatgaaaacttcaccaacaaggtgaatgaaaatgagctgctgcggcaggccgtgaccaacctgaaggagcgcatcctgatcctggagatggacatcggcaagctgaagggggagaatgagaagatcgtggagacctaccggggcaaggagacagagtaccaggccctgcaggagaccaacatgaagttctccatgatgctgcgggagaaggagtttgagtgccacagcatgaaggagaaggccctggcctttgagcagctgctgaaggagaaggagcagggcaagacaggagagctgaaccagctgctgaatgctgtgaagtccatgcaggagaagacagtggtgttccagcaggagcgggaccaggtgatgctggccctgaagcagaagcagatggagaacacagccctgcagaatgaggtgcagaggctgcgggacaaggagttccgcagcaaccaggagctggagcggctgaggaaccacctgctggagagcgaggacagctacacccgggaggccctggccgcagaagatcgggaggccaagctgaggaagaaggtgacagtgctggaggagaagctggtgagcagcagcaatgccatggagaatgccagccaccaggcctctgtgcaggtggagagcctgcaggagcagctgaatgtggtgtccaagcagagagatgaaacagccctgcagctgtctgtgtcccaggagcaggtgaagcagtatgccctgagcctggccaacctgcagatggtgctggagcacttccagcaggaggagaaggccatgtacagcgctgagctggagaagcagaagcagctgattgctgagtggaagaagaatgctgagaacctggagggcaaggtgatcagcctgcaggagtgcctggatgaggccaatgctgccctggacagcgccagccggctgacagagcagctggatgtgaaggaggagcagatcgaggagctgaagaggcagaatgagctgcggcaggagatgctggatgatgtgcagaagaagctgatgagcctggccaacagcagcgagggcaaggtggacaaggtgctgatgaggaacctcttcatcggccacttccacacccccaagaaccagagacatgaggtgctgcggctgatgggcagcatcctgggcgtgagaagagaggagatggagcagctgttccatgatgaccagggcggcgtgacccgctggatgacaggctggctgggcggcggcagcaagtctgtgcccaacacccccctgcggcccaaccagcagagcgtggtgaacagcagcttcagcgagctgtttgtgaagttcctggagacagagagccaccccagcatccccccacccaagctgtctgtgcatgacatgaagcccctggacagccctggccgcaggaagagggacaccaatgcccctgagagcttcaaggacacagctgagagccgctctggaagaagaacagatgtgaaccccttcctggcccccaggtctgctgctgtgcccctcatcaacccagctggcctgggccctgggggccctggccacctgctgctgaagcccatcagtgatgtgctgcccaccttcacccccctgcctgccctgcctgacaacagcgctggggtggtgctgaaggacctgctgaagcagtag

SEQ ID NO: 173262 - DNA, 5148 bp, Artificial Sequence
  Description of Artificial Sequence: Synthetic coding sequence
atgtctgtgctgcagaatgcccaccagcagaagctgacagagatcagcagaagacaccgggaggagctgagtgactatgaggagcgcatcgaggagctggagaacctgctgcagcagggcggcagcggcgtgattgaaacagacctgagcaagatctatgagatgcagaagaccatccaggtgctgcagatcgagaaggtggagagcaccaagaagatggagcagctggaggacaagatcaaggacatcaacaagaagctgagcagcgcagaaaatgaccgggacatcctgcggcgggagcaggagcagctgaatgtggagaagaggcagatcatggaggagtgtgagaacctgaagctggagtgcagcaagctgcagcccagcgctgtgaagcagagcgacaccatgacagagaaggagcgcatcctggcccagagcgcctctgtggaggaggtgttccggctgcagcaggccctgagtgatgctgaaaatgagatcatgaggctgagcagcctgaaccaggaggagctgcagatgagcctgctgaagctgaacaatgaatatgaggtgatcaagagcacagccacccgggacatcagcctggacagcgagctgcatgacctgcggctgaacctggaggccaaggagcaggagctgaaccagagcatcagcgagaaggagaccctgattgctgagattgaggagctggaccggcagaaccaggaggccaccaagcacatgatcctgatcaaggaccagctgagcaagcagcagaatgaaggagacagcatcatcagcaagctgaagcaggacctgaatgatgagaagaagagggtgcaccagctggaggatgacaagatggacatcaccaaggagctggatgtgcagaaggagaagctgatccagagcgaggtggccctgaatgacctgcacctgaccaagcagaagctggaggacaaggtggagaacctggtggaccagctgaacaagagccaggagagcaatgtgtccatccagaaggagaacctggagctgaaggagcacatccggcagaatgaggaggagctgagccgcatcagaaatgagctgatgcagagcctgaaccaggacagcaacagcaacttcaaggacaccctgctgaaggagcgggaggccgaggtgaggaacctgaagcagaacctgtctgagctggagcagctgaatgaaaacctgaagaaggtggcctttgatgtgaagatggagaatgagaagctggtgctggcctgtgaagatgtgcgccaccagctggaggagtgcctggccggcaacaaccagctgagcctggagaagaacaccatcgtggagaccctgaagatggagaagggggagattgaagctgagctgtgctgggccaagaagaggctgctggaggaggccaacaagtatgagaagaccatcgaggagctgagcaatgccaggaacctgaacaccagcgccctgcagctggagcacgagcacctgatcaagctgaaccagaagaaggacatggagattgctgagctgaagaagaacatcgagcagatggacacagaccacaaggagaccaaggatgtgctgagcagcagcctggaggagcagaagcagctgacccagctgatcaacaagaaggagatcttcatcgagaagctgaaggagaggagcagcaagctgcaggaggagctggacaagtacagccaggccctgaggaagaatgagatcctgcggcagaccatcgaggagaaggacaggagcctgggctccatgaaggaggagaacaaccacctgcaggaggagctggagcggctgcgggaggagcagagcaggacagcccctgtggccgaccccaagaccctggacagcgtgacagagctggccagcgaggtgtcccagctgaacaccatcaaggagcacctggaggaggagatcaagcaccaccagaagatcatcgaggaccagaaccagagcaagatgcagctgctgcagagcctgcaggagcagaagaaggagatggatgagttccgctaccagcacgagcagatgaatgccacccacacccagctgttcctggagaaggatgaggagatcaagagcctgcagaagaccatcgagcagatcaagacccagctgcacgaggagcggcaggacatccagacagacaacagcgacatcttccaggagaccaaggtgcagagcctgaacattgaaaatggcagcgagaagcatgacctgagcaaggccgagacagagcggctggtgaagggcatcaaggagcgggagctggagatcaagctgctgaatgagaagaacatcagcctgaccaagcagattgaccagctgagcaaggatgaggtgggcaagctgacccagatcatccagcagaaggacctggagatccaggccctgcacgcccgcatcagcagcaccagccacacccaggatgtggtgtacctgcagcagcagctgcaggcctatgccatggagcgggagaaggtgtttgctgtgctgaatgagaagacccgggagaacagccacctgaagacagagtaccacaagatgatggacatcgtggccgccaaggaggccgccctgatcaagctgcaggatgagaacaagaagctgagcaccaggtttgagagcagcggccaggacatgttccgggagaccatccagaacctgagccgcatcatccgggagaaggacattgaaattgatgccctgagccagaagtgccagaccctgctggccgtgctgcagaccagcagcactggaaatgaggccggcggcgtgaacagcaaccagtttgaggagctgctgcaggagcgggacaagctgaagcagcaggtgaagaagatggaggagtggaagcagcaggtgatgaccaccgtgcagaacatgcagcatgaaagtgcccagctgcaggaggagctgcaccagctgcaggcccaggtgctggtggacagcgacaacaacagcaagctgcaggtggactacacaggcctcatccagagctatgagcagaatgagaccaagctgaagaactttggccaggagctggcccaggtgcagcacagcatcggccagctgtgcaacaccaaggacctgctgctgggcaagctggacatcatcagcccccagctgagcagcgccagcctgctgaccccccagagcgctgagtgcctgcgggccagcaagtctgaggtgctgtctgagagcagcgagctgctgcagcaggagctggaggagctgaggaagagcctgcaggagaaggatgccaccatccgcaccctgcaggagaacaaccaccggctgagtgacagcattgctgccaccagcgagctggagaggaaggagcacgagcagacagattctgagatcaagcagctgaaggagaagcaggatgtgctgcagaagctgctgaaggagaaggacctgctgatcaaggccaagagtgaccagctgctgagcagcaatgaaaacttcaccaacaaggtgaatgaaaatgagctgctgcggcaggccgtgaccaacctgaaggagcgcatcctgatcctggagatggacatcggcaagctgaagggggagaatgagaagatcgtggagacctaccggggcaaggagacagagtaccaggccctgcaggagaccaacatgaagttctccatgatgctgcgggagaaggagtttgagtgccacagcatgaaggagaaggccctggcctttgagcagctgctgaaggagaaggagcagggcaagacaggagagctgaaccagctgctgaatgctgtgaagtccatgcaggagaagacagtggtgttccagcaggagcgggaccaggtgatgctggccctgaagcagaagcagatggagaacacagccctgcagaatgaggtgcagaggctgcgggacaaggagttccgcagcaaccaggagctggagcggctgaggaaccacctgctggagagcgaggacagctacacccgggaggccctggccgcagaagatcgggaggccaagctgaggaagaaggtgacagtgctggaggagaagctggtgagcagcagcaatgccatggagaatgccagccaccaggcctctgtgcaggtggagagcctgcaggagcagctgaatgtggtgtccaagcagagagatgaaacagccctgcagctgtctgtgtcccaggagcaggtgaagcagtatgccctgagcctggccaacctgcagatggtgctggagcacttccagcaggaggagaaggccatgtacagcgctgagctggagaagcagaagcagctgattgctgagtggaagaagaatgctgagaacctggagggcaaggtgatcagcctgcaggagtgcctggatgaggccaatgctgccctggacagcgccagccggctgacagagcagctggatgtgaaggaggagcagatcgaggagctgaagaggcagaatgagctgcggcaggagatgctggatgatgtgcagaagaagctgatgagcctggccaacagcagcgagggcaaggtggacaaggtgctgatgaggaacctcttcatcggccacttccacacccccaagaaccagagacatgaggtgctgcggctgatgggcagcatcctgggcgtgagaagagaggagatggagcagctgttccatgatgaccagggcggcgtgacccgctggatgacaggctggctgggcggcggcagcaagtctgtgcccaacacccccctgcggcccaaccagcagagcgtggtgaacagcagcttcagcgagctgtttgtgaagttcctggagacagagagccaccccagcatccccccacccaagctgtctgtgcatgacatgaagcccctggacagccctggccgcaggaagagggacaccaatgcccctgagagcttcaaggacacagctgagagccgctctggaagaagaacagatgtgaaccccttcctggcccccaggtctgctgctgtgcccctcatcaacccagctggcctgggccctgggggccctggccacctgctgctgaagcccatcagtgatgtgctgcccaccttcacccccctgcctgccctgcctgacaacagcgctggggtggtgctgaaggacctgctgaagcagtag

SEQ ID NO: 173263 - DNA, 5979 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagagagccccagcgagaccaacaagccccacagcaagagcaagaagaggcacctggaccaggagcagcagctgaagagcgcccagagccccagcaccagcaaggcccacaccaggaagagcggggccactggaggcagccgcagccagaagaggaagaggacagagagcagctgtgtgaagagcggcagcggcagcgagagcactggagctgaggagaggtctgccaagcccaccaagctggccagcaagagcgccaccagcgccaaggccggctgcagcaccatcacagacagcagcagcgctgccagcaccagcagcagcagcagcgctgtggccagcgccagcagcacagtgcccccaggggcccgggtgaagcagggcaaggaccagaacaaggcccggcgcagccgcagcgccagcagccccagccccaggaggagcagccgggagaaggagcagagcaagacaggaggcagcagcaagtttgactgggccgcccgcttcagccccaaggtgtccctgcccaagaccaagctgagcctgcccggcagcagcaagtctgagaccagcaagccaggccccagcggcctgcaggccaagctggccagcctgaggaagagcaccaagaagaggtctgagagccccccagctgagctgcccagcctgcggcgcagcacccggcagaagaccaccggcagctgtgccagcaccagcagaagaggcagcggcctgggcaagagaggagctgctgaggcccggcggcaggagaagatggctgaccctgagagcaaccaggaggccgtgaacagcagcgctgccaggacagatgaggccccccagggcgctgctggagctgtgggcatgaccaccagcggggagagcgagagtgatgattctgagatgggccgcctgcaggccctgctggaggcccggggcctgcccccccacctgtttggccccctgggccccaggatgagccagctgttccacaggaccatcggcagcggggccagcagcaaggcccagcagctgctgcagggcctgcaggccagtgatgagagccagcagctgcaggccgtgattgagatgtgccagctgctggtgatgggaaatgaggagaccctgggcggcttccctgtgaagtctgtggtgcctgccctgatcaccctgctgcagatggagcacaactttgacatcatgaaccacgcctgccgggccctgacctacatgatggaggccctgcccaggagcagcgctgtggtggtggatgccatccctgtgttcctggagaagctgcaggtgatccagtgcattgatgtggccgagcaggccctgacagccctggagatgctgagcagaagacacagcaaggccatcctgcaggccggcggcctggccgactgcctgctgtacctggagttcttcagcatcaatgcccagagaaatgccctggccatcgccgccaactgctgccagagcatcaccccagatgagttccactttgtggccgacagcctgcccctgctgacccagaggctgacccaccaggacaagaagtctgtggagagcacctgcctgtgctttgcccggctggtggacaacttccagcacgaggagaacctgctgcagcaggtggccagcaaggacctgctgaccaacgtgcagcagctgctggtggtgaccccacccatcctgagcagcggcatgttcatcatggtggtgaggatgttcagcctgatgtgcagcaactgccccaccctggccgtgcagctgatgaagcagaacattgctgagaccctgcacttcctgctgtgtggggccagcaatggcagctgccaggagcagattgacctggtgcccaggagcccccaggagctgtatgagctgaccagcctcatctgtgagctgatgccctgcctgcccaaggagggcatctttgctgtggacaccatgctgaagaagggaaatgcccagaacacagatggagccatctggcagtggagagatgaccggggcctgtggcacccctacaacagaattgacagccgcatcatcgagcagatcaatgaagacaccggcacagcccgggccatccagaggaagcccaaccccctggccaacagcaacaccagcggctacagcgagagcaagaaggatgatgcccgggcccagctgatgaaggaggaccctgagctggccaagagcttcatcaagaccctgtttggagtgctgtatgaggtgtacagcagcagcgctggccctgctgtgcgccacaagtgcctgcgggccatcctgcgcatcatctactttgctgatgctgagctgctgaaggatgtgctgaagaaccacgctgtgagcagccacatcgcctccatgctgagcagccaggacctgaagatcgtggtgggcgccctgcagatggccgagatcctgatgcagaagctgcctgacatcttctctgtgtacttccggcgggagggcgtgatgcaccaggtgaagcacctggccgagagcgagagcctgctgaccagcccccccaaggcctgcaccaatggaagtggctccatgggcagcaccacctctgtgagcagcggcacagccacagctgccacccatgctgctgctgacctgggcagccccagcctgcagcacagcagagatgacagcctggacctgagcccccagggccgcctgagtgatgtgctgaagaggaagaggctgcccaagaggggcccccggcggcccaagtacagccccccaagagatgatgacaaggtggacaaccaggccaagagccccaccaccacccagagccccaagagcagcttcctggccagcctgaaccccaagacctggggccgcctgagcacccagagcaacagcaacaacatcgagcccgccaggacagctgggggcagcggcctggcccgggccgccagcaaggacaccatcagcaacaaccgggagaagatcaagggctggatcaaggagcaggcccacaagtttgtggagcgctacttcagcagcgagaacatggatggcagcaacccagccctgaatgtgctgcagaggctgtgtgccgccacagagcagctgaacctgcaggtggatggaggagcagaatgtctggtggagatccgcagcatcgtgtctgagagtgatgtgtcctcctttgagatccagcacagcggctttgtgaagcagctgctgctgtacctgaccagcaagtctgagaaggatgctgtgtcccgggagatccggctgaagcgcttcctgcacgtgttcttcagcagccccctgcctggagaggagcccatcggccgggtggagcctgtgggcaatgcccccctgctggccctggtgcacaagatgaacaactgcctgagccagatggagcagtttcctgtgaaggtgcatgacttccccagcggaaatggaactggaggcagcttcagcctgaacagaggcagccaggccctgaagttcttcaacacccaccagctgaagtgccagctgcagaggcacccagactgtgccaacgtgaagcagtggaagggcggccctgtgaagattgaccccctggccctggtgcaggccatcgagcgctacctggtggtgcggggctacggccgggtgcgggaggatgatgaagattctgatgatgatggcagtgatgaggagattgatgagagcctggccgcccagttcctgaacagcggaaatgtgcgccaccggctgcagttctacatcggggagcacctgctgccctacaacatgacagtgtaccaggccgtgcggcagttcagcatccaggctgaagatgagcgggagagcacagatgatgagagcaaccccctgggccgggccggcatctggaccaagacccacaccatctggtacaagcctgtgagagaagatgaggagagcaacaaggactgtgtgggcggcaagaggggccgggcccagacagcccccaccaagaccagccccagaaatgccaagaagcatgatgagctgtggcatgatggagtgtgccccagcgtgagcaaccccctggaggtgtacctgatccccaccccacctgagaacatcacctttgaggaccccagcctggatgtgatcctgctgctgcgggtgctgcacgccatcagccgctactggtactacctgtatgacaatgccatgtgcaaggagatcatccccaccagcgagttcatcaacagcaagctgacagccaaggccaaccggcagctgcaggaccccctggtgatcatgacaggcaacatccccacctggctgacagagctgggcaagacctgccccttcttcttcccctttgacacccggcagatgctgttctacgtgacagcctttgaccgggaccgggccatgcagaggctgctggacaccaaccctgagatcaaccagagcgacagccaggacagccgggtggccccccggctggacaggaagaagaggacagtgaaccgggaggagctgctgaagcaggccgagagcgtgatgcaggacctgggcagcagccgggccatgctggagatccagtatgaaaatgaggtgggcaccggcctgggccccaccctggagttctacgccctggtgtcccaggagctgcagagagctgacctgggcctgtggagaggagaggaggtgaccctgagcaaccccaagggcagccaggagggcaccaagtacatccagaacctgcagggcctgtttgccctgccctttggaagaacagccaagccagcccacatcgccaaggtgaagatgaagttccgcttcctgggcaagctgatggccaaggccatcatggacttccggctggtggacctgcccctgggcctgcccttctacaagtggatgctgcggcaggagaccagcctgaccagccatgacctgtttgatattgatcctgtggtggcccggtctgtgtaccacctggaggacatcgtgcggcagaagaagaggctggagcaggacaagagccagaccaaggagagcctgcagtatgccctggagaccctgaccatgaatggctgcagcgtggaggacctgggcctggacttcaccctgcccggcttccccaacatcgagctgaagaagggcggcaaggacatccctgtgaccatccacaacctggaggagtacctgcggctggtgatcttctgggccctgaatgaaggagtgtcccggcagtttgacagcttcagagatggctttgaatctgtgttccccctgagccacctgcagtacttctacccagaggagctggaccagctgctgtgtggcagcaaggctgacacctgggatgccaagaccctgatggagtgctgcaggccagaccacggctacacccatgacagcagagctgtgaagttcctgtttgagatcctgagcagctttgacaatgagcagcagaggctcttcctgcagtttgtgacaggcagcccccggctgcctgtgggcggcttccgcagcctgaacccccccctgaccatcgtgaggaagacctttgagagcacagaaaatccagatgacttcctgcccagcgtgatgacctgtgtgaactacctgaagctgcctgactacagcagcattgagatcatgagggagaagctgctgattgctgcccgggagggccagcagagcttccacctgtcctag

SEQ ID NO: 173264 - DNA, 300 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagaatag

SEQ ID NO: 173265 - DNA, 6123 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagccacctgggccaggccaagcacaagggctacagccccccagagagcaggaagagcaacagcaaggcccccaaggtgcagagcaacaccaccagcgagctgagccggggccacctgagcaagaggagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagagagccccagcgagaccaacaagccccacagcaagagcaagaagaggcacctggaccaggagcagcagctgaagagcgcccagagccccagcaccagcaaggcccacaccaggaagagcggggccactggaggcagccgcagccagaagaggaagaggacagagagcagctgtgtgaagagcggcagcggcagcgagagcactggagctgaggagaggtctgccaagcccaccaagctggccagcaagagcgccaccagcgccaaggccggctgcagcaccatcacagacagcagcagcgctgccagcaccagcagcagcagcagcgctgtggccagcgccagcagcacagtgcccccaggggcccgggtgaagcagggcaaggaccagaacaaggcccggcgcagccgcagcgccagcagccccagccccaggaggagcagccgggagaaggagcagagcaagacaggaggcagcagcaagtttgactgggccgcccgcttcagccccaaggtgtccctgcccaagaccaagctgagcctgcccggcagcagcaagtctgagaccagcaagccaggccccagcggcctgcaggccaagctggccagcctgaggaagagcaccaagaagaggtctgagagccccccagctgagctgcccagcctgcggcgcagcacccggcagaagaccaccggcagctgtgccagcaccagcagaagaggcagcggcctgggcaagagaggagctgctgaggcccggcggcaggagaagatggctgaccctgagagcaaccaggaggccgtgaacagcagcgctgccaggacagatgaggccccccagggcgctgctgccagcagctctgtggccggggctgtgggcatgaccaccagcggggagagcgagagtgatgattctgagatgggccgcctgcaggccctgctggaggcccggggcctgcccccccacctgtttggccccctgggccccaggatgagccagctgttccacaggaccatcggcagcggggccagcagcaaggcccagcagctgctgcagggcctgcaggccagtgatgagagccagcagctgcaggccgtgattgagatgtgccagctgctggtgatgggaaatgaggagaccctgggcggcttccctgtgaagtctgtggtgcctgccctgatcaccctgctgcagatggagcacaactttgacatcatgaaccacgcctgccgggccctgacctacatgatggaggccctgcccaggagcagcgctgtggtggtggatgccatccctgtgttcctggagaagctgcaggtgatccagtgcattgatgtggccgagcaggccctgacagccctggagatgctgagcagaagacacagcaaggccatcctgcaggccggcggcctggccgactgcctgctgtacctggagttcttcagcatcaatgcccagagaaatgccctggccatcgccgccaactgctgccagagcatcaccccagatgagttccactttgtggccgacagcctgcccctgctgacccagaggctgacccaccaggacaagaagtctgtggagagcacctgcctgtgctttgcccggctggtggacaacttccagcacgaggagaacctgctgcagcaggtggccagcaaggacctgctgaccaacgtgcagcagctgctggtggtgaccccacccatcctgagcagcggcatgttcatcatggtggtgaggatgttcagcctgatgtgcagcaactgccccaccctggccgtgcagctgatgaagcagaacattgctgagaccctgcacttcctgctgtgtggggccagcaatggcagctgccaggagcagattgacctggtgcccaggagcccccaggagctgtatgagctgaccagcctcatctgtgagctgatgccctgcctgcccaaggagggcatctttgctgtggacaccatgctgaagaagggaaatgcccagaacacagatggagccatctggcagtggagagatgaccggggcctgtggcacccctacaacagaattgacagccgcatcatcgagcagatcaatgaagacaccggcacagcccgggccatccagaggaagcccaaccccctggccaacagcaacaccagcggctacagcgagagcaagaaggatgatgcccgggcccagctgatgaaggaggaccctgagctggccaagagcttcatcaagaccctgtttggagtgctgtatgaggtgtacagcagcagcgctggccctgctgtgcgccacaagtgcctgcgggccatcctgcgcatcatctactttgctgatgctgagctgctgaaggatgtgctgaagaaccacgctgtgagcagccacatcgcctccatgctgagcagccaggacctgaagatcgtggtgggcgccctgcagatggccgagatcctgatgcagaagctgcctgacatcttctctgtgtacttccggcgggagggcgtgatgcaccaggtgaagcacctggccgagagcgagagcctgctgaccagcccccccaaggcctgcaccaatggaagtggctccatgggcagcaccacctctgtgagcagcggcacagccacagctgccacccatgctgctgctgacctgggcagccccagcctgcagcacagcagagatgacagcctggacctgagcccccagggccgcctgagtgatgtgctgaagaggaagaggctgcccaagaggggcccccggcggcccaagtacagccccccaagagatgatgacaaggtggacaaccaggccaagagccccaccaccacccagagccccaagagcagcttcctggccagcctgaaccccaagacctggggccgcctgagcacccagagcaacagcaacaacatcgagcccgccaggacagctgggggcagcggcctggcccgggccgccagcaaggacaccatcagcaacaaccgggagaagatcaagggctggatcaaggagcaggcccacaagtttgtggagcgctacttcagcagcgagaacatggatggcagcaacccagccctgaatgtgctgcagaggctgtgtgccgccacagagcagctgaacctgcaggtggatggaggagcagaatgtctggtggagatccgcagcatcgtgtctgagagtgatgtgtcctcctttgagatccagcacagcggctttgtgaagcagctgctgctgtacctgaccagcaagtctgagaaggatgctgtgtcccgggagatccggctgaagcgcttcctgcacgtgttcttcagcagccccctgcctggagaggagcccatcggccgggtggagcctgtgggcaatgcccccctgctggccctggtgcacaagatgaacaactgcctgagccagatggagcagtttcctgtgaaggtgcatgacttccccagcggaaatggaactggaggcagcttcagcctgaacagaggcagccaggccctgaagttcttcaacacccaccagctgaagtgccagctgcagaggcacccagactgtgccaacgtgaagcagtggaagggcggccctgtgaagattgaccccctggccctggtgcaggccatcgagcgctacctggtggtgcggggctacggccgggtgcgggaggatgatgaagattctgatgatgatggcagtgatgaggagattgatgagagcctggccgcccagttcctgaacagcggaaatgtgcgccaccggctgcagttctacatcggggagcacctgctgccctacaacatgacagtgtaccaggccgtgcggcagttcagcatccaggctgaagatgagcgggagagcacagatgatgagagcaaccccctgggccgggccggcatctggaccaagacccacaccatctggtacaagcctgtgagagaagatgaggagagcaacaaggactgtgtgggcggcaagaggggccgggcccagacagcccccaccaagaccagccccagaaatgccaagaagcatgatgagctgtggcatgatggagtgtgccccagcgtgagcaaccccctggaggtgtacctgatccccaccccacctgagaacatcacctttgaggaccccagcctggatgtgatcctgctgctgcgggtgctgcacgccatcagccgctactggtactacctgtatgacaatgccatgtgcaaggagatcatccccaccagcgagttcatcaacagcaagctgacagccaaggccaaccggcagctgcaggaccccctggtgatcatgacaggcaacatccccacctggctgacagagctgggcaagacctgccccttcttcttcccctttgacacccggcagatgctgttctacgtgacagcctttgaccgggaccgggccatgcagaggctgctggacaccaaccctgagatcaaccagagcgacagccaggacagccgggtggccccccggctggacaggaagaagaggacagtgaaccgggaggagctgctgaagcaggccgagagcgtgatgcaggacctgggcagcagccgggccatgctggagatccagtatgaaaatgaggtgggcaccggcctgggccccaccctggagttctacgccctggtgtcccaggagctgcagagagctgacctgggcctgtggagaggagaggaggtgaccctgagcaaccccaagggcagccaggagggcaccaagtacatccagaacctgcagggcctgtttgccctgccctttggaagaacagccaagccagcccacatcgccaaggtgaagatgaagttccgcttcctgggcaagctgatggccaaggccatcatggacttccggctggtggacctgcccctgggcctgcccttctacaagtggatgctgcggcaggagaccagcctgaccagccatgacctgtttgatattgatcctgtggtggcccggtctgtgtaccacctggaggacatcgtgcggcagaagaagaggctggagcaggacaagagccagaccaaggagagcctgcagtatgccctggagaccctgaccatgaatggctgcagcgtggaggacctgggcctggacttcaccctgcccggcttccccaacatcgagctgaagaagggcggcaaggacatccctgtgaccatccacaacctggaggagtacctgcggctggtgatcttctgggccctgaatgaaggagtgtcccggcagtttgacagcttcagagatggctttgaatctgtgttccccctgagccacctgcagtacttctacccagaggagctggaccagctgctgtgtggcagcaaggctgacacctgggatgccaagaccctgatggagtgctgcaggccagaccacggctacacccatgacagcagagctgtgaagttcctgtttgagatcctgagcagctttgacaatgagcagcagaggctcttcctgcagtttgtgacaggcagcccccggctgcctgtgggcggcttccgcagcctgaacccccccctgaccatcgtgaggaagacctttgagagcacagaaaatccagatgacttcctgcccagcgtgatgacctgtgtgaactacctgaagctgcctgactacagcagcattgagatcatgagggagaagctgctgattgctgcccgggagggccagcagagcttccacctgtcctag

SEQ ID NO: 173266 - DNA, 5169 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggcagccggcggggcagcggcctgggcaagagaggagctgctgaggcccggcggcaggagaagatggctgaccctgagagcaaccaggaggccgtgaacagcagcgctgccaggacagatgaggccccccagggcgccgccgccagcagctctgtggccggggctgtgggcatgaccaccagcggggagagcgagagtgatgacagcgagatgggccgcctgcaggccctgctggaggcccggggcctgcccccccacctgtttggccccctgggccccaggatgagccagctgttccacaggaccatcggcagcggggccagcagcaaggcccagcagctgctgcagggcctgcaggccagtgatgagagccagcagctgcaggccgtcatcgagatgtgccagctgctggtgatgggaaatgaggagaccctgggcggcttccctgtgaagtctgtggtgcctgccctgatcaccctgctgcagatggagcacaactttgacatcatgaaccacgcctgccgggccctgacctacatgatggaggccctgcccaggagcagcgctgtggtggtggatgccatccctgtgttcctggagaagctgcaggtgatccagtgcattgatgtggccgagcaggccctgacagccctggagatgctgagccgccgccacagcaaggccatcctgcaggccggcggcctggccgactgcctgctgtacctggagttcttcagcatcaatgcccagagaaatgccctggccatcgccgccaactgctgccagagcatcaccccagatgagttccactttgtggccgacagcctgcccctgctgacccagaggctgacccaccaggacaagaagtctgtggagagcacctgcctgtgctttgcccggctggtggacaacttccagcacgaggagaacctgctgcagcaggtggccagcaaggacctgctgaccaacgtgcagcagctgctggtggtgaccccacccatcctgagcagcggcatgttcatcatggtggtgaggatgttcagcctgatgtgcagcaactgccccaccctggccgtgcagctgatgaagcagaacattgctgagaccctgcacttcctgctgtgtggggccagcaatggcagctgccaggagcagattgacctggtgcccaggagcccccaggagctgtatgagctgaccagcctcatctgtgagctgatgccctgcctgcccaaggagggcatctttgctgtggacaccatgctgaagaagggaaatgcccagaacacagatggagccatctggcagtggagagatgaccggggcctgtggcacccctacaacagaattgacagccgcatcatcgaggccgcccaccaggtgggggaggatgagatcagcctgagcaccctgggccgggtgtacaccatcgacttcaacagcatgcagcagatcaatgaagacaccggcacagcccgggccatccagaggaagcccaaccccctggccaacagcaacaccagcggctacagcgagagcaagaaggatgatgcccgggcccagctgatgaaggaggaccctgagctggccaagagcttcatcaagaccctgtttggagtgctgtatgaggtgtacagcagcagcgctggccctgctgtgcgccacaagtgcctgcgggccatcctgcgcatcatctactttgctgatgctgagctgctgaaggatgtgctgaagaaccacgctgtgagcagccacatcgcctccatgctgagcagccaggacctgaagatcgtggtgggcgccctgcagatggccgagatcctgatgcagaagctgcctgacatcttctctgtgtacttccggcgggagggcgtgatgcaccaggtgaagcacctggccgagagcgagagcctgctgaccagcccccccaaggcctgcaccaatggaagtggctccatgggcagcaccacctctgtgagcagcggcacagccacagctgccacccatgctgctgctgacctgggcagccccagcctgcagcacagcagagatgacagcctggacctgagcccccagggccgcctgagtgatgtgctgaagaggaagaggctgcccaagaggggcccccggcggcccaagtacagccccccaagagatgatgacaaggtggacaaccaggccaagagccccaccaccacccagagccccaagagcagcttcctggccagcctgaaccccaagacctggggccgcctgagcacccagagcaacagcaacaacatcgagcccgccaggacagctgggggcagcggcctggcccgggccgccagcaaggacaccatcagcaacaaccgggagaagatcaagggctggatcaaggagcaggcccacaagtttgtggagcgctacttcagcagcgagaacatggatggcagcaacccagccctgaatgtgctgcagaggctgtgtgccgccacagagcagctgaacctgcaggtggatggaggagcagaatgtctggtggagatccgcagcatcgtgtctgagagtgatgtgtcctcctttgagatccagcacagcggctttgtgaagcagctgctgctgtacctgaccagcaagtctgagaaggatgctgtgtcccgggagatccggctgaagcgcttcctgcacgtgttcttcagcagccccctgcctggagaggagcccatcggccgggtggagcctgtgggcaatgcccccctgctggccctggtgcacaagatgaacaactgcctgagccagatggagcagtttcctgtgaaggtgcatgacttccccagcggaaatggaactggaggcagcttcagcctgaacagaggcagccaggccctgaagttcttcaacacccaccagctgaagtgccagctgcagaggcacccagactgtgccaacgtgaagcagtggaagggcggccctgtgaagattgaccccctggccctggtgcaggccatcgagcgctacctggtggtgcggggctacggccgggtgcgggaggatgatgaagattctgatgatgatggcagtgatgaggagattgatgagagcctggccgcccagttcctgaacagcggaaatgtgcgccaccggctgcagttctacatcggggagcacctgctgccctacaacatgacagtgtaccaggccgtgcggcagttcagcatccaggctgaagatgagcgggagagcacagatgatgagagcaaccccctgggccgggccggcatctggaccaagacccacaccatctggtacaagcctgtgagagaagatgaggagagcaacaaggactgtgtgggcggcaagaggggccgggcccagacagcccccaccaagaccagccccagaaatgccaagaagcatgatgagctgtggcatgatggagtgtgccccagcgtgagcaaccccctggaggtgtacctgatccccaccccacctgagaacatcacctttgaggaccccagcctggatgtgatcctgctgctgcgggtgctgcacgccatcagccgctactggtactacctgtatgacaatgccatgtgcaaggagatcatccccaccagcgagttcatcaacagcaagctgacagccaaggccaaccggcagctgcaggaccccctggtgatcatgacaggcaacatccccacctggctgacagagctgggcaagacctgccccttcttcttcccctttgacacccggcagatgctgttctacgtgacagcctttgaccgggaccgggccatgcagaggctgctggacaccaaccctgagatcaaccagagcgacagccaggacagccgggtggccccccggctggacaggaagaagaggacagtgaaccgggaggagctgctgaagcaggccgagagcgtgatgcaggacctgggcagcagccgggccatgctggagatccagtatgaaaatgaggtgggcaccggcctgggccccaccctggagttctacgccctggtgtcccaggagctgcagagagctgacctgggcctgtggagaggagaggaggtgaccctgagcaaccccaagggcagccaggagggcaccaagtacatccagaacctgcagggcctgtttgccctgccctttggaagaacagccaagccagcccacatcgccaaggtgaagatgaagttccgcttcctgggcaagctgatggccaaggccatcatggacttccggctggtggacctgcccctgggcctgcccttctacaagtggatgctgcggcaggagaccagcctgaccagccatgacctgtttgatattgatcctgtggtggcccggtctgtgtaccacctggaggacatcgtgcggcagaagaagaggctggagcaggacaagagccagaccaaggagagcctgcagtatgccctggagaccctgaccatgaatggctgcagcgtggaggacctgggcctggacttcaccctgcccggcttccccaacatcgagctgaagaagggcggcaaggacatccctgtgaccatccacaacctggaggagtacctgcggctggtgatcttctgggccctgaatgaaggagtgtcccggcagtttgacagcttcagagatggctttgaatctgtgttccccctgagccacctgcagtacttctacccagaggagctggaccagctgctgtgtggcagcaaggctgacacctgggatgccaagaccctgatggagtgctgcaggccagaccacggctacacccatgacagcagagctgtgaagttcctgtttgagatcctgagcagctttgacaatgagcagcagaggctcttcctgcagtttgtgacaggcagcccccggctgcctgtgggcggcttccgcagcctgaacccccccctgaccatcgtgaggaagacctttgagagcacagaaaatccagatgacttcctgcccagcgtgatgacctgtgtgaactacctgaagctgcctgactacagcagcattgagatcatgagggagaagctgctgattgctgcccgggagggccagcagagcttccacctgtcctag

SEQ ID NO: 173267 - DNA, 450 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagagagccccagcgagaccaacaagccccacagcaagagcaagaagaggcacctggaccaggagcagcagctgaagagcgcccagagccccagcaccagcaaggcccacaccaggaagagcggggccactggaggcagccgcagccagaagaggtag

SEQ ID NO: 173268 - DNA, 465 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagagagccccagcgagaccaacaagccccacagcaagagcaagaagaggcacctggaccaggagcagcagctgaagagcgcccagagccccagcaccagcaaggcccacaccaggaagagcggggccactggaggcagccgcagccagaagaggaagaggacagagagctag

SEQ ID NO: 173269 - DNA, 1041 bp, Artificial Sequence
  Description of Artificial Sequence: Synthetic coding sequence
atgagcaaccggcccaacaacaaccctgggggcagcctgcggcgcagccagaggaacacagctggggcccagccccaggatgacagcatcggcggccgcagccacctgggccaggccaagcacaagggctacagccccccagagagcaggaagagcaacagcaaggcccccaaggtgcagagcaacaccaccagcgagctgagccggggccacctgagcaagaggagctgcagcagcagcagcgctgtgattgtgccccagccagaagatcctgaccgggccaacaccagcgagcggcagaagacaggccaggtgcccaagaaggacaacagcagaggagtgaagaggtctgccagcccagactacaacagaaccaacagccccagcagcgccaagaagcccaaggccctgcagcacacagagagccccagcgagaccaacaagccccacagcaagagcaagaagaggcacctggaccaggagcagcagctgaagagcgcccagagccccagcaccagcaaggcccacaccaggaagagcggggccactggaggcagccgcagccagaagaggaagaggacagagagcagctgtgtgaagagcggcagcggcagcgagagcactggagctgaggagaggtctgccaagcccaccaagctggccagcaagagcgccaccagcgccaaggccggctgcagcaccatcacagacagcagcagcgctgccagcaccagcagcagcagcagcgctgtggccagcgccagcagcacagtgcccccaggggcccgggtgaagcagggcaaggaccagaacaaggcccggcgcagccgcagcgccagcagccccagccccaggaggagcagccgggagaaggagcagagcaagacaggaggcagcagcaagtttgactgggccgcccgcttcagccccaaggtgtccctgcccaagaccaagctgagcctgcccggcagcagcaagtctgagaccagcaagccaggccccagcggcctgcaggccaaggtgctgaccagcaagaggtag

SEQ ID NO: 173270 - DNA, 1746 bp, Artificial Sequence
  Description of Artificial Sequence: Synthetic coding sequence
atggctgtggccggggctgtgtctggagagcccctggtgcactggtgcacccagcagctgaggaagaccttcggcctggatgtgtctgaggagatcatccagtatgtgctgagcattgaatctgctgaggagatccgggagtatgtgacagacctgctgcagggcaatgaaggcaagaagggccagttcatcgaggagctgatcaccaagtggcagaagaatgaccaggagctgatcagtgaccccctgcagcagtgcttcaagaaggatgagatcctggatggccagaagagcggggaccacctgaagaggggcaggaagaagggcaggaaccggcaggaggtgcctgccttcacagagccagacaccacagctgaggtgaagaccccatttgacctggccaaggcccaggagaacagcaacagcgtgaagaagaagaccaagtttgtgaacctgtacacccgggagggccaggaccggctggccgtgctgctgcccggccgccacccctgtgactgcctgggccagaagcacaagctgatcaacaactgcctgatctgtggccgcatcgtgtgtgagcaggagggcagcggcccctgcctcttctgtggcaccctggtgtgcacccatgaggagcaggacatcctgcagagggacagcaacaagagccagaagctgctgaagaagctgatgtctggagtggagaacagcggcaaggtggacatcagcaccaaggacctgctgccccaccaggagctgcgcatcaagagcggcctggagaaggccatcaagcacaaggacaagctgctggagtttgacaggaccagcatccggaggacccaggtgattgatgatgaaagtgactactttgccagtgacagcaaccagtggctgagcaagctggagcgggagaccctgcagaagcgggaggaggagctgcgggagctgcggcatgccagccggctgagcaagaaggtgaccatcgactttgctggcaggaagatcctggaggaggagaacagcctggccgagtaccacagccggctggatgagaccatccaggccatcgccaacggcaccctgaaccagcccctgaccaagctggacaggagcagcgaggagcccctgggcgtgctggtgaaccccaacatgtaccagagccccccccagtgggtggaccacactggagctgccagccagaagaaggccttccgcagcagcggcttcggcctggagttcaacagcttccagcaccagctgcgcatccaggaccaggagttccaggagggctttgatggcggctggtgcctgtctgtgcaccagccctgggccagcctgctggtgcggggcatcaagagggtggagggccgctcctggtacaccccccaccggggccgcctgtggattgctgccacagccaagaagcccagcccccaggaggtgtctgagctgcaggccacctaccgcctgctgcggggcaaggatgtggagttccccaatgactaccccagcggctgcctgctgggctgtgtggacctgattgactgcctgagccagaagcagttcaaggagcagttcccagacatcagccaggagagtgacagcccctttgtgttcatctgcaagaacccccaggagatggtggtgaagttccccatcaagggcaaccccaagatctggaagctggacagcaagatccaccagggcgccaagaagggcctgatgaagcagaacaaggctgtgtag

SEQ ID NO: 173271 - DNA, 1431 bp, Artificial Sequence
  Description of Artificial Sequence: Synthetic coding sequence
atgagcggccccacctggctgccccccaagcagcctgagcccgcccgggccccccagggccgggccatcccccggggcaccccaggccccccaccagcccacggggccgccctgcagccccacccccgggtgaacttctgccccctgcccagcgagcagtgctaccaggcccctgggggccctgaggaccggggccctgcctgggtgggcagccacggcgtgctgcagcacacccagggcctgcctgctgaccggggcggcctgcggcccggcagcctggatgctgagattgacctgctgagcagcaccctggccgagctgaatggaggccggggccacgccagccggcggccagaccggcaggcctatgagcccccacctcctccagcctacagaacaggcagcctgaagcccaacccagccagccccctgcctgccagcccctatggaggccccaccccagccagctacaccacagccagcaccccagctggccctgccttccctgtgcaggtgaaggtggcccagcctgtgcggggctgcggccccccaagaagaggagccagccaggccagcggccccctgcccggcccccacttccccctgcccggccgcggggaggtgtggggccctggctaccgcagccagcgggagcccggccctggggccaaggaggaggccgccggcgtgtctggccctgctggccggggccggggcggggagcacggcccccaggtgcccctgagccagcccccagaagatgagctggaccggctgaccaagaagctggtgcatgacatgaaccacccccccagcggggagtacttcggccagtgtggcggctgtggggaggatgtggtgggagatggagctggggtggtggccctggacagagtcttccacgtgggctgctttgtgtgcagcacctgccgggcccagctgcggggccagcacttctatgctgtggagcggcgggcctactgtgagggctgctacgtggccaccctggagaagtgtgccacctgcagccagcccatcctggaccgcatcctgcgggccatgggcaaggcctaccaccctggctgcttcacctgtgtggtgtgccaccggggcctggatggcatccccttcaccgtggatgccaccagccagatccactgcatcgaggacttccacaggaagtttgccccccgctgcagcgtgtgtggcggggccatcatgcctgagcccggccaggaggagaccgtgcgcatcgtggccctggacaggagcttccacatcggctgctacaagtgtgaggagtgtggcctgctgctgagcagcgagggggagtgccagggctgctaccccctggatggccacatcctgtgcaaggcctgcagcgcctggaggatccaggagctgagcgccaccgtgaccacagactgctag

SEQ ID NO: 173272 - DNA, 1473 bp, Artificial Sequence
  Description of Artificial Sequence: Synthetic coding sequence
atggagcagaagcccagcaaggtggagtgtggcagtgaccctgaggagaacagcgcccggagcccagatggcaagaggaagaggaagaatggccagtgcagcctgaagacctccatgagcggctacatccccagctacctggacaaggatgagcagtgtgtggtgtgtggggacaaggccaccggctaccactaccgctgcatcacctgtgagggctgcaagggcttcttccggaggaccatccagaagaacctgcaccccacctacagctgcaagtatgacagctgctgcgtgattgacaagatcaccaggaaccagtgccagctgtgccgcttcaagaagtgcatcgctgtgggcatggccatggacctggtgctggatgacagcaagagggtggccaagaggaagctgattgagcagaaccgggagaggaggaggaaggaggagatgatccgcagcctgcagcagaggcctgagcccaccccagaggagtgggacctgatccacatcgccacagaggcccacaggagcaccaatgcccagggcagccactggaagcagaggaggaagttcctgcctgatgacatcggccagagccccatcgtgtccatgccagatggagacaaggtggacctggaggccttcagcgagttcaccaagatcatcaccccagccatcaccagggtggtggactttgccaagaagctgcccatgttcagcgagctgccctgtgaggaccagatcatcctgctgaagggctgctgcatggagatcatgagcctgcgggctgctgtgcgctatgaccctgagagtgacaccctgaccctgtctggagagatggctgtgaagcgggagcagctgaagaatggaggcctgggcgtggtgtctgatgccatctttgagctgggcaagagcctgagcgccttcaacctggatgacacagaggtggccctgctgcaggccgtgctgctgatgagcacagacaggagcggcctgctgtgtgtggacaagattgagaagagccaggaggcctacctgctggcctttgagcactacgtgaaccacaggaagcacaacatcccccacttctggcccaagctgctgatgaaggagcgggaggtgcagagcagcatcctgtacaagggagctgctgctgagggccggcctgggggcagcctgggcgtgcaccctgagggccagcagctgctgggcatgcacgtggtgcagggcccccaggtgcggcagctggagcagcagctgggggaggccggcagcctgcagggccctgtgctgcagcaccagagccccaagagcccccagcagaggctgctggagctgctgcacaggagcggcatcctgcacgcccgggctgtgtgtggagaagatgacagcagcgaggccgacagccccagcagcagcgaggaggagcctgaggtgtgtgaggacctggccggaaatgctgccagcccctag

SEQ ID NO: 173273 - DNA, 1473 bp, Artificial Sequence; identical to SEQ ID NO: 173272
  Description of Artificial Sequence: Synthetic coding sequence

SEQ ID NO: 173274 - DNA, 1233 bp, Artificial Sequence
  Description of Artificial Sequence: Synthetic coding sequence
atggagcagaagcccagcaaggtggagtgtggcagtgaccctgaggagaacagcgcccggagcccagatggcaagaggaagaggaagaatggccagtgcagcctgaagacctccatgagcggctacatccccagctacctggacaaggatgagcagtgtgtggtgtgtggggacaaggccaccggctaccactaccgctgcatcacctgtgagggctgcaagggcttcttccggaggaccatccagaagaacctgcaccccacctacagctgcaagtatgacagctgctgcgtgattgacaagatcaccaggaaccagtgccagctgtgccgcttcaagaagtgcatcgctgtgggcatggccatggacctggtgctggatgacagcaagagggtggccaagaggaagctgattgagcagaaccgggagaggaggaggaaggaggagatgatccgcagcctgcagcagaggcctgagcccaccccagaggagtgggacctgatccacatcgccacagaggcccacaggagcaccaatgcccagggcagccactggaagcagaggaggaagttcctgcctgatgacatcggccagagccccatcgtgtccatgccagatggagacaaggtggacctggaggccttcagcgagttcaccaagatcatcaccccagccatcaccagggtggtggactttgccaagaagctgcccatgttcagcgagctgccctgtgaggaccagatcatcctgctgaagggctgctgcatggagatcatgagcctgcgggctgctgtgcgctatgaccctgagagtgacaccctgaccctgtctggagagatggctgtgaagcgggagcagctgaagaatggaggcctgggcgtggtgtctgatgccatctttgagctgggcaagagcctgagcgccttcaacctggatgacacagaggtggccctgctgcaggccgtgctgctgatgagcacagacaggagcggcctgctgtgtgtggacaagattgagaagagccaggaggcctacctgctggcctttgagcactacgtgaaccacaggaagcacaacatcccccacttctggcccaagctgctgatgaaggtgacagacctgaggatgattggagcctgccacgccagccgcttcctgcacatgaaggtggagtgccccacagagctgttccccccactcttcctggaggtgtttgaggaccaggaggtgtag

SEQ ID NO: 173275 - DNA, 1233 bp, Artificial Sequence; identical to SEQ ID NO: 173274
  Description of Artificial Sequence: Synthetic coding sequence

SEQ ID NO: 173276 - DNA, 1386 bp, Artificial Sequence
  Description of Artificial Sequence: Synthetic coding sequence
atgacccccaacagcatgacagaaaatggcctgacagcctgggacaagcccaagcactgcccagaccgggagcatgactggaagctggtgggcatgtctgaggcctgcctgcacaggaagagccacagcgagaggaggagcaccctgaagaatgagcagagcagcccccacctgatccagaccacctggaccagcagcatcttccacctggaccatgatgatgtgaatgaccagagcgtgagcagcgcccagaccttccagacagaggagaagaagtgcaagggctacatccccagctacctggacaaggatgagctgtgtgtggtgtgtggggacaaggccaccggctaccactaccgctgcatcacctgtgagggctgcaagggcttcttccggaggaccatccagaagaacctgcaccccagctacagctgcaagtatgagggcaaatgtgtgattgacaaggtgaccaggaaccagtgccaggagtgccgcttcaagaagtgcatctacgtgggcatggccacagacctggtgctggatgacagcaagaggctggccaagaggaagctgattgaggagaaccgggagaagagaagaagagaggagctgcagaagagcatcggccacaagccagagcccacagatgaggagtgggagctgatcaagacagtgacagaggcccacgtggccaccaatgcccagggcagccactggaagcagaagaggaagttcctgcctgaggacatcggccaggcccccatcgtgaatgcccctgagggcggcaaggtggacctggaggccttcagccacttcaccaagatcatcaccccagccatcaccagggtggtggactttgccaagaagctgcccatgttctgtgagctgccctgtgaggaccagatcatcctgctgaagggctgctgcatggagatcatgagcctgcgggctgctgtgcgctatgaccctgagagcgagaccctgaccctgaatggagagatggctgtgacccggggccagctgaagaatggaggcctgggcgtggtgtctgatgccatctttgacctgggcatgagcctgagcagcttcaacctggatgacacagaggtggccctgctgcaggccgtgctgctgatgagcagtgaccggcccggcctggcctgtgtggagcgcatcgagaagtaccaggacagcttcctgctggcctttgagcactacatcaactacaggaagcaccacgtgacccacttctggcccaagctgctgatgaaggtgacagacctgaggatgattggagcctgccacgccagccgcttcctgcacatgaaggtggagtgccccacagagctgttccccccactcttcctggaggtgtttgaggactag

SEQ ID NO: 173277 - DNA, 1386 bp, Artificial Sequence; identical to SEQ ID NO: 173276
  Description of Artificial Sequence: Synthetic coding sequence

SEQ ID NO: 173278 - DNA, 1386 bp, Artificial Sequence; identical to SEQ ID NO: 173276
  Description of Artificial Sequence: Synthetic coding sequence

SEQ ID NO: 173279 - DNA, 87 bp, Artificial Sequence
  Description of Artificial Sequence: Synthetic coding sequence
atgacccccaacagcatgacagagatggccctgcagcccggcaccaacagaagcacagtgcagacagagaacaccaccggcagctag

SEQ ID NO: 173280 - DNA, 366 bp, Artificial Sequence
  Description of Artificial Sequence: Synthetic coding sequence
atgacccccaacagcatgacagaaaatggcctgacagcctgggacaagcccaagcactgcccagaccgggagcatgactggaagctggtgggcatgtctgaggcctgcctgcacaggaagagccacagcgagaggaggagcaccctgaagaatgagcagagcagcccccacctgatccagaccacctggaccagcagcatcttccacctggaccatgatgatgtgaatgaccagagcgtgagcagcgcccagaccttccagacagaggagaagaagtgcaagggctacatccccagctacctggacaaggatgagctgtgtgtggtgtgtggggacaaggccaccggctaccactaccgctgctag

SEQ ID NO: 173281 - DNA, 441 bp, Artificial Sequence
  Description of Artificial Sequence: Synthetic coding sequence
atgcaggtgctgaccaagcgctaccccaagaactgcctgctgactgtgatggacagatatgctgctgaggtgcacaacatggagcaggtggtgatgatccccagcctgctgagagatgtgcagctgagcggccctgggggccaggcccaggccgaggccccagacctgtacacctacttcaccatgctgaaggccatctgtgtggatgtggaccacggcctgctgccccgggaggagtggcaggccaaggtggccggctctgaagaaaatggaacagctgagacagaggaggtggaggatgagagcgccagcggggagctggacctggaggcccagttccacctgcacttcagcagcctgcaccacatcctgatgcacctgacagagaaggcccaggaggtgaccaggaagtaccaggagatgacaggccaggtgtggtag

SEQ ID NO: 173282 - DNA, 2802 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagccctggcccgctggctgccccctgtgtatgaagatggcttcagccagccccggggctggaaccctggcttcctgtacaacggcttccccctgccccctgtgcgggaggtgaccaggcatgtgatccaggtgtccaatgaggtggtgacagatgatgaccgctacagcgacctgctgatggcctggggccagtacatcgaccatgacatcgccttcaccccccagagcaccagcaaggccgcctttggaggcggcgctgactgccagatgacctgtgagaaccagaacccctgcttccccatccagctgcctgaggaggcccggcctgctgctggaacagcctgcctgcccttctaccgcagcagcgctgcctgtggcaccggggaccagggcgccctgtttggaaacctgagcacagccaacccccggcagcagatgaatggcctgaccagcttcctggatgccagcacagtgtatggcagcagccctgccctggagcggcagctgaggaactggaccagcgctgagggcctgctgcgggtgcacgcccggctgcgggacagcggccgggcctacctgccctttgtgcccccccgggccccagctgcctgtgcccctgagcccggcatccctggagagacccggggcccctgcttcctggccggagatggccgggccagcgaggtgcccagcctgacagccctgcacaccctgtggctgcgggagcacaaccggctggccgccgccctgaaggccctgaatgcccactggagcgcagatgctgtgtaccaggaggccaggaaggtggtgggcgccctgcaccagatcatcaccctgcgggactacatcccccgcatcctgggccctgaggccttccagcagtatgtgggcccctatgagggctatgacagcacagccaaccccaccgtgtccaatgtgttcagcacagctgccttccgcttcggccacgccaccatccaccccctggtgcggcggctggatgccagcttccaggagcacccagacctgcccggcctgtggctgcaccaggccttcttcagcccctggaccctgctgcggggcggcggcctggaccccctcatccggggcctgctggcccggcctgccaagctgcaggtgcaggaccagctgatgaatgaggagctgacagagcggctgtttgtgctgagcaacagcagcaccctggacctggccagcatcaacctgcagaggggccgggaccacggcctgcccggctacaatgagtggagggagttctgtggcctgccccggctggagaccccagctgacctgagcacagccatcgccagccgctctgtggccgacaagatcctggacctgtacaagcacccagacaacattgatgtgtggctgggcggcctggccgagaacttcctgccccgggccaggacaggccccctgtttgcctgcctgattggcaagcagatgaaggccctgagagatggagactggttctggtgggagaacagccacgtgttcacagatgcccagaggcgggagctggagaagcacagcctgagcagggtcatctgtgacaacacaggcctgaccagggtgcccatggatgccttccaggtgggcaagtttcctgaggactttgagagctgtgacagcatcaccggcatgaacctggaggcctggagggagaccttcccccaggatgacaagtgtggcttccctgagagcgtggagaatggagactttgtgcactgtgaggagagcggcagaagagtgctggtgtacagctgccgccacggctatgagctgcagggccgggagcagctgacctgcacccaggagggctgggacttccagccccccctgtgcaaggatgtgaatgaatgtgctgatggagcccaccccccctgccacgccagcgcccgctgcaggaacaccaagggcggcttccagtgcctgtgtgccgacccctatgagctgggagatgatggccgcacctgtgtggacagcggccgcctgccccgggtgacctggatctccatgagcctggccgccctgctgattggaggctttgctggcctgaccagcaccgtcatctgccgctggaccaggacaggcaccaagagcaccctgcccatcagcgagactggaggcggcaccccagagctgcgctgtgggaagcaccaggccgtgggcaccagcccccagagagctgctgcccaggacagcgagcaggagagcgctggcatggagggccgggacacccaccggctgccccgggccctgtag

SEQ ID NO: 173283 - DNA, 2790 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagccctggcccgctggctgccccctgtgtatgaagatggcttcagccagccccggggctggaaccctggcttcctgtacaacggcttccccctgccccctgtgcgggaggtgaccaggcatgtgatccaggtgtccaatgaggtggtgacagatgatgaccgctacagcgacctgctgatggcctggggccagtacatcgaccatgacatcgccttcaccccccagagcaccagcaaggccgcctttggaggcggcgctgactgccagatgacctgtgagaaccagaacccctgcttccccatccagctgcctgaggaggcccggcctgctgctggaacagcctgcctgcccttctaccgcagcagcgctgcctgtggcaccggggaccagggcgccctgtttggaaacctgagcacagccaacccccggcagcagatgaatggcctgaccagcttcctggatgccagcacagtgtatggcagcagccctgccctggagcggcagctgaggaactggaccagcgctgagggcctgctgcgggtgcacgcccggctgcgggacagcggccgggcctacctgccctttgtgcccccccgggccccagctgcctgtgcccctgagcccggcatccctggagagacccggggcccctgcttcctggccggagatggccgggccagcgaggtgcccagcctgacagccctgcacaccctgtggctgcgggagcacaaccggctggccgccgccctgaaggccctgaatgcccactggagcgcagatgctgtgtaccaggaggccaggaaggtggtgggcgccctgcaccagatcatcaccctgcgggactacatcccccgcatcctgggccctgaggccttccagcagtatgtgggcccctatgagggctatgacagcacagccaaccccaccgtgtccaatgtgttcagcacagctgccttccgcttcggccacgccaccatccaccccctggtgcggcggctggatgccagcttccaggagcacccagacctgcccggcctgtggctgcaccaggccttcttcagcccctggaccctgctgcggggcggcggcctggaccccctcatccggggcctgctggcccggcctgccaagctgcaggtgcaggaccagctgatgaatgaggagctgacagagcggctgtttgtgctgagcaacagcagcaccctggacctggccagcatcaacctgcagaggggccgggaccacggcctgcccggctacaatgagtggagggagttctgtggcctgccccggctggagaccccagctgacctgagcacagccatcgccagccgctctgtggccgacaagatcctggacctgtacaagcacccagacaacattgatgtgtggctgggcggcctggccgagaacttcctgccccgggccaggacaggccccctgtttgcctgcctgattggcaagcagatgaaggccctgagagatggagactggttctggtgggagaacagccacgtgttcacagatgcccagaggcgggagctggagaagcacagcctgagcagggtcatctgtgacaacacaggcctgaccagggtgcccatggatgccttccaggtgggcaagtttcctgaggactttgagagctgtgacagcatcaccggcatgaacctggaggcctggagggagaccttcccccaggatgacaagtgtggcttccctgagagcgtggagaatggagactttgtgcactgtgaggagagcggcagaagagtgctggtgtacagctgccgccacggctatgagctgcagggccgggagcagctgacctgcacccaggagggctgggacttccagccccccctgtgcaaggatgtgaatgaatgtgctgatggagcccaccccccctgccacgccagcgcccgctgcaggaacaccaagggcggcttccagtgcctgtgtgccgacccctatgagctgggagatgatggccgcacctgtgtggacagcggccgcctgccccgggtgacctggatctccatgagcctggccgccctgctgattggaggctttgctggcctgaccagcaccgtcatctgccgctggagggtgctgggctggaaggccggcatcctgaccggctgccgggagcccagcgagggcaaggtggccggccactgcaggacagccagctgcagccagaaccacaggaccaccctcttccagacccaggccaaccccaagtctgctggccgcctcttcagccagcacggctag

SEQ ID NO: 173284 - DNA, 2802 bp, Artificial Sequence; identical to SEQ ID NO: 173282
  Description of Artificial Sequence: Synthetic coding sequence

SEQ ID NO: 173285 - DNA, 2670 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagccctggcccgctggctgccccctgtgtatgaagatggcttcagccagccccggggctggaaccctggcttcctgtacaacggcttccccctgccccctgtgcgggaggtgaccaggcatgtgatccaggtgtccaatgaggtggtgacagatgatgaccgctacagcgacctgctgatggcctggggccagtacatcgaccatgacatcgccttcaccccccagagcaccagcaaggccgcctttggaggcggcgctgactgccagatgacctgtgagaaccagaacccctgcttccccatccagctgcctgaggaggcccggcctgctgctggaacagcctgcctgcccttctaccgcagcagcgctgcctgtggcaccggggaccagggcgccctgtttggaaacctgagcacagccaacccccggcagcagatgaatggcctgaccagcttcctggatgccagcacagtgtatggcagcagccctgccctggagcggcagctgaggaactggaccagcgctgagggcctgctgcgggtgcacgcccggctgcgggacagcggccgggcctacctgccctttgtgcccccccgggccccagctgcctgtgcccctgagcccggcatccctggagagacccggggcccctgcttcctggccggagatggccgggccagcgaggtgcccagcctgacagccctgcacaccctgtggctgcgggagcacaaccggctggccgccgccctgaaggccctgaatgcccactggagcgcagatgctgtgtaccaggaggccaggaaggtggtgggcgccctgcaccagatcatcaccctgcgggactacatcccccgcatcctgggccctgaggccttccagcagtatgtgggcccctatgagggctatgacagcacagccaaccccaccgtgtccaatgtgttcagcacagctgccttccgcttcggccacgccaccatccaccccctggtgcggcggctggatgccagcttccaggagcacccagacctgcccggcctgtggctgcaccaggccttcttcagcccctggaccctgctgcggggcggcggcctggaccccctcatccggggcctgctggcccggcctgccaagctgcaggtgcaggaccagctgatgaatgaggagctgacagagcggctgtttgtgctgagcaacagcagcaccctggacctggccagcatcaacctgcagaggggccgggaccacggcctgcccggctacaatgagtggagggagttctgtggcctgccccggctggagaccccagctgacctgagcacagccatcgccagccgctctgtggccgacaagatcctggacctgtacaagcacccagacaacattgatgtgtggctgggcggcctggccgagaacttcctgccccgggccaggacaggccccctgtttgcctgcctgattggcaagcagatgaaggccctgagagatggagactggttctggtgggagaacagccacgtgttcacagatgcccagaggcgggagctggagaagcacagcctgagcagggtcatctgtgacaacacaggcctgaccagggtgcccatggatgccttccaggtgggcaagtttcctgaggactttgagagctgtgacagcatcaccggcatgaacctggaggcctggagggagaccttcccccaggatgacaagtgtggcttccctgagagcgtggagaatggagactttgtgcactgtgaggagagcggcagaagagtgctggtgtacagctgccgccacggctatgagctgcagggccgggagcagctgacctgcacccaggagggctgggacttccagccccccctgtgcaaggacagcggccgcctgccccgggtgacctggatctccatgagcctggccgccctgctgattggaggctttgctggcctgaccagcaccgtcatctgccgctggaccaggacaggcaccaagagcaccctgcccatcagcgagactggaggcggcaccccagagctgcgctgtgggaagcaccaggccgtgggcaccagcccccagagagctgctgcccaggacagcgagcaggagagcgctggcatggagggccgggacacccaccggctgccccgggccctgtag

SEQ ID NO: 173286 - DNA, 2283 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagccctggcccgctggctgccccctgtgtatgaagatggcttcagccagccccggggctggaaccctggcttcctgtacaacggcttccccctgccccctgtgcgggaggtgaccaggcatgtgatccaggtgtccaatgaggtggtgacagatgatgaccgctacagcgacctgctgatggcctggggccagtacatcgaccatgacatcgccttcaccccccagagcaccagcaaggccgcctttggaggcggcgctgactgccagatgacctgtgagaaccagaacccctgcttccccatccagatcatcaccctgcgggactacatcccccgcatcctgggccctgaggccttccagcagtatgtgggcccctatgagggctatgacagcacagccaaccccaccgtgtccaatgtgttcagcacagctgccttccgctttggacatgccaccatccaccccctggtgcggcggctggatgccagcttccaggagcacccagacctgcccggcctgtggctgcaccaggccttcttcagcccctggaccctgctgcggggcggcggcctggaccccctcatccggggcctgctggcccggcctgccaagctgcaggtgcaggaccagctgatgaatgaggagctgacagagcggctgtttgtgctgagcaacagcagcaccctggacctggccagcatcaacctgcagaggggccgggaccacggcctgcccggctacaatgagtggagggagttctgtggcctgccccggctggagaccccagctgacctgagcacagccatcgccagccgctctgtggccgacaagatcctggacctgtacaagcacccagacaacattgatgtgtggctgggcggcctggccgagaacttcctgccccgggccaggacaggccccctgtttgcctgcctgattggcaagcagatgaaggccctgagagatggagactggttctggtgggagaacagccacgtgttcacagatgcccagaggcgggagctggagaagcacagcctgagcagggtcatctgtgacaacacaggcctgaccagggtgcccatggatgccttccaggtgggcaagttcccagaagattttgagagctgtgacagcatcaccggcatgaacctggaggcctggagggagaccttcccccaggatgacaagtgtggcttccctgagagcgtggagaatggagactttgtgcactgtgaggagagcggccggcgggtgctggtgtacagctgcagacatggctatgagctgcagggccgggagcagctgacctgcacccaggagggctgggacttccagccccccctgtgcaaggatgtgaatgaatgtgctgatggagcccaccccccctgccacgccagcgcccgctgcaggaacaccaagggcggcttccagtgcctgtgtgccgacccctatgagctgggagatgatggccgcacctgtgtggacagcggccgcctgccccgggtgacctggatctccatgagcctggccgccctgctgattggaggctttgctggcctgaccagcaccgtcatctgccgctggaccaggacaggcaccaagagcaccctgcccatcagcgagaccggcggcggcaccccagagctgcgctgtgggaagcaccaggccgtgggcaccagcccccagagagctgctgcccaggacagcgagcaggagagcgctggcatggagggccgggacacccaccggctgccccgggccctgtag

SEQ ID NO: 173287 - DNA, 2283 bp, Artificial Sequence; identical to SEQ ID NO: 173286
  Description of Artificial Sequence: Synthetic coding sequence

SEQ ID NO: 173288 - DNA, 2631 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagccctggcccgctggctgccccctgtgtatgaagatggcttcagccagccccggggctggaaccctggcttcctgtacaacggcttccccctgccccctgtgcgggaggtgaccaggcatgtgatccaggtgtccaatgaggtggtgacagatgatgaccgctacagcgacctgctgatggcctggggccagtacatcgaccatgacatcgccttcaccccccagagcaccagcaaggccgcctttggaggcggcgctgactgccagatgacctgtgagaaccagaacccctgcttccccatccagctgcctgaggaggcccggcctgctgctggaacagcctgcctgcccttctaccgcagcagcgctgcctgtggcaccggggaccagggcgccctgtttggaaacctgagcacagccaacccccggcagcagatgaatggcctgaccagcttcctggatgccagcacagtgtatggcagcagccctgccctggagcggcagctgaggaactggaccagcgctgagggcctgctgcgggtgcacgcccggctgcgggacagcggccgggcctacctgccctttgtgcccccccgggccccagctgcctgtgcccctgagcccggcatccctggagagacccggggcccctgcttcctggccggagatggccgggccagcgaggtgcccagcctgacagccctgcacaccctgtggctgcgggagcacaaccggctggccgccgccctgaaggccctgaatgcccactggagcgcagatgctgtgtaccaggaggccaggaaggtggtgggcgccctgcaccagatcatcaccctgcgggactacatcccccgcatcctgggccctgaggccttccagcagtatgtgggcccctatgagggctatgacagcacagccaaccccaccgtgtccaatgtgttcagcacagctgccttccgcttcggccacgccaccatccaccccctggtgcggcggctggatgccagcttccaggagcacccagacctgcccggcctgtggctgcaccaggccttcttcagcccctggaccctgctgcggggcggctacaatgagtggagggagttctgtggcctgccccggctggagaccccagctgacctgagcacagccatcgccagccgctctgtggccgacaagatcctggacctgtacaagcacccagacaacattgatgtgtggctgggcggcctggccgagaacttcctgccccgggccaggacaggccccctgtttgcctgcctgattggcaagcagatgaaggccctgagagatggagactggttctggtgggagaacagccacgtgttcacagatgcccagaggcgggagctggagaagcacagcctgagcagggtcatctgtgacaacacaggcctgaccagggtgcccatggatgccttccaggtgggcaagttcccagaagattttgagagctgtgacagcatcaccggcatgaacctggaggcctggagggagaccttcccccaggatgacaagtgtggcttccctgagagcgtggagaatggagactttgtgcactgtgaggagagcggccggcgggtgctggtgtacagctgcagacatggctatgagctgcagggccgggagcagctgacctgcacccaggagggctgggacttccagccccccctgtgcaaggatgtgaatgaatgtgctgatggagcccaccccccctgccacgccagcgcccgctgcaggaacaccaagggcggcttccagtgcctgtgtgccgacccctatgagctgggagatgatggccgcacctgtgtggacagcggccgcctgccccgggtgacctggatctccatgagcctggccgccctgctgattggaggctttgctggcctgaccagcaccgtcatctgccgctggaccaggacaggcaccaagagcaccctgcccatcagcgagaccggcggcggcaccccagagctgcgctgtgggaagcaccaggccgtgggcaccagcccccagagagctgctgcccaggacagcgagcaggagagcgctggcatggagggccgggacacccaccggctgccccgggccctgtag

SEQ ID NO: 173289 - DNA, 519 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacagagaccacccccgctggggcgccagcaacacagcctag

SEQ ID NO: 173290 - DNA, 462 bp, Artificial Sequence
  Description of Artificial Sequence: Synthetic coding sequence
atgaatggcctgaccagcttcctggatgccagcacagtgtatggcagcagccctgccctggagcggcagctgaggaactggaccagcgctgagggcctgctgcgggtgcacgcccggctgcgggacagcggccgggcctacctgccctttgtgcccccccgggccccagctgcctgtgcccctgagcccggcatccctggagagacccggggcccctgcttcctggccggggacccccggcagaggggccccctgcctgatggaacagcccatgctgtggccgcccgggcccagcccccaggccgcggggcccagggcccccagtgtgccctggagcggggcagaagagtgcctgggggcgcccagggccggggccgcagcgccccagaccaccaccctgagggcctgcacccccaggaccccggcacccggggcctgcctgctgtgcggggcagcctgtag

SEQ ID NO: 173291 - DNA, 525 bp, Artificial Sequence
  Description of Artificial Sequence: Synthetic coding sequence
atgagggccctggccgtgctgtctgtgaccctggtgatggcctgcacagaggccttcttccccttcatcagccggggcaaggagctgctgtggggcaagccagaggagagccgggtgtcctctgtgctggaggagagcaagaggctggtggacacagccatgtatgccaccatgcagaggaacctgaagaagaggggcatcctgagccctgcccagctgctgtccttcagcaagctgcctgagcccaccagcggcgtgattgcccgggctgctgagatcatggagaccagcatccaggccatgaagaggaaggtgaacctgaagacccagcagagccagcaccccacagatgccctgtctgaggacctgctgagcatcatcgccaacatgagcggctgcctgccctacatgctgccccccaagtgccccaacacctgcctggccaacaagtaccggcccatcactggagcctgcaacaacaggaagatgaagtacaagccagaccacagcgagacagccaactag

SEQ ID NO: 173292 - DNA, 2295 bp, Artificial Sequence
  Description of Artificial Sequence: Synthetic coding sequence
atgaggcctgctgacctgctgcagctggtgctgctgctggacctgccccgggacctgggcggcatgggctgcagcagccccccctgtgagtgccaccaggaggaggacttccgggtgacctgcaaggacatccagaggatccccagcctgccccccagcacccagaccctgaagctgattgagacccacctgcggaccatccccagccacgccttcagcaacctgcccaacatcagccgcatctacgtgtccattgatgtgaccctgcagcagctggagagccacagcttctacaacctgagcaaggtgacccacatcgagatccggaacaccaggaacctgacctacattgatcctgatgccctgaaggagctgcccctgctgaagttcctgggcatcttcaacacaggcctgaagatgtttcctgacctgaccaaggtgtacagcacagacatcttcttcatcctggagatcacagacaacccctacatgaccagcatccctgtgaatgccttccagggcctgtgcaatgagaccctgaccctgaagctgtacaacaacggcttcacctctgtgcagggctacgccttcaacggcaccaagctggatgctgtgtacctgaacaagaacaagtacctgaccgtcatcgacaaggatgcctttggaggagtgtacagcggccccagcctgctggatgtgtcccagacctctgtgacagccctgcccagcaagggcctggagcacctgaaggagctgattgccaggaacacctggaccctgaagaagctgcccctgagcctgtccttcctgcacctgaccagggctgacctgagctaccccagccactgctgtgccttcaagaaccagaagaagatccggggcatcctggagagcctgatgtgcaatgaaagctccatgcagagcctgcggcagaggaagtctgtgaatgccctgaacagccccctgcaccaggagtatgaggagaacctgggggacagcatcgtgggctacaaggagaagagcaagttccaggacacccacaacaatgcccactactacgtgttctttgaggagcaggaggatgagatcatcggcttcggccaggagctgaagaacccccaggaggagaccctgcaggcctttgacagccactatgactacaccatctgtggggacagcgaggacatggtgtgcacccccaagagtgatgagttcaacccctgtgaggacatcatgggctacaagttcctgagaattgtggtgtggtttgtgtccctgctggccctgctgggcaatgtgtttgtgctgctgatcctgctgaccagccactacaagctgaatgtgccccgcttcctgatgtgcaacctggcctttgctgacttctgcatgggcatgtacctgctgctgattgcctctgtggacctgtacacccacagcgagtactacaaccacgccatcgactggcagacaggccctggctgcaacacagctggcttcttcaccgtgtttgccagcgagctgtctgtgtacaccctgaccgtcatcaccctggagcgctggtacgccatcacctttgccatgaggctggacaggaagatccggctgcggcatgcctgtgccatcatggtgggcggctgggtgtgctgcttcctgctggccctgctgcccctggtgggcatcagcagctatgccaaggtgtccatctgcctgcccatggacacagagacccccctggccctggcctacatcgtgtttgtgctgaccctgaacatcgtggccttcgtcatcgtgtgctgctgctacgtgaagatctacatcaccgtgaggaacccccagtacaaccctggggacaaggacaccaagatcgccaagaggatggctgtgctgatcttcacagacttcatctgcatggcccccatctccttctacgccctgagcgccatcctgaacaagcccctcatcaccgtgagcaacagcaagatcctgctggtgctcttctaccccctgaacagctgtgccaaccccttcctgtatgccatcttcaccaaggccttccagagagatgtgttcatcctgctgagcaagtttggcatctgcaagaggcaggcccaggcctaccggggccagagggtgccccccaagaacagcacagacatccaggtgcagaaggtgacccatgagatgaggcagggcctgcacaacatggaggatgtgtatgagctgattgagaacagccacctgacccccaagaagcagggccagatcagcgaggagtacatgcagacagtgctgtag

SEQ ID NO: 173293 - DNA, 762 bp, Artificial Sequence
  Description of Artificial Sequence: Synthetic coding sequence
atgaggcctgctgacctgctgcagctggtgctgctgctggacctgccccgggacctgggcggcatgggctgcagcagccccccctgtgagtgccaccaggaggaggacttccgggtgacctgcaaggacatccagaggatccccagcctgccccccagcacccagaccctgaagctgattgagacccacctgcggaccatccccagccacgccttcagcaacctgcccaacatcagccgcatctacgtgtccattgatgtgaccctgcagcagctggagagccacagcttctacaacctgagcaaggtgacccacatcgagatccggaacaccaggaacctgacctacattgatcctgatgccctgaaggagctgcccctgctgaagttcctgggcatcttcaacacaggcctgaagatgtttcctgacctgaccaaggtgtacagcacagacatcttcttcatcctggagatcacagacaacccctacatgaccagcatccctgtgaatgccttccagggcctgtgcaatgagaccctgaccctgaagctgtacaacaacggcttcacctctgtgcagggctacgccttcaacggcaccaagctggatgctgtgtacctgaacaagaacaagtacctgaccgtcatcgacaaggatgcctttggaggagtgtacagcggccccagcctgctgctgcccctgggcaggaagagcctgagctttgagacccagaaggcccccaggagctccatgcccagctag

SEQ ID NO: 173294 - DNA, 1236 bp, Artificial Sequence
  Description of Artificial Sequence: Synthetic coding sequence
atgaggcctgctgacctgctgcagctggtgctgctgctggacctgccccgggacctgggcggcatgggctgcagcagccccccctgtgagtgccaccaggaggaggacttccgggtgacctgcaaggacatccagaggatccccagcctgccccccagcacccagaccctgaagctgattgagacccacctgcgcatcgtggtgtggtttgtgtccctgctggccctgctgggcaatgtgtttgtgctgctgatcctgctgaccagccactacaagctgaatgtgccccgcttcctgatgtgcaacctggcctttgctgacttctgcatgggcatgtacctgctgctgattgcctctgtggacctgtacacccacagcgagtactacaaccacgccatcgactggcagacaggccctggctgcaacacagctggcttcttcaccgtgtttgccagcgagctgtctgtgtacaccctgaccgtcatcaccctggagcgctggtacgccatcacctttgccatgaggctggacaggaagatccggctgcggcatgcctgtgccatcatggtgggcggctgggtgtgctgcttcctgctggccctgctgcccctggtgggcatcagcagctatgccaaggtgtccatctgcctgcccatggacacagagacccccctggccctggcctacatcgtgtttgtgctgaccctgaacatcgtggcctttgtgattgtgtgctgctgctacgtgaagatctacatcaccgtgaggaacccccagtacaaccctggggacaaggacaccaagatcgccaagaggatggctgtgctgatcttcacagacttcatctgcatggcccccatctccttctacgccctgagcgccatcctgaacaagcccctcatcaccgtgagcaacagcaagatcctgctggtgctcttctaccccctgaacagctgtgccaaccccttcctgtatgccatcttcaccaaggccttccagagagatgtgttcatcctgctgagcaagtttggcatctgcaagaggcaggcccaggcctaccggggccagagggtgccccccaagaacagcacagacatccaggtgcagaaggtgacccatgagatgaggcagggcctgcacaacatggaggatgtgtatgagctgattgagaacagccacctgacccccaagaagcagggccagatcagcgaggagtacatgcagacagtgctgtag

SEQ ID NO: 173295 - DNA, 2295 bp, Artificial Sequence; identical to SEQ ID NO: 173292
  Description of Artificial Sequence: Synthetic coding sequence

SEQ ID NO: 173296 - DNA, 825 bp, Artificial Sequence
  Description of Artificial Sequence: Synthetic coding sequence
atgaggcctgctgacctgctgcagctggtgctgctgctggacctgccccgggacctgggcggcatgggctgcagcagccccccctgtgagtgccaccaggaggaggacttccgggtgacctgcaaggacatccagaggatccccagcctgccccccagcacccagaccctgaagctgattgagacccacctgcggaccatccccagccacgccttcagcaacctgcccaacatcagccgcatctacgtgtccattgatgtgaccctgcagcagctggagagccacagcttctacaacctgagcaaggtgacccacatcgagatccggaacaccaggaacctgacctacattgatcctgatgccctgaaggagctgcccctgctgaagttcctgggcatcttcaacacaggcctgaagatgtttcctgacctgaccaaggtgtacagcacagacatcttcttcatcctggagatcacagacaacccctacatgaccagcatccctgtgaatgccttccagggcctgtgcaatgagaccctgaccctgaagctgtacaacaacggcttcacctctgtgcagggctacgccttcaacggcaccaagctggatgctgtgtacctgaacaagaacaagtacctgaccgtcatcgacaaggatgcctttggaggagtgtacagcggccccagcctgctggtggagaatgtggccgtgtctgggaagggcttctgcaagagcctcttctcctggctgtaccgcctgcccctgggcaggaagagcctgagctttgagacccagaaggcccccaggagctccatgcccagctag

SEQ ID NO: 173297 - DNA, 912 bp, Artificial Sequence
  Description of Artificial Sequence: Synthetic coding sequence
atgtctgatgctgggggcggcaagaagccccctgtggacccccaggccggccctggccctggccctggccgggccgccggggagcggggcctgagcggcagcttccccctggtgctgaagaagctgatggagaaccccccccgggaggcccggctggacaaggagaagggcaaggagaagctggaggaggatgaggccgccgccgccagcaccatggctgtgtctgccagcctgatgccacccatctgggacaagaccatcccctatgatggagagagcttccacctggagtacatggacctggatgagttcctgctggagaatggcatcccagccagccccacccacctggcccacaacctgctgctgcctgtggccgagctggagggcaaggagagcgccagcagcagcacagccagcccccccagcagcagcacagccatcttccagcccagcgagaccgtgagcagcacagagagcagcctggagaaggagcgggagacccccagccccatcgaccccaactgtgtggaggtggatgtgaacttcaacccagaccctgctgacctggtgctgagctctgtgcctggaggagagctgttcaaccccaggaagcacaagtttgctgaggaggacctgaagccccagcccatgatcaagaaggccaagaaggtgtttgtgcctgatgagcagaaggatgagaagtactggaccaggaggaagaagaacaacgtggccgccaagaggagcagagatgcccggcggctgaaggagaaccagatcaccatccgggccgccttcctggagaaggaaaatacagccctgaggacagaggtggccgagctgaggaaggaggtgggcaagtgcaagaccatcgtgtccaaatatgagaccaagtatggccccctgtag

SEQ ID NO: 173298 - DNA, 555 bp, Artificial Sequence
  Description of Artificial Sequence: Synthetic coding sequence
tgattcatcttcctgccccggcccggcaccagcctgggccgcatcaggaaggctgacaaggagaagggcaaggagaagctggaggaggatgaggccgccgccgccagcaccatggctgtgtctgccagcctgatgccacccatctgggacaagaccatcccctatgatggagagagcttccacctggagtacatggacctggatgagttcctgctggagaatggcatcccagccagccccacccacctggcccacaacctgctgctgcctgtggccgagctggagggcaaggagagcgccagcagcagcacagccagcccccccagcagcagcacagccatcttccagcccagcgagaccgtgagcagcacagagagcagcctggagaaggagcgggagacccccagccccatcgaccccaactgtgtggaggtggatgtgaacttcaacccagaccctgctgacctggtgctgagctctgtgcctggaggagagctgttcaaccccaggaagcacaagtttgctgaggaggacctgaagccccagcccatgtag

SEQ ID NO: 173299 - DNA, 822 bp, Artificial Sequence
  Description of Artificial Sequence: Synthetic coding sequence
atggacatgcctgaggtgctgaagagcctgctggagcacagcctgccctggccagagaagaggacagacaaggagaagggcaaggagaagctggaggaggatgaggccgccgccgccagcaccatggctgtgtctgccagcctgatgccacccatctgggacaagaccatcccctatgatggagagagcttccacctggagtacatggacctggatgagttcctgctggagaatggcatcccagccagccccacccacctggcccacaacctgctgctgcctgtggccgagctggagggcaaggagagcgccagcagcagcacagccagcccccccagcagcagcacagccatcttccagcccagcgagaccgtgagcagcacagagagcagcctggagaaggagcgggagacccccagccccatcgaccccaactgtgtggaggtggatgtgaacttcaacccagaccctgctgacctggtgctgagctctgtgcctggaggagagctgttcaaccccaggaagcacaagtttgctgaggaggacctgaagccccagcccatgatcaagaaggccaagaaggtgtttgtgcctgatgagcagaaggatgagaagtactggaccaggaggaagaagaacaacgtggccgccaagaggagcagagatgcccggcggctgaaggagaaccagatcaccatccgggccgccttcctggagaaggaaaatacagccctgaggacagaggtggccgagctgaggaaggaggtgggcaagtgcaagaccatcgtgtccaaatatgagaccaagtatggccccctgtag

SEQ ID NO: 173300 - DNA, 822 bp, Artificial Sequence; identical to SEQ ID NO: 173299
  Description of Artificial Sequence: Synthetic coding sequence

SEQ ID NO: 173301 - DNA, 729 bp, Artificial Sequence
  Description of Artificial Sequence: Synthetic coding sequence
atgcctggcccctggctgctgctggccctggccctgaccctgaacctgactggagtgcctgggggccgggcccagcctgaggccgcccagcaggaggccgtgacagctgctgagcaccctggcctggatgacttcctgcggcaggtggagcggctgctcttcctgcgggagaacatccagaggctgcagggcgaccagggcgagcacagcgccagccagatcttccagagcgactggctgagcaagaggcagcaccctgggaagcgggaggaggaggaggaggagggcgtggaggaggaggaggaggaggagggcggcgctgtgggcccccacaagaggcagcaccctggccggcgggaggatgaggcctcctggagcgtggatgtgacccagcacaagaggcagcaccctggaagaagaagcccctggctggcctatgctgtgcccaagaggcagcaccctggccggcggctggccgaccccaaggcccagaggtcctgggaggaggaggaggaggaggaggagcgggaggaggacctgatgcctgagaagaggcagcaccctgggaagagggccctgggcggcccctgtggcccccagggcgcctacggccaggccggcctgctgctgggcctgctggatgacctgagccgcagccagggcgctgaggagaagaggcagcaccctggaagaagagctgcctgggtgcgggagcccctggaggagtag

SEQ ID NO: 173302 - DNA, 3075 bp, Artificial Sequence
  Description of Artificial Sequence: Synthetic coding sequence
atgggagaagatgatgctgccctgcgggccggcagccggggcctgagtgacccctgggccgacagcgtgggcgtgcggcccaggaccacagagcggcacatcgctgtgcacaagaggctggtgctggcctttgctgtgtccctggtggccctgctggccgtgaccatgctggccgtgctgctgagcctgcgctttgatgaatgtggggccagcgccaccccaggagcagatggcggccccagcggcttccctgagcggggcggcaatggcagcctgcccggcagcgcccggaggaaccaccacgccggcggggacagctggcagcctgaggccggcggcgtggccagccctggcaccaccagcgcccagccccccagcgaggaggagcgggagccctgggagccctggacccagctgcggctgagcggccacctgaagcccctgcactacaacctgatgctgacagccttcatggagaacttcaccttcagcggggaggtgaatgtggagatcgcctgcagaaatgccaccaggtatgtggtgctgcacgccagccgggtggccgtggagaaggtgcagctggccgaggaccgggccttcggggctgtgcctgtggccggcttcttcctgtacccccagacccaggtgctggtggtggtgctgaacagaaccctggatgcccagaggaactacaacctgaagatcatctacaatgccctgattgaaaatgagctgctgggcttcttccgcagcagctatgtgctgcacggggagcggcgcttcctgggcgtgacccagttcagccccacccacgccaggaaggccttcccctgctttgatgagcccatctacaaggccaccttcaagatcagcatcaagcaccaggccacctacctgagcctgagcaacatgcctgtggagacctctgtgtttgaagaagatggctgggtgacagaccacttcagccagacccccctgatgagcacctactacctggcctgggccatctgcaacttcacctaccgggagaccaccaccaagagcggcgtggtggtgcggctgtatgcccggccagatgccatccggcggggcagcggggactatgccctgcacatcaccaagaggctgattgagttctatgaggactacttcaaggtgccctacagcctgcccaagctggacctgctggccgtgcccaagcacccctatgctgccatggagaactggggcctgagcatctttgtggagcagaggatcctgctggaccccagcgtgagcagcatctcctacctgctggatgtgaccatggtgattgtgcatgagatctgccaccagtggtttggagacctggtgacccctgtgtggtgggaggatgtgtggctgaaggagggctttgcccactactttgaatttgtgggcacagactacctgtacccaggctggaacatggagaagcagcgcttcctgacagatgtgctgcacgaggtgatgctgctggatggcctggccagcagccaccctgtgtcccaggaggtgctgcaggccacagacatcgacagagtgtttgactggatcgcctacaagaagggagctgccctgatccgcatgctggccaacttcatgggccacagcgtcttccagaggggcctgcaggactacctgaccatccacaagtatggaaatgctgccagaaatgacctgtggaacaccctgtctgaggccctgaagagaaatggcaagtatgtgaacatccaggaggtgatggaccagtggaccctgcagatgggctaccctgtgatcaccatcctgggcaacaccacagcagaaaatcgcatcatcatcacccagcagcacttcatctatgacatcagcgccaagaccaaggccctgaagctgcagaacaacagctacctgtggcagatccccctgaccatcgtggtgggcaacagaagccacgtgtcctctgaggccatcatctgggtgagcaacaagtctgagcaccaccgcatcacctacctggacaagggctcctggctgctgggcaacatcaaccagacaggctacttccgggtgaactatgacctgaggaactggaggctgctgattgaccagctgatcagaaatcatgaggtgctgtctgtgagcaacagagctggcctgattgatgatgccttcagcctggcccgggccggctacctgccccagaacatccccctggagatcatccgctacctgtctgaggagaaggacttcctgccctggcacgccgccagccgggccctgtaccccctggacaagctgctggacaggatggagaactacaacatcttcaatgagtacatcctgaagcaggtggccaccacctacatcaagctgggctggcccaagaacaacttcaacggcagcctggtgcaggccagctaccagcacgaggagctgcggcgggaggtgatcatgctggcctgcagctttggaaacaagcactgccaccagcaggccagcaccctcatcagtgactggatcagcagcaacagaaaccgcatccccctgaatgtgcgggacatcgtgtactgcacaggagtgtccctgctggatgaagatgtgtgggagttcatctggatgaagttccacagcaccacagctgtgtctgagaagaagatcctgctggaggccctgacctgcagtgatgacaggaacctgctgaaccggctgctgaacctgagcctgaacagcgaggtggtgctggaccaggatgccattgatgtgatcatccacgtggccaggaacccccacggccgggacctggcctggaagttcttccgggacaagtggaagatcctgaacaccaggtatggagaggccctcttcatgaacagcaagctgatctctggagtgacagagttcctgaacacagaaggagagctgaaggagctgaagaacttcatgaagaactatgatggagtggccgccgccagcttcagcagagctgtggagaccgtggaggccaacgtgcgctggaagatgctgtaccaggatgagctgttccagtggctgggcaaggccctgcggcactag

SEQ ID NO: 173303 - DNA, 1197 bp, Artificial Sequence
  Description of Artificial Sequence: Synthetic coding sequence
atggagaatgaaacagtgtctgagctgaaccagacccagctgcagcccagggctgtggtggccctggagtaccaggtggtgaccatcctgctggtgctgatcatctgtggcctgggcatcgtgggcaacatcatggtggtgctggtggtgatgaggaccaagcacatgaggacccccaccaactgctacctggtgtccctggccgtggccgacctgatggtgctggtggccgccggcctgcccaacatcacagacagcatctacggctcctgggtgtatggctacgtgggctgcctgtgcatcacctacctgcagtacctgggcatcaatgccagcagctgcagcatcacagccttcaccatcgagcgctacatcgccatctgccaccccatcaaggcccagttcctgtgcaccttcagccgggccaagaagatcatcatctttgtgtgggccttcaccagcctgtactgcatgctgtggttcttcctgctggacctgaacatcagcacctacaaggatgccatcgtcatcagctgtggctacaagatcagcaggaactactacagccccatctacctgatggactttggagtcttctacgtggtgcccatgatcctggccaccgtgctgtatggcttcatcgcccgcatcctcttcctgaaccccatccccagcgaccccaaggagaacagcaagacctggaagaatgacagcacccaccagaacaccaacctgaatgtgaacaccagcaaccgctgcttcaacagcacagtgagcagcaggaagcaggtgaccaagatgctggccgtggtggtgatcctgtttgccctgctgtggatgccctaccgcaccctggtggtggtgaacagcttcctgagcagccccttccaggagaactggttcctgctcttctgccgcatctgcatctacctgaacagcgccatcaaccctgtgatctacaacctgatgagccagaagttccgggccgccttcaggaagctgtgcaactgcaagcagaagcccacagagaagccagccaactacagcgtggccctgaactacagcgtcatcaaggagagtgaccacttcagcacagagctggatgacatcaccgtgacagacacctacctgagcgccaccaaggtgtcctttgatgacacctgcctggccagcgaggtgtccttcagccagagctag

SEQ ID NO: 173304 - DNA, 1197 bp, Artificial Sequence; identical to SEQ ID NO: 173303
  Description of Artificial Sequence: Synthetic coding sequence

SEQ ID NO: 173305 - DNA, 1128 bp, Artificial Sequence
  Description of Artificial Sequence: Synthetic coding sequence
atggaggatgagatgcccaagaccctgtatgtgggcaacctgagcagagatgtgacagaggccctgatcctgcagctgttcagccagatcggcccctgcaagaactgcaagatgatcatggacacagctggaaatgacccctactgctttgtggagttccacgagcacagacatgctgctgctgccctggccgccatgaatggaaggaagatcatgggcaaggaggtgaaggtgaactgggccaccacccccagcagccagaagaaggacaccagcaaccacttccacgtgtttgtgggggacctgagccctgagatcaccacagaggacatcaaggccgcctttgcccccttcggccgcatcagtgatgcccgggtggtgaaggacatggccaccgggaagagcaagggctacggctttgtgtccttcttcaacaagtgggatgctgaaaatgccatccagcagatgggcggccagtggctgggcggccggcagatccgcaccaactgggccaccaggaagcccccagcccccaagagcacctatgagagcaacaccaagcagctgtcctatgatgaggtggtgaaccagagcagccccagcaactgcaccgtgtactgcggcggcgtgaccagcggcctgacagagcagctgatgaggcagaccttcagccccttcggccagatcatggagatccgggtcttcccagacaagggctacagctttgtgcgcttcaacagccatgagagcgctgcccacgccatcgtgtctgtgaatggcaccaccatcgagggccacgtggtgaagtgctactggggcaaggagaccctggacatgatcaaccctgtgcagcagcagaaccagatcggctacccccagccctacggccagtggggccagtggtatggaaatgcccagcagatcggccagtacatgcccaacggctggcaggtgcctgcctacggcatgtatggccaggcctggaaccagcagggcttcaaccagacccagagcagcgccccctggatgggccccaactatggagtgcagcccccccagggccagaatggctccatgctgcccaaccagcccagcggctacagagtggccggctatgagacccagtag

SEQ ID NO: 173306 - DNA, 1161 bp, Artificial Sequence
  Description of Artificial Sequence: Synthetic coding sequence
atggaggatgagatgcccaagaccctgtatgtgggcaacctgagcagagatgtgacagaggccctgatcctgcagctgttcagccagatcggcccctgcaagaactgcaagatgatcatggacacagctggaaatgacccctactgctttgtggagttccacgagcacagacatgctgctgctgccctggccgccatgaatggaaggaagatcatgggcaaggaggtgaaggtgaactgggccaccacccccagcagccagaagaaggacaccagcagcagcacagtggtgtccacccagaggagccaggaccacttccacgtgtttgtgggggacctgagccctgagatcaccacagaggacatcaaggccgcctttgcccccttcggccgcatcagtgatgcccgggtggtgaaggacatggccaccgggaagagcaagggctacggctttgtgtccttcttcaacaagtgggatgctgaaaatgccatccagcagatgggcggccagtggctgggcggccggcagatccgcaccaactgggccaccaggaagcccccagcccccaagagcacctatgagagcaacaccaagcagctgtcctatgatgaggtggtgaaccagagcagccccagcaactgcaccgtgtactgcggcggcgtgaccagcggcctgacagagcagctgatgaggcagaccttcagccccttcggccagatcatggagatccgggtcttcccagacaagggctacagctttgtgcgcttcaacagccatgaatctgctgcccacgccatcgtgtctgtgaatggcaccaccatcgagggccacgtggtgaagtgctactggggcaaggagaccctggacatgatcaaccctgtgcagcagcagaaccagatcggctacccccagccctacggccagtggggccagtggtatggaaatgcccagcagatcggccagtacatgcccaacggctggcaggtgcctgcctacggcatgtatggccaggcctggaaccagcagggcttcaaccagacccagagcagcgccccctggatgggccccaactacggcgtgcagcccccccagggccagaatggctccatgctgcccaaccagcccagcggctacagagtggccggctatgagacccagtag

SEQ ID NO: 173307 - DNA, 1392 bp, Artificial Sequence
  Description of Artificial Sequence: Synthetic coding sequence
cccctggtgtcccgggagacccccctgagctgcagccacaaccggctgaatgacctgggcggcagcgagggccagggcgccggccctggaggagctgctgccacagctgctgccatggaggatgagatgcccaagaccctgtatgtgggcaacctgagcagagatgtgacagaggccctgatcctgcagctgttcagccagatcggcccctgcaagaactgcaagatgatcatggacacagctggaaatgacccctactgctttgtggagttccacgagcacagacatgctgctgctgccctggccgccatgaatggaaggaagatcatgggcaaggaggtgaaggtgaactgggccaccacccccagcagccagaagaaggacaccagcagcagcacagtggtgtccacccagaggagccaggaccacttccacgtgtttgtgggggacctgagccctgagatcaccacagaggacatcaaggccgcctttgcccccttcggccgcatcagtgatgcccgggtggtgaaggacatggccaccgggaagagcaagggctacggctttgtgtccttcttcaacaagtgggatgctgaaaatgccatccagcagatgggcggccagtggctgggcggccggcagatccgcaccaactgggccaccaggaagcccccagcccccaagagcacctatgagtgccgctgcatcggggaggagaaggagatgtggaactttggagagaagtatgcccgcttctgcagccggcggctgattgctgagattgatgagaagcagatcaagaccaccatccagaagagcaacaccaagcagctgtcctatgatgaggtggtgaaccagagcagccccagcaactgcaccgtgtactgcggcggcgtgaccagcggcctgacagagcagctgatgaggcagaccttcagccccttcggccagatcatggagatccgggtcttcccagacaagggctacagctttgtgcgcttcaacagccatgaatctgctgcccacgccatcgtgtctgtgaatggcaccaccatcgagggccacgtggtgaagtgctactggggcaaggagaccctggacatgatcaaccctgtgcagcagaaccagatcggctacccccagccctacggccagtggggccagtggtatggaaatgcccagcagatcggccagtacatgcccaacggctggcaggtgcctgcctacggcatgtatggccaggcctggaaccagcagggcttcaaccagacccagagcagcgccccctggatgggccccaactatggagtgcagcccccccagggccagaatggctccatgctgcccaaccagcccagcggctacagagtggccggctatgagacccagtag

SEQ ID NO: 173308 - DNA, 258 bp, Artificial Sequence
  Description of Artificial Sequence: Synthetic coding sequence
atgatcacagagcacaccagcaatgacccctactgctttgtggagttctatgagcacagagatgctgctgctgccctggccgccatgaatggaaggaagatcctgggcaaggaggtgaaggtgaactgggccaccacccccagcagccagaagaaggacaccagcaaccacttccacgtgtttgtgggggacctgagccctgagatcaccacagaggacatcaagagcgcctttgccccctttgggaagatctcctag

SEQ ID NO: 173309 - DNA, 759 bp, Artificial Sequence
  Description of Artificial Sequence: Synthetic coding sequence
atggatgcccgggtggtgaaggacatggccaccgggaagagcaagggctacggctttgtgtccttctacaacaagctggatgctgaaaatgccatcgtgcacatgggcggccagtggctgggcggccggcagatccgcaccaactgggccaccaggaagcccccagcccccaagagcacccaggagaacaacaccaagcagctgcgctttgaagatgtggtgaaccagagcagccccaagaactgcaccgtgtactgcggcggcatcgccagcggcctgacagaccagctgatgaggcagaccttcagccccttcggccagatcatggagatccgggtcttccctgagaagggctacagctttgtgcgcttcagcacccatgaatctgctgcccacgccatcgtgtctgtgaatggcaccaccatcgagggccacgtggtgaagtgctactggggcaaggagagcccagacatgaccaagaacttccagcaggtggactacagccagtggggccagtggagccaggtgtatggcaacccccagcagtatggccagtacatggccaacggctggcaggtgcccccctacggcgtgtatggccagccctggaaccagcagggcttcggcgtggaccagagccccagcgctgcctggatgggcggctttggagcccagcccccccagggccaggcccctcctcctgtgattcctccacccaaccaggccggctacggcatggccagctaccagacccagtag

SEQ ID NO: 173310 - DNA, 1179 bp, Artificial Sequence
  Description of Artificial Sequence: Synthetic coding sequence
atgatggaggatgatggccagcccaggaccctgtatgtgggcaacctgagcagagatgtgacagaggtgctgatcctgcagctgttcagccagatcggcccctgcaagagctgcaagatgatcacagagcagcctgacagccggcgggtgaacagctctgtgggcttctctgtgctgcagcacaccagcaatgacccctactgctttgtggagttctatgagcacagagatgctgctgctgccctggccgccatgaatggaaggaagatcctgggcaaggaggtgaaggtgaactgggccaccacccccagcagccagaagaaggacaccagcaaccacttccacgtgtttgtgggggacctgagccctgagatcaccacagaggacatcaagagcgcctttgccccctttgggaagatcagtgatgcccgggtggtgaaggacatggccaccgggaagagcaagggctacggctttgtgtccttctacaacaagctggatgctgaaaatgccatcgtgcacatgggcggccagtggctgggcggccggcagatccgcaccaactgggccaccaggaagcccccagcccccaagagcacccaggagaacaacaccaagcagctgcgctttgaagatgtggtgaaccagagcagccccaagaactgcaccgtgtactgcggcggcatcgccagcggcctgacagaccagctgatgaggcagaccttcagccccttcggccagatcatggagatccgggtcttccctgagaagggctacagctttgtgcgcttcagcacccatgaatctgctgcccacgccatcgtgtctgtgaatggcaccaccatcgagggccacgtggtgaagtgctactggggcaaggagagcccagacatgaccaagaacttccagcaggtggactacagccagtggggccagtggagccaggtgtatggcaacccccagcagtatggccagtacatggccaacggctggcaggtgcccccctacggcgtgtatggccagccctggaaccagcagggcttcggcgtggaccagagccccagcgctgcctggatgggcggctttggagcccagcccccccagggccaggcccctcctcctgtgattcctccacccaaccaggccggctacggcatggccagctaccagacccagtag

SEQ ID NO: 173311 - DNA, 399 bp, Artificial Sequence
  Description of Artificial Sequence: Synthetic coding sequence
atgatcacagagcacaccagcaatgacccctactgctttgtggagttctatgagcacagagatgctgctgctgccctggccgccatgaatggaaggaagatcctgggcaaggaggtgaaggtgaactgggccaccacccccagcagccagaagaaggacaccagcaaccacttccacgtgtttgtgggggacctgagccctgagatcaccacagaggacatcaagagcgcctttgccccctttgggaagatcagtgatgcccgggtggtgaaggacatggccaccgggaagagcaagggctacggctttgtgtccttctacaacaagctggatgctgaaaatgccatcgtgcacatgggcggccagtggctgggcggccggcagatccgcaccaactag

SEQ ID NO: 173312 - DNA, 1128 bp, Artificial Sequence
  Description of Artificial Sequence: Synthetic coding sequence
atgatggaggatgatggccagcccaggaccctgtatgtgggcaacctgagcagagatgtgacagaggtgctgatcctgcagctgttcagccagatcggcccctgcaagagctgcaagatgatcacagagcacaccagcaatgacccctactgctttgtggagttctatgagcacagagatgctgctgctgccctggccgccatgaatggaaggaagatcctgggcaaggaggtgaaggtgaactgggccaccacccccagcagccagaagaaggacaccagcaaccacttccacgtgtttgtgggggacctgagccctgagatcaccacagaggacatcaagagcgcctttgccccctttgggaagatcagtgatgcccgggtggtgaaggacatggccaccgggaagagcaagggctacggctttgtgtccttctacaacaagctggatgctgaaaatgccatcgtgcacatgggcggccagtggctgggcggccggcagatccgcaccaactgggccaccaggaagcccccagcccccaagagcacccaggagaacaacaccaagcagctgcgctttgaagatgtggtgaaccagagcagccccaagaactgcaccgtgtactgcggcggcatcgccagcggcctgacagaccagctgatgaggcagaccttcagccccttcggccagatcatggagatccgggtcttccctgagaagggctacagctttgtgcgcttcagcacccatgagagcgctgcccacgccatcgtgtctgtgaatggcaccaccatcgagggccacgtggtgaagtgctactggggcaaggagagcccagacatgaccaagaacttccagcaggtggactacagccagtggggccagtggagccaggtgtatggcaacccccagcagtatggccagtacatggccaacggctggcaggtgcccccctatggagtgtatggccagccctggaaccagcagggctttggagtggaccagagccccagcgctgcctggatgggcggctttggagcccagcccccccagggccaggcccctcctcctgtgatccccccacccaaccaggccggctacggcatggccagctaccagacccagtag

SEQ ID NO: 173313 - DNA, 1776 bp, Artificial Sequence
  Description of Artificial Sequence: Synthetic coding sequence
atggccagcaagtgcagcagcgagaggaagagcaggaccagcctgaccctgaaccagaagctggagatgatcaagctgtctgaggagggcatgagcaaggccgagatcggccggcggctgggcctgctgcggcagacagtgtcccaggtggtgaatgccaaggagaagttcctgaaggaggtgaagagcgccacccccatgaacaccaggatgatcaggaagaggaacagcctgattgctgacatggagaaggtgctggtggtgtggattgaggaccagaccagcaggaacatccccctgagccagagcctcatccagaacaaggccctgaccctcttcaacagcatgaaggccgagcggggcgtggaggccgctgaggagaagtttgaggccagccggggctggttcatgaggttcaaggagaggagccacttccacaacatcaaggcccagggcgaggccgccagcgcagatgtggaggccgccgccagctacccagaggccctggccaagatcattgatgagggcggctacaccaagcagcagatcttcaacgtggatgaaacagccttctactggaagaagatgcccagcaggaccttcatcgcccgggaggagaagtctgtgcccggcttcaaggccagcaaggaccggctgaccctgctgctgggcgccaatgctgctggggacttcaagctgaagcccatgctgatctaccacagcgagaacccccgggccctgaagaactacaccaagagcaccctgcctgtgctgtacaagtggaacagcaaggccaggatgacagcccacctgttcaccgcctggttcacagagtacttcaagcccaccgtggagacctactgcagcgagaagaagatccccttcaagatcctgctgctgattgacaatgcccccagccacccccgggccctgatggagatctatgaggagatcaacgtcatcttcatgcctgccaacaccaccagcatcctgcagcccatggaccagggcgtcatcagcaccttcaagagctactacctgaggaacaccttccacaaggccctggccgccatggacagtgatgtgtctgatggcagcggccagagcaagctgaagaccttctggaagggcttcaccatcctggatgccatcaagaacatccgggacagctgggaggaggtgaagctgagcaccctgactggagtgtggaagaagctgatccccaccctgattgatgattatgagggcttcaagacctctgtggaggaggtgtctgcagatgtggtggagatcgccaaggagctggagctggaggtggagccagaagatgtgacagagctgctgcagagccatgacaagaccctgacagatgaggagctgttcctgatggatgcccagaggaagtggttcctggagatggagagcaccccaggagaagatgctgtgaacatcgtggagatgaccaccaaggacctggagtactacatcaacctggtggacaaggctgctgctggctttgaaagaattgacagcaactttgagaggagcagcacagtgggcaagatgctgagcaacagcatcgcctgctaccgggagatcttccacgagaggaagagccagctgatgaggaaggccagccccatgagctacttcaggaagctgccccagcccccccagcccagcgctgccaccaccctgaccagccagcagcccagcaccagccggcaggaccccccaccagccaagagggtgcggctgacagagggcagtgactag

SEQ ID NO: 173314 - DNA, 1578 bp, Artificial Sequence
  Description of Artificial Sequence: Synthetic coding sequence
atgctgggcaagaggaagagggtggtgctgaccatcaaggacaagctggacatcatcaagaagctggaggagggcatctccttcaagaagctgtctgtggtgtatggaattggagagagcacagtgcgggacatcaagaagaacaaggagcgcatcatcaactatgccaacagcagtgaccccaccagcggcgtgtccaagaggaagtccatgaagagcagcacctatgaggagctggacagagtgatgattgagtggttcaaccagcagaagacagatggcatccctgtgtctggcaccatctgtgccaagcaggccaagttcttctttgatgccctgggcatggagggggacttcaatgccagcagcggctggctgacccgcttcaagcagagacatggcatccccaaggctgctgggaagggcaccaagctgaagggagatgaaacagctgcccgggagttctgtggcagcttccaggagtttgtggagaaggagaacctgcagcctgagcagatctacggggctgaccagacaggcctcttctggaagtgcctgcccagcaggaccctgaccctggagacagaccagagcaccagcggctgccgcagcagccgggagcgcatcatcatcatgtgctgtgccaatgccaccggcctgcacaagctgaacctgtgtgtggtgggcaaggccaagaagccccgggccttcaagggcacagacctgagcaacctgcctgtgacctactacagccagaagggggcctggattgagcagagcgtcttccggcagtggtttgagaagtactttgtgccccaggtgcagaagcacctgaagagcaagggcctgctggagaaggctgtgctgctgctggacttccccccagcccggcccaatgaggagatgctgagcagtgatgatggccgcatcatcgtgaagtacctgccccccaacgtgaccagcctcatccagcccatgagccagggcgtgctggccaccgtgaagcgctactaccgggccggcctgctgcagaagtacatggatgagggcaatgaccccaagatcttctggaagaacctgactgtgctggatgccatctatgaggtgtcccgggcctggaacatggtgaagagcagcaccatcaccaaggcctggaagaagctgtttcctggaaatgaggagaacagcggcatgaacattgatgaaggagccatcctggccgccaacctggccaccgtgctgcagaacacagaagaatgtgagcacgtggacatcgagaacatcgaccagtggtttgacagccgcagcagtgacagcagctgccaggtgctgacagattctgagagcgctgaggaccagaccaaggctgctgagcagaagcccagcagcaagagcaggaagacagagctgaaccctgagaagcacatcagccacaaggccgccctggagtggacagagaacctgctggactacctggagcagcaggatgacatgctgctgagtgacaagctggtgctgcggcggctgcggaccatcatcaggaagaagcagaagatccagaacaacaagaaccactag

SEQ ID NO: 173315 - DNA, 1650 bp, Artificial Sequence
  Description of Artificial Sequence: Synthetic coding sequence
atgaacaagaggggcaagtacaccaccctgaacctggaggagaagatgaaggtgctgagccgcatcgaggccggccgcagcctgaagtctgtgatggatgaatttggcatcagcaagagcaccttctatgacatcaagaagaacaagaagctgatcctggactttgtgctgaagcaggacatgcccctggtgggcgctgagaagaggaagaggaccactggagccaagtatggagatgtggatgatgctgtgtacatgtggtaccagcagaagaggtctgctggggtgcctgtgcggggcgtggagctgcaggccgctgctgagagatttgcccgctgcttcggccgcacagacttcaaggccagcacaggctggctgttccgcttcaggaacagacatgccatcggcaacaggaagggctgtggggagcaggtgctgagctctgtgtctgaaaatgtggagcccttccggcagaagctgtccatgatcatcaaggaggagaagctgtgcctggcccagctgtacagcggagatgaaacagacctcttctggaagtccatgcctgagaacagccaggccagcaggaaggacatctgcctgcccgggaagaagatcaacaaggagcggctgagcgccttcctgtgtgccaatgctgatggcacccacaagctgaagagcatcatcatcggcaagagcaagctgcccaagtctgtgaaggaggacaccagcaccctgcccgtcatctacaagcccagcaaggatgtgtggttcacccgggagctgttcagcgagtggttcttccagaactttgtgcctgaggtgcgccacttccagctgaatgtgctgcgcttccatgatgaagatgtgcgggccctgctgctgctggacagctgcccagcccaccccagcagcgagagcctgaccagtgaagatggccgcatcaagtgcatgttcttcccccacaacaccagcaccctcatccagcccatgaaccagggcgtcatcctgagctgcaagaggctgtaccgctggaagcagctggaggagagcctggtgatctttgaggagagtgatgatgagcaggagaagggggacaagggcgtgtccaagatcaagatctacaacatcaagagcgccatcttcaactgggccaagtcctgggaggaggtgaagcagatcaccatcgccaatgcctgggagaacctgctgtacaagaaggagccagaatatgacttccagggcctggagcacggggactaccgggagatcctggagaagtgtggggagctggagaccaagctggatgatgacagagtgtggctgaatggagatgaggagaagggctgcctgctgaagaccaagggcggcatcaccaaggaggtggtgcagaagggcggggaggccgagaagcagacagctgagttcaagctgtctgctgtgcgggagagcctggactacctgctggactttgtggatgccaccccagagttccagcgcttccacttcaccctgaaggagatgcagcaggagatcgtgaagaagcagttccagagcaagatccacagccgcatcggcagcttcctgaagccccggccccacaacatcaaggacagcttcagcggccccagcaccagcggcagcaaccactag

SEQ ID NO: 173316 - DNA, 1650 bp, Artificial Sequence; identical to SEQ ID NO: 173315
  Description of Artificial Sequence: Synthetic coding sequence

SEQ ID NO: 173317 - DNA, 1536 bp, Artificial Sequence
  Description of Artificial Sequence: Synthetic coding sequence
atgaacaagaggggcaagtacaccaccctgaacctggaggagaagatgaaggtgctgagccgcatcgaggccggccgcagcctgaagtctgtgatggatgaatttggcatcagcaagagcaccttctatgacatcaagaagaacaagaagctgatcctggactttgtgctgaagcaggacatgcccctggtgggcgctgagaagaggaagaggaccactggagccaagtatggagatgtggatgatgctgtgtacatgtggtaccagcagaagaggtctgctggggtgcctgtgcggggcgtggagctgcaggccgctgctgagagatttgcccgctgcttcggccgcacagacttcaaggccagcacaggctggctgttccgcttcaggaacagacatgccatcggcaacaggaagggctgtggggagcaggtgctgagctctgtgtctgaaaatgtggagcccttccggcagaagctgtccatgatcatcaaggaggagaagctgtgcctggcccagctgtacagcggagatgaaacagacctcttctggaagtccatgcctgagaacagccaggccagcaggaaggacatctgcctgcccgggaagaagatcaacaaggagcggctgagcgccttcctgtgtgccaatgctgatggcacccacaagctgaagagcatcatcatcggcaagagcaagctgcccaagtctgtgaaggaggacaccagcaccctgcccgtcatctacaagcccagcaaggatgtgtggttcacccgggagctgttcagcgagtggttcttccagaactttgtgcctgaggtgcgccacttccagctgaatgtgctgcgcttccatgatgaagatgtgcgggccctgctgctgctggacagctgcccagcccaccccagcagcgagagcctgaccagtgaagatggccgcatcaagtgcatgttcttcccccacaacaccagcaccctcatccagcccatgaaccagggcgtcatcctgagctgcaagaggctgtaccgctggaagcagctggaggagagcctggtgatctttgaggagagtgatgatgagcaggagaagggggacaagggcgtgtccaagatcaagatctacaacatcaagagcgccatcttcaactgggccaagtcctgggaggaggtgaagcagatcaccatcgccaatgcctgggagaacctgctgtacaagaaggagccagaatatgacttccagggcctggagcacggggactaccgggagatcctggagaagtgtggggagctggagaccaagctggatgatgacagagtgtggctgaatggagatgaggagaagggctgcctgctgaagaccaagggcggcatcaccaaggaggtggtgcagaagggcggggaggccgagaagcagacagctgagttcaagctgtctgctgtgcgggagagcctggactacctgctggactttgtggatgccaccccagagttccagcgcttccacttcaccctgtgtgagttcagtgatgacagctag

SEQ ID NO: 173318 - DNA, 1644 bp, Artificial Sequence
  Description of Artificial Sequence: Synthetic coding sequence
atgaccagcgctgccccagccaagaagccctacaggaaggcccctcctgagcaccgggagctgcggctggagatccctggcagccggctggagcaggaggagcccctgacagatgctgagaggatgaagctgctgcaggaggagaatgaggagctgcggcggcggctggccagcgccaccaggagaacagaggccctggagcgggagctggagatcggccaggactgcctggagctggagctgggccagagccgggaggagctggacaagttcaaggacaagttccggcggctgcagaacagctacacagccagccagaggaccaaccaggagctggaggacaagctgcacaccctcatcaagaaggccgagatggacaggaagaccctggactgggagatcgtggagctgaccaacaagctgctggatgccaagaacaccatcaacaagctggaggagctgaatgaaagataccgcctggactgcaacctggccgtgcagctgctgaagtgcaacaagagccacttcaggaaccacaagtttgctgacctgccctgtgagctgcaggacatggtgaggaagcacctgcacagcggccaggaggccgccagccctggccctgcccccagcctggcccctggagctgtggtgcccaccagcgtcatcgcccgggtgctggagaagccagagagcctgctgctgaacagcgcccagagcggcagcgctggccggcccctggccgaggatgtgtttgtgcacgtggacatgtctgaaggagtgcctggggaccctgccagccccccagcccctggcagccccaccccccagcccaacggggagtgccacagcctgggcacagcccggggcagccctgaggaggagctgcccctgcctgcctttgagaagctgaacccctaccccacccccagccccccccaccccctgtacccaggaagaagagtcatcgagttcagcgaggacaaggtgcgcatccccaggaacagccccctgcccaactgcacctacgccacccggcaggccatcagcctgagcctggtggaggagggcagcgagcgggcccggcccagccctgtgcccagcaccccagccagcgcccaggccagcccccaccaccagcccagccctgcccccctgaccctgagcgccccagccagcagcgccagcagcgaggaggacctgctggtgtcctggcagagggcctttgtggacaggaccccacctcctgctgctgtggcccagaggacagccttcggcagagatgccctgcctgagctgcagaggcactttgcccacagccctgctgacagagatgaggtggtgcaggcccccagcgcccggcctgaggagagcgagctgctgctgcccacagagccagattctggcttcccccgggaggaggaggagctgaacctgcccatcagccctgaggaggagcggcagagcctgctgcccatcaacagaggaacagaggagggccctggcaccagccacacagagggccgggcctggcccctgcccagcagcagccggccccagaggagccccaagaggatgggcgtgcaccacctgcacaggaaggacagcctgacccaggcccaggagcagggcaacctgctgaactag

SEQ ID NO: 173319 - DNA, 1644 bp, Artificial Sequence; identical to SEQ ID NO: 173318
  Description of Artificial Sequence: Synthetic coding sequence

SEQ ID NO: 173320 - DNA, 1674 bp, Artificial Sequence
  Description of Artificial Sequence: Synthetic coding sequence
atgaccagcgctgccccagccaagaagccctacaggaaggcccctcctgagcaccgggagctgcggctggagatccctggcagccggctggagcaggaggagcccctgacagatgctgagaggatgaagctgctgcaggaggagaatgaggagctgcggcggcggctggccagcgccaccaggagaacagaggccctggagcgggagctggagatcggccaggactgcctggagctggagctgggccagagccgggaggagctggacaagttcaaggacaagttccggcggctgcagaacagctacacagccagccagaggaccaaccaggagctggaggacaagctgcacaccctggccagcctgagccacagctggatctttgccatcaagaaggccgagatggacaggaagaccctggactgggagatcgtggagctgaccaacaagctgctggatgccaagaacaccatcaacaagctggaggagctgaatgaaagataccgcctggactgcaacctggccgtgcagctgctgaagtgcaacaagagccacttcaggaaccacaagtttgctgacctgccctgtgagctgcaggacatggtgaggaagcacctgcacagcggccaggaggccgccagccctggccctgcccccagcctggcccctggagctgtggtgcccaccagcgtcatcgcccgggtgctggagaagccagagagcctgctgctgaacagcgcccagagcggcagcgctggccggcccctggccgaggatgtgtttgtgcacgtggacatgtctgaaggagtgcctggggaccctgccagccccccagcccctggcagccccaccccccagcccaacggggagtgccacagcctgggcacagcccggggcagccctgaggaggagctgcccctgcctgcctttgagaagctgaacccctaccccacccccagccccccccaccccctgtacccaggaagaagagtcatcgagttcagcgaggacaaggtgcgcatccccaggaacagccccctgcccaactgcacctacgccacccggcaggccatcagcctgagcctggtggaggagggcagcgagcgggcccggcccagccctgtgcccagcaccccagccagcgcccaggccagcccccaccaccagcccagccctgcccccctgaccctgagcgccccagccagcagcgccagcagcgaggaggacctgctggtgtcctggcagagggcctttgtggacaggaccccacctcctgctgctgtggcccagaggacagccttcggcagagatgccctgcctgagctgcagaggcactttgcccacagccctgctgacagagatgaggtggtgcaggcccccagcgcccggcctgaggagagcgagctgctgctgcccacagagccagattctggcttcccccgggaggaggaggagctgaacctgcccatcagccctgaggaggagcggcagagcctgctgcccatcaacagaggaacagaggagggccctggcaccagccacacagagggccgggcctggcccctgcccagcagcagccggccccagaggagccccaagaggatgggcgtgcaccacctgcacaggaaggacagcctgacccaggcccaggagcagggcaacctgctgaactag

SEQ ID NO: 173321 - DNA, 1674 bp, Artificial Sequence; identical to SEQ ID NO: 173320
  Description of Artificial Sequence: Synthetic coding sequence

SEQ ID NO: 173322 - DNA, 1644 bp, Artificial Sequence; identical to SEQ ID NO: 173318
  Description of Artificial Sequence: Synthetic coding sequence

SEQ ID NO: 173323 - DNA, 1644 bp, Artificial Sequence; identical to SEQ ID NO: 173318
  Description of Artificial Sequence: Synthetic coding sequence

SEQ ID NO: 173324 - DNA, 1644 bp, Artificial Sequence; identical to SEQ ID NO: 173318
  Description of Artificial Sequence: Synthetic coding sequence

SEQ ID NO: 173325 - DNA, 1674 bp, Artificial Sequence; identical to SEQ ID NO: 173320
  Description of Artificial Sequence: Synthetic coding sequence

SEQ ID NO: 173326 - DNA, 582 bp, Artificial Sequence
  Description of Artificial Sequence: Synthetic coding sequence
atgaccagcgctgccccagccaagaagccctacaggaaggcccctcctgagcaccgggagctgcggctggagatccctggcagccggctggagcaggaggagcccctgacagatgctgagaggatgaagctgctgcaggaggagaatgaggagctgcggcggcggctggccagcgccaccaggagaacagaggccctggagcgggagctggagatcggccaggactgcctggagctggagctgggccagagccgggaggagctggacaagttcaaggacaagttccggcggctgcagaacagctacacagccagccagaggaccaaccaggagctggaggacaagctgcacaccctggccagcctgagccacagctggatctttgccatcaagaaggccgagatggacaggaagaccctggactgggagatcgtggagctgaccaacaagctgctggatgccaagaacaccatcaacaagctggaggagctgaatgaaagataccgcctggactgcaacctggccgtgcagctgctgaagtgcaacaagagccacttcaggaaccacaagtttgctgactag

SEQ ID NO: 173327 - DNA, 720 bp, Artificial Sequence
  Description of Artificial Sequence: Synthetic coding sequence
tgactgctgcaggaggagaatgaggagctgcggcggcggctggccagcgccaccaggagaacagaggccctggagcgggagctggagatcggccaggactgcctggagctggagctgggccagagccgggaggagctggacaagttcaaggacaagttccggcggctgcagaacagctacacagccagccagaggaccaaccaggagctggaggacaagctgcacaccctcatcaagaaggccgagatggacaggaagaccctggactgggagatcgtggagctgaccaacaagctgctggatgccaagaacaccatcaacaagctggaggagctgaatgaaagataccgcctggactgcaacctggccgtgcagctgctgaagtgcaacaagagccacttcaggaaccacaagtttgctgatgtgtccaggacccaccccctgcctgcccacatcgaccacagcggccactgcaggacccccctgacccctgtgtctgcccccctgtctgtgctgctcttccccctgtgcccccccctggcctccatgagccccctgaagcctgtgaacagcgccaccggctggtgccctgtgtactgccccggccccatcaccagcagcggcggccctgccctgctggtgtctgtgacagaaacagagcgggaggaccccggccaggagggggagggcagccagagctacctgcccaaggagtactag

SEQ ID NO: 173328 - DNA, 5247 bp, Artificial Sequence
  Description of Artificial Sequence: Synthetic coding sequence
atgtctgcccgggctgctgctgccaagagcacagccatggaggagacagccatctgggagcagcacacagtgaccctgcaccgggcccctggcttcggcttcggcatcgccatcagcggcggccgggacaacccccacttccagagcggggagaccagcatcgtcatcagtgatgtgctgaagggcggccctgctgagggccagctgcaggagaatgacagagtggccatggtgaatggagtgtccatggacaacgtggagcacgcctttgctgtgcagcagctgaggaagagcggcaagaatgccaagatcaccatccggaggaagaagaaggtgcagatccctgtgtccaggccagaccctgagcctgtgtctgacaatgaagaagattcctatgatgaggagatccatgaccccaggagcggccgcagcggcgtggtgaacagaagaagtgagaagatctggccccgggacagaagtgccagccgggagaggagcctgagccccaggagtgacagaagatctgtggccagcagccagcctgccaagcccaccaaggtgaccctggtgaagagcaggaagaatgaggagtatggcctgcggctggccagccacatctttgtgaaggagatcagccaggacagcctggccgccagagatggcaacatccaggagggagatgtggtgctgaagatcaatggaacagtgacagagaacatgagcctgacagatgccaagaccctgattgaaagaagcaagggcaagctgaagatggtggtgcagagagatgagcgggccaccctgctgaatgtgcctgacctgagtgacagcatccacagcgccaatgccagcgagagagatgacatcagcgagatccagagcctggccagtgaccacagcggccgcagccatgaccggcccccaagaagaagccgcagccgcagcccagaccagaggtctgagcccagcgaccacagccgccacagcccccagcagcccagcaatggcagcctgcggagcagagatgaggagcgcatcagcaagccaggagctgtgtccacccctgtgaagcatgctgatgaccacacccccaagacagtggaggaggtgacagtggagagaaatgagaagcagacccccagcctgcctgagcccaagcctgtgtatgcccaggtgggccagccagatgtggacctgcctgtgagccccagtgatggagtgctgcccaacagcacccatgaagatggcatcctgcggcccagcatgaagctggtgaagttcagaaaaggagacagcgtgggcctgcggctggccggcggcaatgatgtgggcatctttgtggccggcgtgctggaggacagccctgctgccaaggagggcctggaggagggggaccagatcctgcgggtgaacaacgtggacttcaccaacatcatccgggaggaggccgtgctcttcctgctggacctgcccaagggggaggaggtgaccatcctggcccagaagaagaaggatgtgtaccgccgcatcgtggagagtgatgtgggggacagcttctacatccgcacccactttgaatatgagaaggagagcccctacggcctgtccttcaacaagggggaggtgttccgggtggtggacaccctgtacaacgggaagctgggctcctggctggccatccgcatcggcaagaaccacaaggaggtggagcggggcatcatccccaacaagaacagagctgagcagctggcctctgtgcagtacaccctgcccaagacagctggaggagacagagctgacttctggaggttccggggcctgcggagcagcaagaggaacctgaggaagagccgggaggacctgagcgcccagcctgtgcagaccaagtttcctgcctatgagcgggtggtgctgcgggaggccggcttcctgcggcctgtgaccatcttcggccccatcgcagatgtggcccgggagaagctggcccgggaggagccagacatctaccagatcgccaagtctgagcccagagatgctggaacagaccagaggagcagcggcatcatccggctgcacaccatcaagcagatcatcgaccaggacaagcacgccctgctggatgtgaccccaaatgctgtggaccggctgaactatgcccagtggtaccccatcgtggtgttcctgaacccagacagcaagcagggcgtgaagaccatgaggatgaggctgtgcccagagagcaggaagagcgccaggaagctgtatgaaagaagccacaagctgaggaagaacaaccaccacctgttcaccaccaccatcaacctgaacagcatgaatgatggctggtatggagccctgaaggaggccatccagcagcagcagaaccagctggtgtgggtgtctgagggcaaggcagatggagccaccagtgatgacctggacctgcatgatgaccggctgagctacctgagcgcccctggcagcgagtacagcatgtacagcacagacagccgccacaccagtgactatgaggacacagacacagagggcggggcctacacagaccaggagctggatgagaccctgaatgatgaggtgggcaccccacctgagagcgccatcaccaggagcagcgagcctgtgcgggaggacagcagcggcatgcaccacgagaaccagacctacccaccctacagcccccaggcccagccccagcccatccacagaattgacagccctggcttcaagccagccagccagcagaaggccgaggccagcagccctgtgccctacctgagccctgagaccaacccagccagcagcaccagcgctgtgaaccacaacgtgaacctgaccaacgtgcggctggaggagcccaccccagcccccagcaccagctacagcccccaggccgacagcctgcggacccccagcacagaagctgcccacatcatgctgcgggaccaggagcccagcctgagcagccacgtggaccccaccaaggtgtacaggaaggacccctacccagaggagatgatgaggcagaaccacgtgctgaagcagcctgctgtgagccaccctggccacaggccagacaaggagcccaacctgacctatgagccccagctgccctacgtggagaagcaggccagccgggacctggagcagcccacctaccgctatgagagcagcagctacacagaccagttcagcaggaactatgagcaccggctgcgctatgaagatagagtgcccatgtatgaggagcagtggagctactatgatgacaagcagccctaccccagccggcccccatttgacaaccagcacagccaggacctggacagccggcagcaccctgaggagagcagcgagcggggctacttccccaggtttgaggagcccgcccccctgtcctatgacagccggcccaggtatgagcaggccccccgggccagcgccctgcggcatgaggagcagcctgcccctggctatgacacccacggccgcctgcggcctgaggcccagccccaccccagcgctggccccaagccagctgagagcaagcagtactttgagcagtacagccgctcctatgagcaggtgcccccccagggcttcaccagcagagctggccactttgagcccctgcacggggctgctgctgtgcccccactcatccccagcagccagcacaagccagaggccctgcccagcaacaccaagcccctgcccccaccacccacccagacagaggaggaggaggaccctgccatgaagccccagagcgtgctgaccagggtgaagatgtttgagaacaagaggtctgccagcctggagaccaagaaggatgtgaatgacaccggcagcttcaagcccccagaggtggccagcaagcccagcggggcccccatcatcggccccaagcccaccagccagaaccagttcagcgagcatgacaagaccctgtaccgcatccctgagccccagaagccccagctgaagcccccagaggacatcgtgcgcagcaaccactatgaccctgaggaggatgaggagtactacaggaagcagctgagctactttgaccggcgcagctttgagaacaagcccccagcccacatcgccgccagccacctgtctgagcccgccaagccagcccacagccagaaccagagcaacttcagcagctacagcagcaagggcaagcccccagaggctgatggagtggacaggagctttggagagaagagatatgagcccatccaggccaccccacctcctccacccctgcccagccagtatgcccagcccagccagcctgtgaccagcgccagcctgcacatccacagcaagggggcccatggagagggcaacagcgtgtccctggacttccagaacagcctggtgtccaagccagaccccccacccagccagaacaagccagccaccttccggccccccaaccgggaggacacagcccaggccgccttctacccccagaagagcttcccagacaaggcccctgtgaatggaacagagcagacccagaagacagtgaccccagcctacaaccgcttcacccccaagccctacaccagcagcgcccggccctttgagaggaagtttgagagccccaagttcaaccacaacctgctgcccagcgagacagcccacaagccagacctgagcagcaagacccccaccagccccaagaccctggtgaagagccacagcctggcccagcccccagagtttgacagcggcgtggagaccttcagcatccatgctgagaagcccaagtaccagatcaacaacatcagcacagtgcccaaggccatccctgtgagccccagcgctgtggaggaggatgaagatgaagatggccacacagtggtggccacagcccggggcatcttcaacagcaatggaggagtgctgagcagcattgagaccggggtgtccatcatcatcccccagggcgccatccctgagggcgtggagcaggagatctacttcaaggtgtgccgggacaacagcatcctgccccccctggacaaggagaagggggagaccctgctgagccccctggtgatgtgtggcccccacggcctgaagttcctgaagcctgtggagctgcggctgccccactgtgaccccaagacctggcagaacaagtgcctgcccggggaccccaactacctggtgggcgccaactgtgtgtctgtgctgattgaccacttctag

SEQ ID NO: 173329 - DNA, 5007 bp, Artificial Sequence
  Description of Artificial Sequence: Synthetic coding sequence
atgtctgcccgggctgctgctgccaagagcacagccatggaggagacagccatctgggagcagcacacagtgaccctgcaccgggcccctggcttcggcttcggcatcgccatcagcggcggccgggacaacccccacttccagagcggggagaccagcatcgtcatcagtgatgtgctgaagggcggccctgctgagggccagctgcaggagaatgacagagtggccatggtgaatggagtgtccatggacaacgtggagcacgcctttgctgtgcagcagctgaggaagagcggcaagaatgccaagatcaccatccggaggaagaagaaggtgcagatccctgtgtccaggccagaccctgagcctgtgtctgacaatgaagaagattcctatgatgaggagatccatgaccccaggagcggccgcagcggcgtggtgaacagaagaagtgagaagatctggccccgggacagaagtgccagccgggagaggagcctgagccccaggagtgacagaagatctgtggccagcagccagcctgccaagcccaccaaggtgaccctggtgaagagcaggaagaatgaggagtatggcctgcggctggccagccacatctttgtgaaggagatcagccaggacagcctggccgccagagatggcaacatccaggagggagatgtggtgctgaagatcaatggaacagtgacagagaacatgagcctgacagatgccaagaccctgattgaaagaagcaagggcaagctgaagatggtggtgcagagagatgagcgggccaccctgctgaatgtgcctgacctgagtgacagcatccacagcgccaatgccagcgagagagatgacatcagcgagatccagagcctggccagtgaccacagcggccgcagccatgaccggcccccaagaagaagccgcagccgcagcccagaccagaggtctgagcccagcgaccacagccgccacagcccccagcagcccagcaatggcagcctgcggagcagagatgaggagcgcatcagcaagccaggagctgtgtccacccctgtgaagcatgctgatgaccacacccccaagacagtggaggaggtgacagtggagagaaatgagaagcagacccccagcctgcctgagcccaagcctgtgtatgcccaggtgggccagccagatgtggacctgcctgtgagccccagtgatggagtgctgcccaacagcacccatgaagatggcatcctgcggcccagcatgaagctggtgaagttcagaaaaggagacagcgtgggcctgcggctggccggcggcaatgatgtgggcatctttgtggccggcgtgctggaggacagccctgctgccaaggagggcctggaggagggggaccagatcctgcgggtgaacaacgtggacttcaccaacatcatccgggaggaggccgtgctcttcctgctggacctgcccaagggggaggaggtgaccatcctggcccagaagaagaaggatgtgtaccgccgcatcgtggagagtgatgtgggggacagcttctacatccgcacccactttgaatatgagaaggagagcccctacggcctgtccttcaacaagggggaggtgttccgggtggtggacaccctgtacaacgggaagctgggctcctggctggccatccgcatcggcaagaaccacaaggaggtggagcggggcatcatccccaacaagaacagagctgagcagctggcctctgtgcagtacaccctgcccaagacagctggaggagacagagctgacttctggaggttccggggcctgcggagcagcaagaggaacctgaggaagagccgggaggacctgagcgcccagcctgtgcagaccaagtttcctgcctatgagcgggtggtgctgcgggaggccggcttcctgcggcctgtgaccatcttcggccccatcgcagatgtggcccgggagaagctggcccgggaggagccagacatctaccagatcgccaagtctgagcccagagatgctggaacagaccagaggagcagcggcatcatccggctgcacaccatcaagcagatcatcgaccaggacaagcacgccctgctggatgtgaccccaaatgctgtggaccggctgaactatgcccagtggtaccccatcgtggtgttcctgaacccagacagcaagcagggcgtgaagaccatgaggatgaggctgtgcccagagagcaggaagagcgccaggaagctgtatgaaagaagccacaagctgaggaagaacaaccaccacctgttcaccaccaccatcaacctgaacagcatgaatgatggctggtatggagccctgaaggaggccatccagcagcagcagaaccagctggtgtgggtgtctgagggcaaggcagatggagccaccagtgatgacctggacctgcatgatgaccggctgagctacctgagcgcccctggcagcgagtacagcatgtacagcacagacagccgccacaccagtgactatgaggacacagacacagagggcggggcctacacagaccaggagctggatgagaccctgaatgatgaggtgggcaccccacctgagagcgccatcaccaggagcagcgagcctgtgcgggaggacagcagcggcatgcaccacgagaaccagacctacccaccctacagcccccaggcccagccccagcccatccacagaattgacagccctggcttcaagccagccagccagcaggtgtacaggaaggacccctacccagaggagatgatgaggcagaaccacgtgctgaagcagcctgctgtgagccaccctggccacaggccagacaaggagcccaacctgacctatgagccccagctgccctacgtggagaagcaggccagccgggacctggagcagcccacctaccgctatgagagcagcagctacacagaccagttcagcaggaactatgagcaccggctgcgctatgaagatagagtgcccatgtatgaggagcagtggagctactatgatgacaagcagccctaccccagccggcccccatttgacaaccagcacagccaggacctggacagccggcagcaccctgaggagagcagcgagcggggctacttccccaggtttgaggagcccgcccccctgtcctatgacagccggcccaggtatgagcaggccccccgggccagcgccctgcggcatgaggagcagcctgcccctggctatgacacccacggccgcctgcggcctgaggcccagccccaccccagcgctggccccaagccagctgagagcaagcagtactttgagcagtacagccgctcctatgagcaggtgcccccccagggcttcaccagcagagctggccactttgagcccctgcacggggctgctgctgtgcccccactcatccccagcagccagcacaagccagaggccctgcccagcaacaccaagcccctgcccccaccacccacccagacagaggaggaggaggaccctgccatgaagccccagagcgtgctgaccagggtgaagatgtttgagaacaagaggtctgccagcctggagaccaagaaggatgtgaatgacaccggcagcttcaagcccccagaggtggccagcaagcccagcggggcccccatcatcggccccaagcccaccagccagaaccagttcagcgagcatgacaagaccctgtaccgcatccctgagccccagaagccccagctgaagcccccagaggacatcgtgcgcagcaaccactatgaccctgaggaggatgaggagtactacaggaagcagctgagctactttgaccggcgcagctttgagaacaagcccccagcccacatcgccgccagccacctgtctgagcccgccaagccagcccacagccagaaccagagcaacttcagcagctacagcagcaagggcaagcccccagaggctgatggagtggacaggagctttggagagaagagatatgagcccatccaggccaccccacctcctccacccctgcccagccagtatgcccagcccagccagcctgtgaccagcgccagcctgcacatccacagcaagggggcccatggagagggcaacagcgtgtccctggacttccagaacagcctggtgtccaagccagaccccccacccagccagaacaagccagccaccttccggccccccaaccgggaggacacagcccaggccgccttctacccccagaagagcttcccagacaaggcccctgtgaatggaacagagcagacccagaagacagtgaccccagcctacaaccgcttcacccccaagccctacaccagcagcgcccggccctttgagaggaagtttgagagccccaagttcaaccacaacctgctgcccagcgagacagcccacaagccagacctgagcagcaagacccccaccagccccaagaccctggtgaagagccacagcctggcccagcccccagagtttgacagcggcgtggagaccttcagcatccatgctgagaagcccaagtaccagatcaacaacatcagcacagtgcccaaggccatccctgtgagccccagcgctgtggaggaggatgaagatgaagatggccacacagtggtggccacagcccggggcatcttcaacagcaatggaggagtgctgagcagcattgagaccggggtgtccatcatcatcccccagggcgccatccctgagggcgtggagcaggagatctacttcaaggtgtgccgggacaacagcatcctgccccccctggacaaggagaagggggagaccctgctgagccccctggtgatgtgtggcccccacggcctgaagttcctgaagcctgtggagctgcggctgccccactgtgaccccaagacctggcagaacaagtgcctgcccggggaccccaactacctggtgggcgccaactgtgtgtctgtgctgattgaccacttctag

SEQ ID NO: 173330 - DNA, 2982 bp, Artificial Sequence
  Description of Artificial Sequence: Synthetic coding sequence
atgcctgtgcggggggaccggggcttccccccccggcgggagctgagcggctggctgcgggcccctggcatggaggagctgatctgggagcagtacacagtgaccctgcagaaggacagcaagaggggcttcggcattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccacggcggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgagcgggcctaccaccgggcctatgaccctgactatgagcgggcctacagccctgagtaccgccgcggggcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcatgaaggagacatcatcctgaagatcaatggcaccgtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagaggaggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgagagaagatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgagcgggtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggaggtgcggcggggccggccccgggccggcaccggggagcccggggtcttcctggccctgtcctggacagctgtgtgcagcggctgctgcggccgccacagctag

SEQ ID NO: 173331 - DNA, 3132 bp, Artificial Sequence
  Description of Artificial Sequence: Synthetic coding sequence
atgcctgtgcggggggaccggggcttccccccccggcgggagctgagcggctggctgcgggcccctggcatggaggagctgatctgggagcagtacacagtgaccctgcagaaggacagcaagaggggcttcggcattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccacggcggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgagcgggcctaccaccgggcctatgaccctgactatgagcgggcctacagccctgagtaccgccgcggggcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcatgaaggagacatcatcctgaagatcaatggcaccgtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagaggaggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgagagaagatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgagcgggtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggagattgaaattgcccagaagcacccagacatctatgctgtgcccatcaagacccacaagccagaccccggcaccccccagcacaccagcagccggcccccagagccccagaaggcccccagccggccctaccaggacacccggggcagctatggcagtgatgctgaggaggaggagtaccggcagcagctgtctgagcacagcaagaggggctactacggccagagcgcccgctacagagacacagagctgtag

SEQ ID NO: 173332 - DNA, 3573 bp, Artificial Sequence
  Description of Artificial Sequence: Synthetic coding sequence
atgcctgtgcggggggaccggggcttccccccccggcgggagctgagcggctggctgcgggcccctggcatggaggagctgatctgggagcagtacacagtgaccctgcagaaggacagcaagaggggcttcggcattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccacggcggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgagcgggcctaccaccgggcctatgaccctgactatgagcgggcctacagccctgagtaccgccgcggggcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcatgaaggagacatcatcctgaagatcaatggcaccgtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagaggaggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgagagaagatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgagcgggtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggagagcatcaggaagcccagccctgagccccgggcccagatgaggcgggccgccagcagtgaccagctgcgggacaacagccccccaccagccttcaagccagagccccccaaggccaagacccagaacaaggaggagagctatgacttcagcaagagctatgagtacaagagcaaccccagcgctgtggccggaaatgagacccctggggccagcaccaagggctacccacctcctgtggccgccaagcccaccttcggccgcagcatcctgaagcccagcacccccatccccccccaggagggggaggaggtgggggagagcagcgaggagcaggacaatgcccccaagtctgtgctgggcaaggtgaagatctttgagaagatggaccacaaggcccggctgcagaggatgcaggagctgcaggaggcccagaatgcccgcatcgagatcgcccagaagcacccagacatctatgctgtgcccatcaagacccacaagccagaccccggcaccccccagcacaccagcagcaggcctcctgagccccagaaggcccccagccggccctaccaggacacccggggcagctatggcagtgatgctgaggaggaggagtaccggcagcagctgtctgagcacagcaagaggggctactacggccagagcgcccgctacagagacacagagctgtag

SEQ ID NO: 173333 - DNA, 306 bp, Artificial Sequence
  Description of Artificial Sequence: Synthetic coding sequence
atggaggagctgatctgggagcagtacacagtgaccctgcagaaggacagcaagaggggctttggaattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtgtccacaggctttgccttcagcctgccctag

SEQ ID NO: 173334 - DNA, 486 bp, Artificial Sequence
  Description of Artificial Sequence: Synthetic coding sequence
atggaggagctgatctgggagcagtacacagtgaccctgcagaaggacagcaagaggggctttggaattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccatggaggccgcagccgctcctgggaggacagccctgagcggggccggccccatgagcgggcctag

SEQ ID NO: 173335 - DNA, 3063 bp, Artificial Sequence
  Description of Artificial Sequence: Synthetic coding sequence
atggaggagctgatctgggagcagtacacagtgaccctgcagaaggacagcaagaggggctttggaattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccatggaggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgaaagagcctaccaccgggcctatgaccctgactatgaaagagcctacagccctgagtacagaagaggagcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcacgagggggacatcatcctgaagatcaatggaacagtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagcggcggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgcgggaggatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgaaagagtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggagattgagatcgcccagaagcacccagacatctatgctgtgcccatcaagacccacaagccagaccccggcaccccccagcacaccagcagcaggcctcctgagccccagaaggcccccagccggccctaccaggacacccggggcagctatggcagtgatgctgaggaggaggagtaccggcagcagctgtctgagcacagcaagaggggctactacggccagagcgcccgctacagagacacagagctgtag

SEQ ID NO: 173336 - DNA, 3474 bp, Artificial Sequence
  Description of Artificial Sequence: Synthetic coding sequence
atgaagacagcccaggccctgcacaggatgtggatccaggccgtgaagaagctgcggcgctggaagggccgggcccctggcatggaggagctgatctgggagcagtacacagtgaccctgcagaaggacagcaagaggggcttcggcattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccacggcggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgagcgggcctaccaccgggcctatgaccctgactatgagcgggcctacagccctgagtaccgccgcggggcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcatgaaggagacatcatcctgaagatcaatggcaccgtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagaggaggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgagagaagatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgagcgggtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggaggccaagacccagaacaaggaggagagctatgacttcagcaagagctatgagtacaagagcaaccccagcgctgtggccggaaatgagacccctggggccagcaccaagggctacccacctcctgtggccgccaagcccaccttcggccgcagcatcctgaagcccagcacccccatccccccccaggagggggaggaggtgggggagagcagcgaggagcaggacaatgcccccaagtctgtgctgggcaaggtgaagatctttgagaagatggaccacaaggcccggctgcagaggatgcaggagctgcaggaggcccagaatgccagaattgaaattgcccagaagcacccagacatctatgctgtgcccatcaagacccacaagccagaccccggcaccccccagcacaccagcagccggcccccagagccccagaaggcccccagccggccctaccaggacacccggggcagctatggcagtgatgctgaggaggaggagtaccggcagcagctgtctgagcacagcaagaggggctactacggccagagcgcccgctacagagacacagagctgtag

SEQ ID NO: 173337 - DNA, 3666 bp, Artificial Sequence
  Description of Artificial Sequence: Synthetic coding sequence
atgaagacagcccaggccctgcacaggatgtggatccaggccgtgaagaagctgcggcgctggaagggccgggtgagccccagcgccagcagccccctggtgttccccaacctgagctcctgggagggggagggcagcaagaccatcctgacagcccctggcatggaggagctgatctgggagcagtacacagtgaccctgcagaaggacagcaagaggggctttggaattgctgtgtctgggggccgggacaacccccactttgaaaatggagagaccagcatcgtcatcagtgatgtgctgcccggcggccctgcagatggcctgctgcaggagaatgacagagtggtgatggtgaatggcacccccatggaggatgtgctgcacagctttgctgtgcagcagctgaggaagagcggcaaggtggccgccatcgtggtgaagaggcccaggaaggtgcaggtggccgccctgcaggccagcccccccctggaccaggatgaccgggcctttgaggtgatggatgaatttgatggccgctccttccgcagcggctacagcgagaggagccggctgaacagccatggaggccgcagccgctcctgggaggacagccctgagcggggccggccccatgagcgggcccggagccgggagcgggacctgagccgggacaggagccggggccgcagcctggagcggggcctggaccaggaccacgcccggacccgggacaggagccggggccgcagcctggagcggggcctggaccatgactttggccccagccgggaccgggaccgggacaggagccggggccgcagcattgaccaggactatgaaagagcctaccaccgggcctatgaccctgactatgaaagagcctacagccctgagtacagaagaggagcccggcatgatgcccggagccggggccccaggagccgcagccgggagcacccccacagccgcagccccagccctgagccccggggccggcccggccccatcggcgtgctgctgatgaagagccgggccaatgaggagtatggcctgcggctgggcagccagatctttgtgaaggagatgaccaggacaggcctggccaccaaggatggcaacctgcacgagggggacatcatcctgaagatcaatggaacagtgacagagaacatgagcctgacagatgccaggaagctgattgagaagagccggggcaagctgcagctggtggtgctgcgggacagccagcagaccctcatcaacatccccagcctgaatgacagcgacagcgagattgaggacatcagcgagattgagagcaacagaagcttcagccctgaggagcggcggcaccagtacagcgactatgactaccacagcagcagcgagaagctgaaggagcggcccagcagccgggaggacacccccagccggctgagcaggatgggcgccacccccacccccttcaagagcactggagacattgctggcaccgtggtgcctgagaccaacaaggagccccgctaccaggaggaccccccagccccccagcccaaggccgcccccaggaccttcctgcggcccagcccagaagatgaggccatctacggccccaacaccaagatggtgcgcttcaagaagggggacagcgtgggcctgcggctggccggcggcaatgatgtgggcatctttgtggccggcatccaggagggcaccagcgctgagcaggagggcctgcaggagggggaccagatcctgaaggtgaacacccaggacttccggggcctggtgcgggaggatgctgtgctgtacctgctggagatccccaagggggagatggtgaccatcctggcccagagcagagcagatgtgtacagagacatcctggcctgtggccgcggggacagcttcttcatccgcagccactttgaatgtgagaaggagaccccccagagcctggccttcaccagaggagaggtgttccgggtggtggacaccctgtatgatggcaagctgggcaactggctggccgtgagaattggaaatgagctggagaagggcctcatccccaacaagagcagagctgagcagatggcctctgtgcagaatgcccagagggacaatgctggggacagagctgacttctggaggatgaggggccagaggtctggagtgaagaagaacctgaggaagagccgggaggacctgacagctgtggtgtctgtgtccaccaagtttcctgcctatgaaagagtgctgctgcgggaggccggcttcaagaggcctgtggtgctgtttggccccatcgctgacatcgccatggagaagctggccaatgagctgcctgactggttccagacagccaagacagagcccaaggatgctggcagcgagaagagcactggagtggtgcggctgaacacagtgcggcagatcatcgagcaggacaagcacgccctgctggatgtgacccccaaggctgtggacctgctgaactacacccagtggttccccatcgtcatcttcttcaacccagacagccggcagggcgtgaagaccatgaggcagaggctgaaccccaccagcaacaagagcagcaggaagctgtttgaccaggccaacaagctgaagaagacctgtgcccacctgttcaccgccaccatcaacctgaacagcgccaatgacagctggtttggcagcctgaaggacaccatccagcaccagcagggcgaggccgtgtgggtgtctgagggcaagatggagggcatggatgatgatcctgaggacaggatgagctacctgacagccatgggcgctgactacctgagctgtgacagccgcctcatcagtgactttgaggacacagatggagagggcggggcctacacagacaatgagctggatgagcctgctgaggagcccctggtgagcagcatcaccaggagcagcgagcctgtgcagcacgaggagagcatcaggaagcccagccctgagccccgggcccagatgagaagagctgccagcagtgaccagctgcgggacaacagccccccaccagccttcaagccagagccccccaaggccaagacccagaacaaggaggagagctatgacttcagcaagagctatgagtacaagagcaaccccagcgctgtggccggaaatgagacccctggggccagcaccaagggctacccacctcctgtggccgccaagcccaccttcggccgcagcatcctgaagcccagcacccccatccccccccaggagggggaggaggtgggggagagcagcgaggagcaggacaatgcccccaagtctgtgctgggcaaggtgaagatctttgagaagatggaccacaaggcccggctgcagaggatgcaggagctgcaggaggcccagaatgccagaattgaaattgcccagaagcacccagacatctatgctgtgcccatcaagacccacaagccagaccccggcaccccccagcacaccagcagccggcccccagagccccagaaggcccccagccggccctaccaggacacccggggcagctatggcagtgatgctgaggaggaggagtaccggcagcagctgtctgagcacagcaagaggggctactacggccagagcgcccgctacagagacacagagctgtag

SEQ ID NO: 173338 - DNA, 2787 bp, Artificial Sequence
  Description of Artificial Sequence: Synthetic coding sequence
atggctgtgcgcttccaggtggccgacatggaggagctgaccatctgggagcagcacacagccaccctgagcaaggacccccggcggggctttggaattgccatcagcggcggccgggacaggcctgggggctccatggtggtgtctgatgtggtgcctgggggccctgctgagggccgcctgcagacaggagaccacatcgtgatggtgaatggagtgtccatggagaatgccaccagcgcctttgccatccagatcctgaagacctgcaccaagatggccaacatcaccgtgaagaggccccggcgcatccacctgcctgccaccaaggccagccccagcagccctggccggcaggacagtgatgaagatgatggcccccagagggtggaggaggtggaccagggccggggctatgatggagacagcagcagcggcagcggccgctcctgggatgagaggagccggcggccccggcccggccggcggggccgggccggcagccatggaagaagaagccctgggggcggcagcgaggccaacggcctggccctggtgtctggcttcaagaggctgccccggcaggatgtgcagatgaagcctgtgaagtctgtgctggtgaagagaagagacagcgaggagtttggagtgaagctgggcagccagatcttcatcaagcacatcacagattctggcctggccgcccggcaccggggcctgcaggagggggacctgatcctgcagatcaacggggtgagcagccagaacctgagcctgaatgacaccaggaggctcatcgagaagtctgagggcaagctgagcctgctggtgctgcgggaccggggccagttcctggtgaacatccccccagctgtgtctgacagcgacagcagccccctggaggacatcagtgacctggccagcgagctgagccaggccccacccagccacatccccccaccacccaggcatgcccagaggagccctgaggccagccagacagacagccctgtggagagcccccggctgcggcgggagagctctgtggacagcaggaccatcagcgagccagatgagcagaggtctgagctgccccgggagagcagctatgacatctacagagtgcccagcagccagagcatggaggaccggggctacagcccagacaccagggtggtgcgcttcctgaagggcaagagcatcggcctgcggctggccggcggcaatgatgtgggcatctttgtgtctggagtgcaggccggcagccctgcagatggccagggcatccaggagggggaccagatcctgcaggtgaatgatgtgcccttccagaacctgacccgggaggaggccgtgcagttcctgctgggcctgcccccaggagaggagatggagctggtgacccagaggaagcaggacatcttctggaagatggtgcagagccgggtgggggacagcttctacatccgcacccactttgagctggagcccagccccccatctggcctgggcttcaccagaggagatgtgttccacgtgctggacaccctgcaccctggccctggccagagccacgcccggggcggccactggctggccgtgaggatgggccgggacctgcgggagcaggagcggggcatcatccccaaccagagcagagctgagcagctggccagcctggaggccgcccagagagctgtgggcgtgggccctggcagcagcgctggcagcaatgcccgggcagagttctggaggctgcggggcctgcggcggggggccaagaagaccacccagaggagccgggaggacctgagcgccctgacccggcagggccgctacccaccctatgaaagagtggtgctgcgggaggccagcttcaagaggcctgtggtgatcctgggccctgtggccgacatcgccatgcagaagctgacagctgagatgccagaccagtttgaaattgctgagaccgtgtccaggacagacagccccagcaagatcatcaagctggacacagtgcgggtgattgctgagaaggacaagcacgccctgctggatgtgacccccagcgccatcgagcggctgaactacgtgcagtactaccccatcgtggtgttcttcatccctgagagcaggcctgccctgaaggccctgcggcagtggctggccccagccagcagaagaagcacccggcggctgtatgcccaggcccagaagctgaggaagcacagcagccacctgttcaccgccaccatccccctgaatggcaccagtgacacctggtaccaggagctgaaggccatcatccgggagcagcagacccggcccatctggacagctgaggaccagctggatggcagcctggaggacaacctggacctgccccaccacggcctggccgacagcagcgctgacctgagctgtgacagccgggtgaacagcgactatgaaacagatggagagggcggggcctacacagatggagagggctacacagatggagagggcggcccctacacagatgtggatgatgagcccccagccccagccctggcccggagcagcgagcctgtgcaggctgatgagagccagagcccccgggaccggggccgcatcagcgcccaccagggcgcccaggtggacagccgccacccccagggccagtggaggcaggacagcatgaggacctatgagcgggaggccctgaagaagaagttcatgagggtgcatgatgctgagagcagtgatgaagatggctatgactggggccctgccacagacctgtag

SEQ ID NO: 173339 - DNA, 2859 bp, Artificial Sequence
  Description of Artificial Sequence: Synthetic coding sequence
atgaacctgtgtggcctgatgcccatcttccctgcccccctggaccaggtggccgacatggaggagctgaccatctgggagcagcacacagccaccctgagcaaggacccccggcggggctttggaattgccatcagcggcggccgggacaggcctgggggctccatggtggtgtctgatgtggtgcctgggggccctgctgagggccgcctgcagacaggagaccacatcgtgatggtgaatggagtgtccatggagaatgccaccagcgcctttgccatccagatcctgaagacctgcaccaagatggccaacatcaccgtgaagaggccccggcgcatccacctgcctgccaccaaggccagccccagcagccctggccggcaggacagtgatgaagatgatggcccccagagggtggaggaggtggaccagggccggggctatgatggagacagcagcagcggcagcggccgctcctgggatgagaggagccggcggccccggcccggccggcggggccgggccggcagccatggaagaagaagccctgggggcggcagcgaggccaacggcctggccctggtgtctggcttcaagaggctgccccggcaggatgtgcagatgaagcctgtgaagtctgtgctggtgaagagaagagacagcgaggagtttggagtgaagctgggcagccagatcttcatcaagcacatcacagattctggcctggccgcccggcaccggggcctgcaggagggggacctgatcctgcagatcaacggggtgagcagccagaacctgagcctgaatgacaccaggaggctcatcgagaagtctgagggcaagctgagcctgctggtgctgcgggaccggggccagttcctggtgaacatccccccagctgtgtctgacagcgacagcagccccctggaggagggcgtgaccatggctgatgagatgagcagccccccagctgacatcagtgacctggccagcgagctgagccaggccccacccagccacatccccccaccacccaggcatgcccagaggagccctgaggccagccagacagacagccctgtggagagcccccggctgcggcgggagagctctgtggacagcaggaccatcagcgagccagatgagcagaggtctgagctgccccgggagagcagctatgacatctacagagtgcccagcagccagagcatggaggaccggggctacagcccagacaccagggtggtgcgcttcctgaagggcaagagcatcggcctgcggctggccggcggcaatgatgtgggcatctttgtgtctggagtgcaggccggcagccctgcagatggccagggcatccaggagggggaccagatcctgcaggtgaatgatgtgcccttccagaacctgacccgggaggaggccgtgcagttcctgctgggcctgcccccaggagaggagatggagctggtgacccagaggaagcaggacatcttctggaagatggtgcagagccgggtgggggacagcttctacatccgcacccactttgagctggagcccagccccccatctggcctgggcttcaccagaggagatgtgttccacgtgctggacaccctgcaccctggccctggccagagccacgcccggggcggccactggctggccgtgaggatgggccgggacctgcgggagcaggagcggggcatcatccccaaccagagcagagctgagcagctggccagcctggaggccgcccagagagctgtgggcgtgggccctggcagcagcgctggcagcaatgcccgggcagagttctggaggctgcggggcctgcggcggggggccaagaagaccacccagaggagccgggaggacctgagcgccctgacccggcagggccgctacccaccctatgaaagagtggtgctgcgggaggccagcttcaagaggcctgtggtgatcctgggccctgtggccgacatcgccatgcagaagctgacagctgagatgccagaccagtttgaaattgctgagaccgtgtccaggacagacagccccagcaagatcatcaagctggacacagtgcgggtgattgctgagaaggacaagcacgccctgctggatgtgacccccagcgccatcgagcggctgaactacgtgcagtactaccccatcgtggtgttcttcatccctgagagcaggcctgccctgaaggccctgcggcagtggctggccccagccagcagaagaagcacccggcggctgtatgcccaggcccagaagctgaggaagcacagcagccacctgttcaccgccaccatccccctgaatggcaccagtgacacctggtaccaggagctgaaggccatcatccgggagcagcagacccggcccatctggacagctgaggaccagctggatggcagcctggaggacaacctggacctgccccaccacggcctggccgacagcagcgctgacctgagctgtgacagccgggtgaacagcgactatgaaacagatggagagggcggggcctacacagatggagagggctacacagatggagagggcggcccctacacagatgtggatgatgagcccccagccccagccctggcccggagcagcgagcctgtgcaggctgatgagagccagagcccccgggaccggggccgcatcagcgcccaccagggcgcccaggtggacagccgccacccccagggccagtggaggcaggacagcatgaggacctatgagcgggaggccctgaagaagaagttcatgagggtgcatgatgctgagagcagtgatgaagatggctatgactggggccctgccacagacctgtag

SEQ ID NO: 173340 - DNA, 2802 bp, Artificial Sequence
  Description of Artificial Sequence: Synthetic coding sequence
atggaggagctgaccatctgggagcagcacacagccaccctgagcaaggacccccggcggggcttcggcatcgccatcagcggcggccgggacaggcctgggggctccatggtggtgtctgatgtggtgcctgggggccctgctgagggccgcctgcagacaggagaccacatcgtgatggtgaatggagtgtccatggagaatgccaccagcgcctttgccatccagatcctgaagacctgcaccaagatggccaacatcaccgtgaagaggccccggcgcatccacctgcctgccaccaaggccagccccagcagccctggccggcaggacagtgatgaagatgatggcccccagagggtggaggaggtggaccagggccggggctatgatggagacagcagcagcggcagcggccgctcctgggatgagaggagcagaagacccaggcctggaagaagaggccgggccggcagccacggccgccgcagccctgggggcggcagcgaggccaacggcctggccctggtgtctggcttcaagaggctgccccggcaggatgtgcagatgaagcctgtgaagtctgtgctggtgaagaggcgggacagcgaggagtttggagtgaagctgggcagccagatcttcatcaagcacatcacagacagcggcctggccgcccggcaccggggcctgcaggagggggacctgatcctgcagatcaatggagtgagcagccagaacctgagcctgaatgacacccggcggctgattgagaagtctgagggcaagctgagcctgctggtgctgcgggaccggggccagttcctggtgaacatccccccagctgtgtctgacagcgacagcagccccctggaggagggcgtgaccatggctgatgagatgagcagccccccagctgacatcagtgacctggccagcgagctgagccaggccccacccagccacatccccccaccacccaggcatgcccagaggagccctgaggccagccagacagacagccctgtggagagcccccggctgcggcgggagagctctgtggacagcaggaccatcagcgagccagatgagcagaggtctgagctgccccgggagagcagctatgacatctacagagtgcccagcagccagagcatggaggaccggggctacagcccagacaccagggtggtgcgcttcctgaagggcaagagcatcggcctgcggctggccggcggcaatgatgtgggcatctttgtgtctggagtgcaggccggcagccctgcagatggccagggcatccaggagggggaccagatcctgcaggtgaatgatgtgcccttccagaacctgacccgggaggaggccgtgcagttcctgctgggcctgcccccaggagaggagatggagctggtgacccagaggaagcaggacatcttctggaagatggtgcagagccgggtgggggacagcttctacatccgcacccactttgagctggagcccagcccccccagcggcctgggcttcaccagaggagatgtgttccacgtgctggacaccctgcaccctggccctggccagagccacgcccggggcggccactggctggccgtgaggatgggccgggacctgcgggagcaggagcggggcatcatccccaaccagagcagagctgagcagctggccagcctggaggccgcccagagagctgtgggcgtgggccctggcagcagcgctggcagcaatgcccgggcagagttctggaggctgcggggcctgcggcggggggccaagaagaccacccagaggagccgggaggacctgagcgccctgacccggcagggccgctacccaccctatgagcgggtggtgctgcgggaggccagcttcaagaggcctgtggtgatcctgggccctgtggccgacatcgccatgcagaagctgacagctgagatgccagaccagtttgaaattgctgagaccgtgtccaggacagacagccccagcaagatcatcaagctggacacagtgcgggtgattgctgagaaggacaagcacgccctgctggatgtgaccccatctgccatcgagcggctgaactacgtgcagtactaccccatcgtggtgttcttcatccctgagagcaggcctgccctgaaggccctgcggcagtggctggccccagccagccgccgcagcacccggcggctgtatgcccaggcccagaagctgaggaagcacagcagccacctgttcaccgccaccatccccctgaatggcaccagtgacacctggtaccaggagctgaaggccatcatccgggagcagcagacccggcccatctggacagctgaggaccagctggatggcagcctggaggacaacctggacctgccccaccacggcctggccgacagcagcgctgacctgagctgtgacagccgggtgaacagcgactatgaaacagatggagagggcggggcctacacagatggagagggctacacagatggagagggcggcccctacacagatgtggatgatgagcccccagccccagccctggcccggagcagcgagcctgtgcaggctgatgagagccagagcccccgggaccggggccgcatcagcgcccaccagggcgcccaggtggacagccgccacccccagggccagtggaggcaggacagcatgaggacctatgaaagagaggccctgaagaagaagttcatgagggtgcatgatgctgagagcagtgatgaagatggctatgactggggccctgccacagacctgtag

SEQ ID NO: 173341 - DNA, 2652 bp, Artificial Sequence
  Description of Artificial Sequence: Synthetic coding sequence
atggtggtgtctgatgtggtgcctgggggccctgctgagggccgcctgcagacaggagaccacatcgtgatggtgaatggagtgtccatggagaatgccaccagcgcctttgccatccagatcctgaagacctgcaccaagatggccaacatcaccgtgaagaggccccggcgcatccacctgcctgccaccaaggccagccccagcagccctggccggcaggacagtgatgaagatgatggcccccagagggtggaggaggtggaccagggccggggctatgatggagacagcagcagcggcagcggccgctcctgggatgagaggagcagaagacccaggcctggaagaagaggccgggccggcagccacggccgccgcagccctgggggcggcagcgaggccaacggcctggccctggtgtctggcttcaagaggctgccccggcaggatgtgcagatgaagcctgtgaagtctgtgctggtgaagaggcgggacagcgaggagtttggagtgaagctgggcagccagatcttcatcaagcacatcacagacagcggcctggccgcccggcaccggggcctgcaggagggggacctgatcctgcagatcaatggagtgagcagccagaacctgagcctgaatgacacccggcggctgattgagaagtctgagggcaagctgagcctgctggtgctgcgggaccggggccagttcctggtgaacatccccccagctgtgtctgacagcgacagcagccccctggaggacatcagtgacctggccagcgagctgagccaggccccacccagccacatccccccaccacccaggcatgcccagaggagccctgaggccagccagacagacagccctgtggagagcccccggctgcggcgggagagctctgtggacagcaggaccatcagcgagccagatgagcagaggtctgagctgccccgggagagcagctatgacatctacagagtgcccagcagccagagcatggaggaccggggctacagcccagacaccagggtggtgcgcttcctgaagggcaagagcatcggcctgcggctggccggcggcaatgatgtgggcatctttgtgtctggagtgcaggccggcagccctgcagatggccagggcatccaggagggggaccagatcctgcaggtgaatgatgtgcccttccagaacctgacccgggaggaggccgtgcagttcctgctgggcctgcccccaggagaggagatggagctggtgacccagaggaagcaggacatcttctggaagatggtgcagagccgggtgggggacagcttctacatccgcacccactttgagctggagcccagcccccccagcggcctgggcttcaccagaggagatgtgttccacgtgctggacaccctgcaccctggccctggccagagccacgcccggggcggccactggctggccgtgaggatgggccgggacctgcgggagcaggagcggggcatcatccccaaccagagcagagctgagcagctggccagcctggaggccgcccagagagctgtgggcgtgggccctggcagcagcgctggcagcaatgcccgggcagagttctggaggctgcggggcctgcggcggggggccaagaagaccacccagaggagccgggaggacctgagcgccctgacccggcagggccgctacccaccctatgagcgggtggtgctgcgggaggccagcttcaagaggcctgtggtgatcctgggccctgtggccgacatcgccatgcagaagctgacagctgagatgccagaccagtttgaaattgctgagaccgtgtccaggacagacagccccagcaagatcatcaagctggacacagtgcgggtgattgctgagaaggacaagcacgccctgctggatgtgaccccatctgccatcgagcggctgaactacgtgcagtactaccccatcgtggtgttcttcatccctgagagcaggcctgccctgaaggccctgcggcagtggctggccccagccagccgccgcagcacccggcggctgtatgcccaggcccagaagctgaggaagcacagcagccacctgttcaccgccaccatccccctgaatggcaccagtgacacctggtaccaggagctgaaggccatcatccgggagcagcagacccggcccatctggacagctgaggaccagctggatggcagcctggaggacaacctggacctgccccaccacggcctggccgacagcagcgctgacctgagctgtgacagccgggtgaacagcgactatgaaacagatggagagggcggggcctacacagatggagagggctacacagatggagagggcggcccctacacagatgtggatgatgagcccccagccccagccctggcccggagcagcgagcctgtgcaggctgatgagagccagagcccccgggaccggggccgcatcagcgcccaccagggcgcccaggtggacagccgccacccccagggccagtggaggcaggacagcatgaggacctatgaaagagaggccctgaagaagaagttcatgagggtgcatgatgctgagagcagtgatgaagatggctatgactggggccctgccacagacctgtag

SEQ ID NO: 173342 - DNA, 2760 bp, Artificial Sequence
  Description of Artificial Sequence: Synthetic coding sequence
atggaggagctgaccatctgggagcagcacacagccaccctgagcaaggacccccggcggggcttcggcatcgccatcagcggcggccgggacaggcctgggggctccatggtggtgtctgatgtggtgcctgggggccctgctgagggccgcctgcagacaggagaccacatcgtgatggtgaatggagtgtccatggagaatgccaccagcgcctttgccatccagatcctgaagacctgcaccaagatggccaacatcaccgtgaagaggccccggcgcatccacctgcctgccaccaaggccagccccagcagccctggccggcaggacagtgatgaagatgatggcccccagagggtggaggaggtggaccagggccggggctatgatggagacagcagcagcggcagcggccgctcctgggatgagaggagcagaagacccaggcctggaagaagaggccgggccggcagccacggccgccgcagccctgggggcggcagcgaggccaacggcctggccctggtgtctggcttcaagaggctgccccggcaggatgtgcagatgaagcctgtgaagtctgtgctggtgaagaggcgggacagcgaggagtttggagtgaagctgggcagccagatcttcatcaagcacatcacagacagcggcctggccgcccggcaccggggcctgcaggagggggacctgatcctgcagatcaatggagtgagcagccagaacctgagcctgaatgacacccggcggctgattgagaagtctgagggcaagctgagcctgctggtgctgcgggaccggggccagttcctggtgaacatccccccagctgtgtctgacagcgacagcagccccctggaggacatcagtgacctggccagcgagctgagccaggccccacccagccacatccccccaccacccaggcatgcccagaggagccctgaggccagccagacagacagccctgtggagagcccccggctgcggcgggagagctctgtggacagcaggaccatcagcgagccagatgagcagaggtctgagctgccccgggagagcagctatgacatctacagagtgcccagcagccagagcatggaggaccggggctacagcccagacaccagggtggtgcgcttcctgaagggcaagagcatcggcctgcggctggccggcggcaatgatgtgggcatctttgtgtctggagtgcaggccggcagccctgcagatggccagggcatccaggagggggaccagatcctgcaggtgaatgatgtgcccttccagaacctgacccgggaggaggccgtgcagttcctgctgggcctgcccccaggagaggagatggagctggtgacccagaggaagcaggacatcttctggaagatggtgcagagccgggtgggggacagcttctacatccgcacccactttgagctggagcccagcccccccagcggcctgggcttcaccagaggagatgtgttccacgtgctggacaccctgcaccctggccctggccagagccacgcccggggcggccactggctggccgtgaggatgggccgggacctgcgggagcaggagcggggcatcatccccaaccagagcagagctgagcagctggccagcctggaggccgcccagagagctgtgggcgtgggccctggcagcagcgctggcagcaatgcccgggcagagttctggaggctgcggggcctgcggcggggggccaagaagaccacccagaggagccgggaggacctgagcgccctgacccggcagggccgctacccaccctatgagcgggtggtgctgcgggaggccagcttcaagaggcctgtggtgatcctgggccctgtggccgacatcgccatgcagaagctgacagctgagatgccagaccagtttgaaattgctgagaccgtgtccaggacagacagccccagcaagatcatcaagctggacacagtgcgggtgattgctgagaaggacaagcacgccctgctggatgtgaccccatctgccatcgagcggctgaactacgtgcagtactaccccatcgtggtgttcttcatccctgagagcaggcctgccctgaaggccctgcggcagtggctggccccagccagccgccgcagcacccggcggctgtatgcccaggcccagaagctgaggaagcacagcagccacctgttcaccgccaccatccccctgaatggcaccagtgacacctggtaccaggagctgaaggccatcatccgggagcagcagacccggcccatctggacagctgaggaccagctggatggcagcctggaggacaacctggacctgccccaccacggcctggccgacagcagcgctgacctgagctgtgacagccgggtgaacagcgactatgaaacagatggagagggcggggcctacacagatggagagggctacacagatggagagggcggcccctacacagatgtggatgatgagcccccagccccagccctggcccggagcagcgagcctgtgcaggctgatgagagccagagcccccgggaccggggccgcatcagcgcccaccagggcgcccaggtggacagccgccacccccagggccagtggaggcaggacagcatgaggacctatgaaagagaggccctgaagaagaagttcatgagggtgcatgatgctgagagcagtgatgaagatggctatgactggggccctgccacagacctgtag

SEQ ID NO: 173343 - DNA, 1623 bp, Artificial Sequence; identical to SEQ ID NO: 146586
  Description of Artificial Sequence: Synthetic coding sequence

SEQ ID NO: 173344 - DNA, 3627 bp, Artificial Sequence
  Description of Artificial Sequence: Synthetic coding sequence
atggacctgcacatgatgaactgtgagctgctggccacctgcagcgccctgggctacctggagggggacacctaccacaaggagccagactgcctggagagcgtgaaggacctgatccgctacctgcggcatgaagatgagaccagagatgtgcggcagcagctgggcgccgcccagatcctgcagagcgacctgctgcccatcctgacccagcaccaccaggacaagcccctgtttgatgctgtgatccggctgatggtgaacctgacccagcctgccctgctgtgctttggaaacctgcccaaggagcccagcttccgccaccacttcctgcaggtgctgacctacctgcaggcctacaaggaggcctttgccagcgagaaggccttcggcgtgctgtctgagaccctgtatgagctgctgcagctgggctgggaggagcggcaggaggaggacaacctgctgattgaaagaatcctgctgctggtgaggaacatcctgcacgtgcctgctgacctggaccaggagaagaagattgatgatgatgccagcgcccatgaccagctgctgtgggccatccacctgagcggcctggatgacctgctgctcttcctggccagcagcagcgctgaggagcagtggagcctgcacgtgctggagatcgtgtccctgatgttccgggaccagaaccctgagcagctggccggcgtgggccagggccgcctggcccaggagaggtctgctgactttgctgagctggaggtgctgcggcagcgggagatggccgagaagaagacccgggccctgcagaggggcaacagacacagcagatttggaggcagctacatcgtgcagggcctgaagagcatcggggagcgggacctgatcttccacaagggcctgcacaacctgaggaactacagcagtgacctgggcaagcagcccaagaaggtgcccaagaggcggcaggccgcccgggagctgagcatccagaggagaagtgccctgaatgtgcggctcttcctgcgggacttctgcagcgagttcctggagaactgctacaaccggctgatgggctctgtgaaggaccacctgctgcgggagaaggcccagcagcatgatgagacctactacatgtgggccctggccttcttcatggccttcaacagagctgccagcttccggcccggcctggtgtctgagaccctgtctgtgaggaccttccacttcatcgagcagaacctgaccaactactatgagatgatgctgacagacaggaaggaggccgcctcctgggcccggaggatgcacctggccctgaaggcctaccaggagctgctggccaccgtgaatgagatggacatcagcccagatgaggccgtgcgggagagcagccgcatcatcaagaacaacatcttctacgtgatggagtaccgggagctgttcctggccctcttcaggaagtttgatgagcgctgccagcccaggagcttcctgcgggacctggtggagaccacccacctgttcctgaagatgctggagcgcttctgccgcagccggggcaacctggtggtgcagaacaagcagaagaagaggaggaagaagaagaagaaggtgctggaccaggccatcgtgtctggaaatgtgcccagcagccctgaggaggtggaggccgtgtggccagccctggccgagcagctgcagtgctgtgcccagaacagcgagctgtccatggacagcgtggtgccctttgatgctgccagcgaggtgcctgtggaggagcagagagctgaggccatggtgcgcatccaggactgcctgctggccggccaggccccccaggccctgaccctgctgcggagcgcccgggaggtgtggccagaaggagatgtgtttggcagccaggacatcagccctgaggaggagatccagctgctgaagcagatcctgagcgcccccctgccccggcagcagggccctgaggagagaggagctgaggaggaggaggaggaggaggaggaggaggaggaggagctgcaggtggtgcaggtgtctgagaaggagttcaacttcctggactacctgaagagatttgcctgcagcacagtggtgcgggcctacgtgctgctgctgcggagctaccagcagaacagcgcccacaccaaccactgcatcgtgaagatgctgcaccggctggcccatgacctgaagatggaggccctgctcttccagctgagcgtcttctgcctcttcaaccggctgctgagtgaccctgctgctggggcctacaaggagctggtgacctttgccaagtacatcctgggcaagttctttgccctggccgctgtgaaccagaaggcctttgtggagctgctcttctggaagaacacagctgtggtgcgggagatgacagagggctacggcagcctggatgacaggagcagcagcagaagagcccccacctggagccctgaggaggaggcccacctgcgggagctgtacctggccaacaaggatgtggagggccaggatgtggtggaggccatcctggcccacctgaacacagtgcccaggaccaggaagcagatcatccaccacctggtgcagatgggcctggccgacagcgtgaaggacttccagaggaagggcacccacatcgtgctgtggacaggagaccaggagctggagctgcagaggctgtttgaggagttccgggacagtgatgatgtgctgggccacatcatgaagaacatcacagccaagaggagccgggccagaattgtggacaagctgctggccctgggcctggtggccgagcggcgggagctgtacaagaagaggcagaagaagctggccagcagcatcctgcccaacggggctgagagcctgaaggacttctgccaggaggacctggaggaggaggagaacctgcctgaggaggacagcgaggaggaggaggagggcggcagcgaggccgagcaggtgcagggcagcctggtgctgagcaatgaaaacctgggccagagcctgcaccaggagggcttcagcatccccctgctgtggctgcagaactgcctgatccgggcagcagatgaccgggaggaggatggctgcagccaggccgtgcccctggtgcccctgacagaggagaatgaggaggccatggagaatgagcagttccagcagctgctgaggaagctgggcgtgcggcccccagccagcggccaggagaccttctggaggatcccagccaagctgagccccacccagctgcggcgggctgctgccagcctgagccagcctgaggaggagcagaagctgcagcctgagctgcagcccaaggtgcctggagagcagggcagtgatgaggagcactgcaaggagcaccgggcccaggccctgcgggccctgctgctggcccacaagaagaaggccggcctggccagccctgaggaggaggatgctgtgggcaaggagcccctgaaggccgcccccaagaagaggcagctgctggacagtgatgaggagcaggaggaggatgagggcaggaacagagcccctgagctgggcgcccctggcatccagaagaagaagcgctaccagattgaagatgatgaagatgactag

SEQ ID NO: 173345 - DNA, 906 bp, Artificial Sequence
  Description of Artificial Sequence: Synthetic coding sequence
atgctggagccccaggagaatggagtcatcgacctgcctgactatgaacatgtggaggatgagaccttcccccccttccccccaccagccagccctgagcggcaggatggagagggcacagagccagatgaggagagcggaaatggagcccctgtgcgggtgccccccaagaggacagtgaagaggaacatccccaagctggatgcccagaggctcatcagcgagcggggcctgcctgccctgcggcacgtgtttgacaaggccaagttcaagggcaaaggacatgaagctgaggacctgaagatgctgatccgccacatggagcactgggcccacaggctcttccccaagctgcagtttgaggacttcatcgacagagtggagtacctgggcagcaagaaggaggtgcagacctgcctgaagaggatccggctggacctgcccatcctgcacgaggactttgtgagcaacaatgatgaggtggctgaaaataatgaacatgatgtgaccagcacagagctggaccccttcctgaccaacctgtctgagagcgagatgtttgccagcgagctgagccgcagcctgacagaggagcagcagcagagaattgaaagaaacaagcagctggccctggagcggcggcaggccaagctgctgagcaacagccagaccctgggcaatgacatgctgatgaacaccccccgggcccacacagtggaggaggtgaacacagatgaggaccagaaggaggagagcaatggcctgaatgaagacatcctggacaacccctgcaatgatgccatcgccaacaccctgaatgaggaggagaccctgctggaccagagcttcaagaatgtgcagcagcagctggatgccaccagcaggaacatcacagaggccaggtag

SEQ ID NO: 173346 - DNA, 603 bp, Artificial Sequence
  Description of Artificial Sequence: Synthetic coding sequence
atgctgatccgccacatggagcactgggcccacaggctcttccccaagctgcagtttgaggacttcatcgacagagtggagtacctgggcagcaagaaggaggtgcagacctgcctgaagaggatccggctggacctgcccatcctgcatgaagattttgtgagcaacaatgatgaggtggccgagaacaatgaacatgatgtgaccagcacagagctggaccccttcctgaccaacctgtctgagagcgagatgtttgccagcgagctgagccgcagcctgacagaggagcagcagcagagaattgaaagaaacaagcagctggccctggagcggcggcaggccaagctgctgagcaacagccagaccctgggcaatgacatgctgatgaacaccccccgggcccacacagtggaggaggtgaacacagatgaggaccagaaggaggagagcaatggcctgaatgaagacatcctggacaacccctgcaatgatgccatcgccaacaccctgaatgaggaggagaccctgctggaccagagcttcaagaatgtgcagcagcagctggatgccaccagcaggaacatcacagaggccaggtag

SEQ ID NO: 173347 - DNA, 537 bp, Artificial Sequence
  Description of Artificial Sequence: Synthetic coding sequence
atgatgatccacggcttccagagcagccaccgggacttctgcttcggcccctggaagctgacagccagcaagacccacatcatgaagtctgcagatgtggagaagctggctgatgagctgcacatgcccagcctgcctgagatgatgtttggagacaacgtgctgcgcatccagcacggcagcggctttggaattgagttcaatgccacagatgccctgcgctgtgtgaacaactaccagggcatgctgaaggtggcctgtgccgaggagtggcaggagagcaggacagaaggagagcacagcaaggaggtgatcaagccctatgactggacctacaccacagactacaagggcaccctgctgggggagagcctgaagctgaaggtggtgcccaccacagaccacatcgacacagagaagctgaaggcccgggagcagatcaagttctttgaggaggtgctgctgtttgaagatgagctgcatgaccatggagtgagcagcctgtctgtgaagatccctgggggcggccacctgtag

SEQ ID NO: 173348 - DNA, 819 bp, Artificial Sequence
  Description of Artificial Sequence: Synthetic coding sequence
atgatgatccacggcttccagagcagccaccgggacttctgcttcggcccctggaagctgacagccagcaagacccacatcatgaagtctgcagatgtggagaagctggctgatgagctgcacatgcccagcctgcctgagatgatgtttggagacaacgtgctgcgcatccagcacggcagcggctttggaattgagttcaatgccacagatgccctgcgctgtgtgaacaactaccagggcatgctgaaggtggcctgtgccgaggagtggcaggagagcaggacagaaggagagcacagcaaggaggtgatcaagccctatgactggacctacaccacagactacaagggcaccctgctgggggagagcctgaagctgaaggtggtgcccaccacagaccacatcgacacagagaagctgaaggcccgggagcagatcaagttctttgaggaggtgctgctgtttgaagatgagctgcatgaccatggagtgagcagcctgtctgtgaagatccgggtgatgcccagcagcttcttcctgctgctgcgcttcttcctgagaattgatggagtgctgatccgcatgaatgacacccggctgtaccatgaagctgacaagacctacatgctgcgggagtacaccagccgggagagcaagatcagcagcctgatgcacgtgccccccagcctcttcacagagcccaatgagatcagccagtacctgcccatcaaggaggccgtgtgtgagaagctgatcttccctgagagaattgaccccaacccagctgacagccagaagagcacccaggtggagtag

SEQ ID NO: 173349 - DNA, 1143 bp, Artificial Sequence; identical to SEQ ID NO: 161301
  Description of Artificial Sequence: Synthetic coding sequence

SEQ ID NO: 173350 - DNA, 756 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacccggcagtgtgaggagttcatctacggcggctgtgagggcaaccagaacagatttgagagcctggaggagtgcaagaagatgtgcacccgggacaatgccaaccgcatcatcaagaccaccctgcagcaggagaagccagacttctgcttcctggaggaggaccccggcatctgccggggctacatcacccgctacttctacaacaaccagaccaagcagtgtgagcgcttcaagtatggaggctgcctgggcaacatgaacaactttgagaccctggaggagtgcaagaacatctgtgaagatggccccaacggcttccaggtggacaactacggcacccagctgaatgctgtgaacaacagcctgaccccccagagcaccaaggtgcccagcctgtttgtgaccaaggagggcaccaatgatggctggaagaatgctgcccacatctaccaggtgttcctgaatgccttctgcatccacgcctccatgttcttcctgggcctggacagcatcagctgcctgtgctag

SEQ ID NO: 173351 - DNA, 915 bp, Artificial Sequence; identical to SEQ ID NO: 161158
  Description of Artificial Sequence: Synthetic coding sequence

SEQ ID NO: 173352 - DNA, 756 bp, Artificial Sequence; identical to SEQ ID NO: 173350
  Description of Artificial Sequence: Synthetic coding sequence

SEQ ID NO: 173353 - DNA, 231 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacctag

SEQ ID NO: 173354 - DNA, 186 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggatag

SEQ ID NO: 173355 - DNA, 321 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacccggcagtgtgaggagttcatctacggcggctgtgagggcaaccagaacagatttgagagcctggaggagtgcaagaagatgtgcaccaggtag

SEQ ID NO: 173356 - DNA, 867 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacccggcagtgtgaggagttcatctacggcggctgtgagggcaaccagaacagatttgagagcctggaggagtgcaagaagatgtgcacccgggacaatgccaaccgcatcatcaagaccaccctgcagcaggagaagccagacttctgcttcctggaggaggaccccggcatctgccggggctacatcacccgctacttctacaacaaccagaccaagcagtgtgagcgcttcaagtatggaggctgcctgggcaacatgaacaactttgagaccctggaggagtgcaagaacatctgtgaagatggccccaacggcttccaggtggacaactacggcacccagctgaatgctgtgaacaacagcctgaccccccagagcaccaaggtgcccagcctgtttgagttccacggccccagctggtgcctgaccccagctgaccggggcctgtgccgggccaatgaaaatcgcttctactacaacagcgtgattggaaaatgtcggcccttcaagtacagcggctgcggcggcaatgaaaacaacttcaccagcaagcaggagtgcctgcgggcctgcaagaagggcttcatccagaggatcagcaaaggaggcctcatcaagaccaagaggaagaggaagtag

SEQ ID NO: 173357 - DNA, 321 bp, Artificial Sequence; identical to SEQ ID NO: 173355
  Description of Artificial Sequence: Synthetic coding sequence

SEQ ID NO: 173358 - DNA, 318 bp, Artificial Sequence
  Description of Artificial Sequence: Synthetic coding sequence
atgatctacaccatgaagaaggtgcacgccctgtgggcctctgtgtgcctgctgctgaacctggccccagcccccctgaatgctgacagcgaggaggatgaggagcacaccatcatcacagacacagagctgccccccctgaagctgatgcacagcttctgtgccttcaaggcagatgatggcccctgcaaggccatcatgaagcgcttcttcttcaacatcttcacccggcagtgtgaggagttcatctacggcggctgtgagggcaaccagaacagatttgagagcctggaggagtgcaagaagatgtgcacctag

SEQ ID NO: 173359 - DNA, 966 bp, Artificial Sequence
  Description of Artificial Sequence: Synthetic coding sequence
atgggagagccccagggctccatgaggatcctggtgactggaggcagcggcctggtgggcaaggccatccagaaggtggtggctgatggagctggcctgcccggggaggactgggtgtttgtgagcagcaaggatgctgacctgacagacacagcccagacccgggccctgtttgagaaggtgcagcccacccacgtgatccacctggccgccatggtgggcggcctcttcaggaacatcaagtacaacctggacttctggaggaagaatgtgcacatgaatgacaacgtgctgcacagcgcctttgaggtgggcgccaggaaggtggtgtcctgcctgagcacctgcatcttcccagacaagaccacctaccccattgatgagaccatgatccacaatggaccaccccacaacagcaactttggctacagctatgccaagaggatgattgatgtgcagaacagagcctacttccagcagtatggctgcaccttcaccgctgtgatccccaccaacgtgtttggcccccatgacaacttcaacattgaagatggccacgtgctgcccggcctcatccacaaggtgcacctggccaagagcagcggcagcgccctgactgtgtggggcaccggcaacccccggcggcagttcatctacagcctggacctggcccagctgttcatctgggtgctgcgggagtacaatgaggtggagcccatcatcctgtctgtgggggaggaggatgaggtgtccatcaaggaggccgctgaggccgtggtggaggccatggacttccacggggaggtgacctttgacaccaccaagagtgatggccagttcaagaagacagccagcaacagcaagctgcggacctacctgcctgacttccgcttcacccccttcaagcaggccgtgaaggagacctgtgcctggttcacagacaactatgagcaggccaggaagtag

SEQ ID NO: 173360 - DNA, 360 bp, Artificial Sequence
  Description of Artificial Sequence: Synthetic coding sequence
atgggagagccccagggctccatgaggatcctggtgactggaggcagcggcctggtgggcaaggccatccagaaggtggtggctgatggagctggcctgcccggggaggactgggtgtttgtgagcagcaaggatgctgacctgacagacacagcccagacccgggccctgtttgagaaggtgcagcccacccacgtgatccacctggccgccatggtgggcggcctcttcaggaacatcaagtacaacctggacttctggaggaagaatgtgcacatgaatgacaacgtgctgcacagcgcctttgaggtgggcgccaggaaggtggtgtcctgcctgagcacctgcatcttcccctag

SEQ ID NO: 173361 - DNA, 807 bp, Artificial Sequence
  Description of Artificial Sequence: Synthetic coding sequence
atgggagagccccagggctccatgaggatcctggtgactggaggcagcggcctggtgggcaaggccatccagaaggtggtggctgatggagctggcctgcccggggaggactgggtgtttgtgagcagcaaggatgctgacctgacagacacagcccagacccgggccctgtttgagaaggtgcagcccacccacgtgatccacctggccgccatggtgggcggcctcttcaggaacatcaagtacaacctggacttctggaggaagaatgtgcacatgaatgacaacgtgctgcacagcgcctttgaggtgggcgccaggaaggtggtgtcctgcctgagcacctgcatcttcccagacaagaccacctaccccattgatgagaccatgatccacaatggaccaccccacaacagcaactttggctacagctatgccaagaggatgattgatgtgcagaacagagcctacttccagcagtatggctgcaccttcaccgctgtgatccccaccaacgtgtttggcccccatgacaacttcaacattgaagatggccacgtgctgcccggcctcatccacaaggtgcacctggccaagagcagcggcagcgccctgactgtgtggggcaccggcaacccccggcggcagttcatctacagcctggacctggcccagctgttcatctgggtgctgcgggagtacaatgaggtggagcccatcatcctgtctgtgggggaggaggatgaggtgtccatcaaggaggccgctgaggccgtggtggaggccatggacttccacggggagtag

SEQ ID NO: 173362 - DNA, 966 bp, Artificial Sequence; identical to SEQ ID NO: 173359
  Description of Artificial Sequence: Synthetic coding sequence

SEQ ID NO: 173363 - DNA, 597 bp, Artificial Sequence
  Description of Artificial Sequence: Synthetic coding sequence
atgggagagccccagggctccatgaggatcctggtgactggaggcagcggcctggtgggcaaggccatccagaaggtggtggctgatggagctggcctgcccggggaggactgggtgtttgtgagcagcaaggatgctgacctgacagacacagcccagacccgggccctgtttgagaaggtgcagcccacccacgtgatccacctggccgccatggtgggcggcctcttcaggaacatcaagtacaacctggacttctggaggaagaatgtgcacatgaatgacaacgtgctgcacagcgcctttgaggtgggcgccaggaaggtggtgtcctgcctgagcacctgcatcttcccagacaagaccacctaccccattgatgagaccatgatccacaatggaccaccccacaacagcaactttggctacagctatgccaagaggatgattgatgtgcagaacagagcctacttccagcagtatggctgcaccttcaccgctgtgatccccaccaacgtgtttggcccccatgacaacttcaacattgaagatggccacgtgctgcccggcctcatccacaaggtgcacctggcctag

SEQ ID NO: 173364 - DNA, 2658 bp, Artificial Sequence
  Description of Artificial Sequence: Synthetic coding sequence
atggtggagaagagcagcattgatgaaaattccatcagcctggagaaggaggtgcgccacgtgcaggagcagaacctggacatcctgaagacagacctgagcctgaagagcttcagcgaggagatctacagcgagagctgtgccctgctgcccaccagcagcgctgacatcgaggagacagacctgtctgagaagagctgccccctggagaatggaggccgcagcagcatcagccacctgaagaaggccgccagcgaggagaagcccctgggcgtgggggagatggaggaggagtgcaccctggagcctgagctggccgccttccccaagcaggacggcggcacccaggagtacacagatgccaccctggaggaccacagaggagatgtgcaggaggccgacaccctgcaccggcagctgagcctgagccagtgcttccccctgctgatgacagaggagcagcagaaccctggagagcagatcagcaccaacatccacgccagcggggaggagaagtgctatgaggaggtgcaggtgcagaatgaggccagcttcagcaccctggagggggagatgattgagaccagcttcagccagaacatccccaagctggatgaggcccacaccacagaggccgctgagagcgagaccagcctgacccagtacctgctggccgccggcaagcgggaggtgcctgagaccaaggacacccgggaccaggccaagctggtgcagagcgagagcatcacctccatggaggtggaggaggtgaccttcaacacagtgtatgagtactacaaccagaagcaggagagcctgggccggcccctgagccctgagagtgacatcagcattggagtgggcagcaccaccagcgaggagatcagcgagctggaccagttctacaccccacccagctctgtggagtactttgagagccccaagagcccagacctgtacttcaaccccagcgacatcaccaagcagagcagcatccacagcggcggggagaccgtggagcgctacagcacccccctgggggaggtggccgagcgctacagcaccccatctgagggggaggtgggggagcgctacagcaccccacctggagagaccctggagcgctacagcaccccacctggagagaccctggagcgctacagcaccccacctggagaggccctggagcgctacagcatccccaccggcggccccaaccccaccggcaccttcaagacctaccccagcaagattgaaagagaagatggcaccccaaatgagcacttctacacccccacagaggagcggggcagcgcctatgagatctggaggagtgacagctttggcaccccaaatgaggccatcgagcccaaggacaatgagatgcctccttccttcatcgagcccctgaccaagaggaaggtgtatgagaacaccaccctgggcttcatcgtggaggtggagggcctgcctgtgcctggggtgaagtggtacagaaacaagagcctgctggagccagatgagcgcatcaagatggagcgggtgggcaatgtgtgcagcctggagatcagcaacatccagaagggggagggcggggagtacatgtgccacgctgtgaacatcatcggggaggccaagagctttgccaacgtggacatcatgccccaggaggagcgggtggtggccctgcccccacctgtgacccaccagcacgtgatggagtttgacctggagcacaccaccagcagcaggacccccagcccccaggagatcgtgctggaggtggagctgtctgagaaggatgtgaaggagtttgagaagcaggtgaagatcgtgacagtgcctgagttcaccccagaccacaagtccatgattgtgtccctggatgtgctgcccttcaactttgtggaccccaacatggacagccgggagggggaggacaaggagctgaagattgacctggaggtgtttgagatgccaccccgcttcatcatgcccatctgtgacttcaagatccctgagaacagtgatgctgtgttcaagtgcagcgtgattggcatccccaccccagaggtgaagtggtacaaggagtacatgtgcattgaaccagacaacatcaagtatgtgatcagcgaggagaagggcagccacaccctgaagatcagaaatgtgtgcctgagtgacagcgccacctaccgctgcagagctgtgaactgtgtgggggaggccatctgccggggcttcctgaccatgggagacagcgagatctttgctgtgattgccaagaagagcaaggtgaccctgagcagcctgatggaggagctggtgctgaagagcaactacacagacagcttctttgagttccaggtggtggagggccccccacgcttcatcaagggcatcagtgactgctacgcccccatcggcacagctgcctacttccagtgcctggtgcggggcagcccccggcccaccgtgtactggtacaaggatggcaagctggtgcagggccgccgcttcaccgtggaggagagcggcaccggcttccacaacctcttcatcaccagcctggtgaagagtgatgaaggagagtaccgctgtgtggccaccaacaagagcggcatggccgagagctttgctgccctgaccctgacctag

SEQ ID NO: 173365 - DNA, 16815 bp, Artificial Sequence
  Description of Artificial Sequence: Synthetic coding sequence
atgaccacccaggcccccaccttcacccagcccctgcagagcgtggtggtgctggagggcagcacagccacctttgaggcccacatcagcggcttccctgtgcctgaggtgtcctggttcagagatggccaggtgatcagcaccagcaccctgcccggggtgcagatctccttcagtgatggccgggccaagctgaccatcccagctgtgaccaaggccaacagcggccgctacagcctgaaggccaccaacggcagcggccaggccaccagcacagctgagctgctggtgaaggccgagacagccccacccaactttgtgcagaggctgcagagcatgacagtgcggcagggcagccaggtgcggctgcaggtgcgggtgacaggcatccccacccctgtggtgaagttctacagagatggagctgagatccagagcagcctggacttccagatcagccaggagggggacctgtacagcctgctgattgctgaggcctacccagaagattctggcacctacagcgtgaatgccaccaacagcgtgggccgggccaccagcacagctgagctgctggtgcagggcgaggaggaggtgcctgccaagaagaccaagaccatcgtgtccacagcccagatcagcgagagccggcagaccagaattgagaagaagattgaggcccactttgatgcccggagcatcgccaccgtggagatggtgattgatggagctgctggccagcagctgccccacaagaccccaccccgcatcccccccaagcccaagagccgcagccccaccccacccagcattgctgccaaggcccagctggcccggcagcagagccccagccccatccgccacagccccagccctgtgagacatgtgcgggcccccacccccagccctgtgcgctctgtgtccccagctgcccgcatcagcaccagccccatccgctctgtgcgcagccccctgctgatgaggaagacccaggccagcacagtggccactggacctgaggtgcccccaccctggaagcaggagggctacgtggccagcagcagcgaggccgagatgagggagaccaccctgaccaccagcacccagatcagaacagaggagcgctgggagggccgctatggagtgcaggagcaggtgaccatctctggagctgctggagctgctgcctctgtgtctgccagcgccagctatgctgctgaggccgtggccactggagccaaggaggtgaagcaggatgctgacaagtctgctgctgtggccaccgtggtggccgctgtggacatggcccgggtgcgggagcctgtgatctctgctgtggagcagacagcccagaggaccaccaccacagctgtgcacatccagcctgcccaggagcaggtgaggaaggaggccgagaagacagctgtgaccaaggtggtggtggccgctgacaaggccaaggagcaggagctgaagagcaggaccaaggaggtgatcaccaccaagcaggagcagatgcacgtgacccatgagcagatcaggaaggagacagagaagacctttgtgcccaaggtggtgatctctgctgccaaggccaaggagcaggagacccgcatcagcgaggagatcaccaagaagcagaagcaggtgacccaggaggccatccggcaggagacagagatcacagctgcctccatggtggtggtggccacagccaagagcaccaagctggagaccgtgcctggggcccaggaggagaccaccacccagcaggaccagatgcacctgtcctatgagaagatcatgaaggagaccaggaagacagtggtgcccaaggtgattgtggccacccccaaggtgaaggagcaggacctggtgtcccggggccgggagggcatcaccaccaagcgggagcaggtgcagatcacccaggagaagatgaggaaggaggccgagaagacagccctgagcaccatcgctgtggccacagccaaggccaaggagcaggagaccatcctgcggacccgggagaccatggccacccggcaggagcagatccaggtgacccacggcaaggtggatgtgggcaagaaggccgaggccgtggccaccgtggtggccgctgtggaccaggcccgggtgcgggagccccgggagcccggccacctggaggagagctatgcccagcagaccaccctggagtatggctacaaggagcgcatctctgctgccaaggtggccgagcccccccagaggcctgccagcgagccccacgtggtgcccaaggctgtgaagcccagggtcatccaggcccccagcgagacccacatcaagaccacagaccagaagggcatgcacatcagcagccagatcaagaagaccacagacctgaccacagagcggctggtgcacgtggacaagaggcccaggacagccagcccccacttcaccgtgtccaagatctctgtgcccaagacagagcacggctatgaggccagcattgctggcagcgccatcgccaccctgcagaaggagctgagcgccaccagcagcgcccagaagatcaccaagtctgtgaaggcccccaccgtgaagcccagcgagaccagggtgcgggcagagcccacccccctgccccagttcccctttgctgacaccccagacacctacaagtctgaggccggcgtggaggtgaagaaggaggtgggcgtgtccatcaccggcaccaccgtgcgggaggagagatttgaggtgctgcacggccgggaggccaaggtgacagaaacagcccgggtgcctgcccctgtggagatccctgtgaccccacccaccctggtgtctggcctgaagaatgtgacagtgattgaaggagagagcgtgaccctggagtgccacatcagcggctaccccagccccaccgtgacctggtaccgggaggactaccagatcgagagcagcattgacttccagatcaccttccagagcggcatcgcccggctgatgatccgggaggcctttgctgaggacagcggccgcttcacctgcagcgctgtgaatgaagctggcaccgtgtccaccagctgctacctggccgtgcaggtgtctgaggagtttgagaaggagaccacagctgtgacagagaagttcaccacagaggagaagagatttgtggagagcagagatgtggtgatgacagacaccagcctgacagaggagcaggccggccctggagagcctgctgccccctacttcatcaccaagcctgtggtgcagaagctggtggagggcggctctgtggtgtttggctgccaggtgggcggcaaccccaagccccacgtgtactggaagaagagcggcgtgcccctgaccaccggctaccgctacaaggtgtcctacaacaagcagacaggagagtgcaagctggtgatctccatgacctttgctgatgatgctggggagtacaccatcgtggtgaggaacaagcacggggagaccagcgccagcgccagcctgctggaggaggccgactatgagctgctgatgaagagccagcaggagatgctgtaccagacccaggtgacagcctttgtgcaggagcccaaggtgggggagacagcccctggctttgtgtacagtgaatatgagaaggagtatgagaaggagcaggccctgatcaggaagaagatggccaaggacacagtggtggtgaggacctacgtggaggaccaggagttccacatcagcagctttgaggagcggctcatcaaggagattgagtaccgcatcatcaagaccaccctggaggagctgctggaggaggatggagaggagaagatggctgtggacatcagcgagagcgaggccgtggagagcggctttgacagccgcatcaagaactaccgcatcctggagggcatgggcgtgaccttccactgcaagatgagcggctaccccctgcccaagatcgcctggtacaaggatggcaagaggatcaagcatggagagcgctaccagatggacttcctgcaggacggccgggccagcctgcgcatccctgtggtgctgcctgaagatgagggcatctacacagcctttgccagcaacatcaagggaaatgccatctgcagcggcaagctgtatgtggagcctgctgcccccctgggcgcccccacctacatccccaccctggagcctgtgagccgcatccgcagcctgagccccaggtctgtgagccgcagccccatccgcatgagccctgccaggatgagccctgccaggatgagccctgccaggatgagccctgccaggatgagccctggaagaaggctggaggagacagatgagagccagctggagcggctgtacaagcctgtgtttgtgctgaagcctgtgtccttcaagtgcctggagggccagacagccaggtttgacctgaaggtggtgggccggcccatgcctgagaccttctggttccatgatggccagcagatcgtgaatgactacacccacaaggtggtgatcaaggaggatggcacccagagcctcatcatcgtgcctgccacccccagcgacagcggggagtggacagtggtggcccagaacagagctggccgcagcagcatcagcgtcatcctgactgtggaggccgtggagcaccaggtgaagcccatgtttgtggagaagctgaagaatgtgaacatcaaggagggcagccggctggagatgaaggtgcgggccaccggcaaccccaacccagacatcgtgtggctgaagaacagcgacatcatcgtgccccacaagtaccccaagatccgcatcgagggcaccaagggggaggccgccctgaagattgacagcacagtgtcccaggacagcgcctggtacacagccacagccatcaacaaggccggccgggacaccacccgctgcaaggtgaatgtggaggtggagtttgctgagcctgagcctgagaggaagctgatcatcccccggggcacctaccgggccaaggagattgctgcccctgagctggagcccctgcacctgcgctatggccaggagcagtgggaggagggggacctgtatgacaaggagaagcagcagaagcccttcttcaagaagaagctgaccagcctgcggctgaagagatttggacctgcccactttgaatgtcggctgacccccatcggggaccccaccatggtggtggagtggctgcatgatggcaagcccctggaggccgccaaccggctgaggatgatcaatgaatttggctactgcagcctggactatggagtggcctacagccgggacagcggcatcatcacctgccgggccaccaacaagtatggaacagaccacaccagcgccaccctgattgtgaaggatgagaagagcctggtggaggagagccagctgcctgagggcaggaagggcctgcagagaattgaggagctggagaggatggcccacgagggcgccctgactggagtgaccacagaccagaaggagaagcagaagccagacatcgtgctgtacccagagcctgtgcgggtgctggagggggagacagcccgcttccgctgccgggtgacaggctacccccagcccaaggtgaactggtacctgaatggccagctgatcaggaagagcaagcgcttccgggtgcgctatgatggcatccactacctggacatcgtggactgcaagagctatgacacaggagaggtgaaggtgacagcagaaaatcctgagggcgtgattgagcacaaggtgaagctggagatccagcagcgggaggacttccgctctgtgctgcggcgggcccctgagcccaggcctgagttccacgtgcatgagcccgggaagctgcagtttgaggtgcagaaggtggacaggcctgtggacaccacagagaccaaggaggtggtgaagctgaagagagctgagcgcatcacccatgagaaggtgcctgaggagagcgaggagctgcggagcaagttcaagagaagaacagaggagggctactatgaggccatcacagctgtggagctgaagagcaggaagaaggatgagagctatgaggagctgctgaggaagaccaaggatgagctgctgcactggaccaaggagctgacagaggaggagaagaaggccctggccgaggagggcaagatcaccatccccaccttcaagccagacaagattgagctgagccccagcatggaggcccccaagatctttgagcgcatccagagccagacagtgggccagggcagtgatgcccacttccgggtgcgggtggtgggcaagccagaccctgaatgtgagtggtacaagaatggagtgaagattgaaagaagtgaccgcatctactggtactggccagaggacaacgtgtgtgagctggtgatcagagatgtgacagctgaggacagcgccagcatcatggtgaaggccatcaacattgctggggagaccagcagccacgccttcctgctggtgcaggccaagcagctgatcaccttcacccaggagctgcaggatgtggtggccaaggagaaggacaccatggccacctttgaatgtgagaccagcgagccctttgtgaaggtgaagtggtacaaggatggcatggaggtgcatgaaggagacaagtacaggatgcacagcgacaggaaggtgcacttcctgagcatcctgaccatcgacaccagtgatgctgaggactacagctgtgtgctggtggaggatgaaaatgtgaagaccacagccaagctgattgtggagggcgctgtggtggagtttgtgaaggagctgcaggacatcgaggtgcctgagagctacagcggggagctggagtgcatcgtgtccccagaaaatattgagggcaagtggtaccacaatgatgtggagctgaagagcaatggcaagtacaccatcaccagcagaagaggccggcagaacctgactgtgaaggatgtgaccaaggaggaccagggcgagtacagctttgtgattgatggcaagaagaccacctgcaagctgaagatgaagccccggcccatcgccatcctgcagggcctgagtgaccagaaggtgtgtgagggggacatcgtgcagctggaggtgaaggtgtccctggagagcgtggagggcgtgtggatgaaggatggccaggaggtgcagcccagcgacagagtgcacatcgtgattgacaagcagagccacatgctgctgattgaggacatgaccaaggaggatgctggcaactacagcttcaccatcccagccctgggcctgagcaccagcggccgggtgtctgtgtacagcgtggatgtgatcacccccctgaaggatgtgaatgtgattgagggcaccaaggctgtgctggagtgcaaggtgtctgtgcctgatgtgacctctgtgaagtggtacctgaatgatgagcagatcaagccagatgacagagtgcaggccatcgtgaagggcaccaagcagaggctggtgatcaacagaacccacgccagtgatgagggcccctacaagctgattgtgggccgggtggagaccaactgcaacctgtctgtggagaagatcaagatcatccggggcctgcgggacctgacctgcacagagacccagaatgtggtgtttgaggtggagctgagccacagcggcattgatgtgctgtggaacttcaaggacaaggagatcaagcccagcagcaagtacaagattgaggcccacggcaagatctacaagctgactgtgctgaacatgatgaaggatgatgagggcaagtacaccttctacgccggggagaacatgaccagcggcaagctgactgtggccggcggggccatcagcaagcccctgacagaccagacagtggccgagagccaggaggccgtgtttgaatgtgaggtggccaacccagacagcaaaggagagtggctgagagatggcaagcacctgcccctgaccaacaacatccgctctgagagtgatggccacaagaggaggctcatcatcgccgccaccaagctggatgacatcggggagtacacctacaaggtggccaccagcaagaccagcgccaagctgaaggtggaggccgtgaagatcaagaagaccctgaagaacctgactgtgacagagacccaggatgctgtgttcaccgtggagctgacccaccccaacgtgaagggcgtgcagtggatcaagaatggagtggtgctggagagcaatgagaagtatgccatctctgtgaagggcaccatctacagcctgcgcatcaagaactgtgccatcgtggatgaatctgtgtatggcttccggctgggccgcctgggcgccagcgcccggctgcacgtggagaccgtgaagatcatcaagaagcccaaggatgtgacagccctggagaatgccaccgtggcctttgaggtgtctgtgtcccatgacacagtgcctgtgaagtggttccacaagtctgtggagatcaagcccagcgacaagcaccggctggtgtctgagaggaaggtgcacaagctgatgctgcagaacatcagccccagtgatgctggggagtacacagctgtggtgggccagctggagtgcaaggccaagctgtttgtggagaccctgcacatcaccaagaccatgaagaacatcgaggtgcctgagaccaagacagccagctttgaatgtgaggtgagccacttcaacgtgcccagcatgtggctgaagaatggagtggagattgagatgtctgagaagttcaagatcgtggtgcagggcaagctgcaccagctgatcatcatgaacaccagcacagaggacagcgctgagtacacctttgtgtgtggaaatgaccaggtgtctgccaccctgactgtgacccccatcatgatcacctccatgctgaaggacatcaatgctgaggagaaggacaccatcacctttgaggtgacagtgaactatgagggcatctcctacaagtggctgaagaatggagtggagatcaagagcacagacaagtgccagatgaggaccaagaagctgacccacagcctgaacatcagaaatgtgcactttggagatgctgctgactacacctttgtggccggcaaggccaccagcacagccaccctgtatgtggaggcccggcacatcgagttcaggaagcacatcaaggacatcaaggtgctggagaagaagagggccatgtttgaatgtgaggtgtctgagccagacatcaccgtgcagtggatgaaggatgaccaggagctgcagatcacagaccgcatcaagatccagaaggagaagtatgtgcaccggctgctgatccccagcaccaggatgtctgatgctgggaagtacacagtggtggccggcggcaatgtgtccacagccaagctgtttgtggagggcagagatgtgcgcatccgcagcatcaagaaggaggtgcaggtgattgagaagcagagagctgtggtggagtttgaggtgaatgaagatgatgtggatgcccactggtacaaggatggcatcgagatcaacttccaggtgcaggagcggcacaagtatgtggtggagcggcgcatccacaggatgttcatcagcgagacccggcagagtgatgctggggagtacacctttgtggccggcaggaacagaagctctgtgaccctgtatgtgaatgcccctgagcccccccaggtgctgcaggagctgcagcctgtgacagtgcagagcggcaagccagcccgcttctgtgccgtcatcagcggccggccccagcccaagatctcctggtacaaggaggagcagctgctgagcacaggcttcaagtgcaagttcctgcatgatggccaggagtacaccctgctgctgattgaggccttcccagaagatgctgctgtgtacacctgtgaggccaagaatgactatggagtggccaccaccagcgccagcctgtctgtggaggtgcctgaggtggtgtccccagaccaggagatgcctgtgtaccccccagccatcatcacccccctgcaggacacagtgaccagcgagggccagcctgcccgcttccagtgccgggtgtctggaacagacctgaaggtgtcctggtacagcaaggacaagaagatcaagcccagccgcttcttcaggatgacccagtttgaggacacctaccagctggagattgctgaggcctacccagaagatgagggcacctacacctttgtggccagcaatgctgtgggccaggtgagcagcacagccaacctgagcctggaggcccctgagagcatcctgcacgagcgcatcgagcaggagattgagatggagatgaaggagctgttcagcgagggggagagcgagcacagcgagcgggacaccagagatgccttcagtgacagcgaggacatcgaccacaagtccatggccgccaagagatatgccagccgcatcagcagcaccagctcctggccagagtacttcaagcccagcttcacccagaagctgaccttcaagtatgtgctggagggggagcctgtggtgttcacctgccgcctcatcgcctgccccaccccagagatgacctggttccacaacaaccggcccatccccaccggcctgcggcgcatcatcaaggccgagagtgacctgcaccaccacagcagcagcctggagatcaagagggtgcaggaccgggacagcggcagctaccgcctgctggccatcaacagcgagggcagcgctgagagcacagccagcctgctggtgatccagaagggccaggatgagaagtacctggagttcctgaagagagctgagaggacccatgaaaatgtggaggccctggtggagcggggggaggaccgcatcaaggtggacctgcgcttcaccggcagccccttcaacaagaagcaggatgtggagcagaagggcatgatgaggaccatccacttcaagaccatgagcagcgccaagaagacagactacatgtatgatgaggagtacctggagagcaagagtgacatccggggctggctgaatgtgggggagagcttcctggacaaggagaccaaggtgaagctgcagaggctgcgggaggccaggaagaccctgatggagaagaagaagctgagcctgctggacaccagcagcgagatcagcagcaggaccctgcggtctgaggccagtgacaaggacatcctcttcagccgggaggacatgaagatccgctccatgtctgacctggccgagagctacaaggtggaccacagcgctgagagcatcgtgcagaacccccacgccctgagcaaccagatggaccagaacatcgagagcgaggagctgcccaccagcttccagaccatcgtggatgaggagatcttccagacagagatccgcatgagccaggaggccctggtgaaggagagcctgcccaaggaccacctgtatggagagatcctggtgaatgaaaacacccaggcccggggccagctggaggagatcatggccaacaccaccatcggggagagcagcacctacatcaccaacgtgtgtgagaaggaggaggtgtatgagaccccagaaaatgtgtcccaggccatcaccccccacgccagcgagagctttggcaccctggtgaatgtggaggagagcgaggagatcgccagcgagcgcatcaagaaggatgacctgcgggagctgcagctgagcgccagcaccagaattgatgagttcaagacagagcagaaggaggagaacatgaggttctttgagaacagcttcaggaagaggccccagcgctgccccccatccttcctgcaggagattgagagccaggaggtgtatgaaggagacagctgcaactttgtgtgccacttccagggctacccccagcccatcgtgacctggtacaacaatgacatgcccatccccaggaaccagaacttcatcatccacagcctggagaactacagcatcctgaccctgagctctgtgcaccaccagaatgaaggcagcatcacctgtgtgctcttcaaccagtatggcaccgtgaagaccacctccatgctgaaggtgaaggccaagcagaagcatgatgtgaaggcccacaaggtgcctgtgttccatgactacctggatgaggaggaggagctggccctggtgtttgaccaggccaagggggcccaccccagcatgagccaggagggccagaccaacctgcacctgctgaagaccaacccccctgtgcccccatctggggacacagagctgctgtccttccctgtggagatccaggtgacagctgccacccccatccctgagcaggacaaggagagcaaggaggtgttccagacagaggagctggagcccaaggccatgccccaggaccaggtgacccagagccccaagcacagatttgtgttcctgagtgacatcaccaatgaaccacccaagatgctgcaggagatgcccaagcacgcccgctgccgggagggggacagcatcatcctggagtgcctgatctctggagagccccagcctgtggtgacctggttccagaatggagtgctgctgaagcagaaccagaagttccagtttgaggaggtgaactgcagccaccagctgtacatcaaggatgtgaacagccaggacagcggcaagtacaagtgtgtggccgagaacaacagcggggctgtggagagcgtgtctgacctgactgtggagcctgtgacctaccgggagaacagccagtttgagaacatcggggagatctacggcaagtacagccgggaccagcagctgcaggaccagggcgagagcgtgcgggcccacttctatgactacccagctggccccttcaccccctggaccaacgtgaaggagtacagcgtgcgggactacttccagagcctggagaccatcgagcagattgaccagaaggagcaggtgcgctgcatccccagccgggagaagatccccaggtttgtgcacggggccagcaggaccatcaagatcagcaagcccatccgggcagagttcatccagtgccaggccgagggcaaggagagacatgtgtctgagaagagcaagctgcaccaggccgagggcaccgtgtacccctttgtggatgacttcagtgatgtgaccatcaagaaggagatccggaacaactttgggaagctgggccgctctgagaaggaaaatgtgcaggagtgtgcccagagcgactacctgcccaacatccacagcgagcgcatcagtgacagctacaacaccaaggacagcagcgccatcgtgtatgaggagagcctgggggaggagatccactacccaggcaagaaggtgaagcaccgcatcattgaatttgagaagctgcacgtggagaagggcgtgctggagaagaggcccaccaggaccagcatcgtgaaccccccccagaagaagattgatgacaaggccttcagcctgaagcagcgggagagccgcagcagcaacctgaatgccaacatgtaccaggccgagaagatgagccccaacacagaaagtgacagcagcaacatcgccatcaacctgaagctgctgagcagccagacccacaaggagtttgatgcccaggagcgggagcagcaggagaagatcagcctgattgacaagccagccatcagcaagagagctgagcacgagagccccatcacctttgacctgaagcagttccacacccagatcaagcacacagatgtgaagttccaggagctggacagcggccagcctgaggaggcctacttcaagatccagcaccctgctgacacagagaacatcgtgtttgacctgaagcagatgtacagccacatcggggaccctgccctggagttccagggccaggagacccgggagcagcaggagatccactacaaggagaagatccccagccctgagaccctgcagcctgacacccacaacatcagcaagtctgtgcagaacaacgtgtttgccagccaggagatcagcagcagccaggagctgagcaacagaaccatggtggagaagagcagcattgatgaaaattccatcagcctggagaaggaggtgcgccacgtgcaggagcagaacctggacatcctgaagacagacctgagcctgaagagcttcagcgaggagatctacagcgagagctgtgccctgctgcccaccagcagcgctgacatcgaggagacagacctgtctgagaagagctgccccctggagaatggaggccgcagcagcatcagccacctgaagaaggccgccagcgaggagaagcccctgggcgtgggggagatggaggaggagtgcaccctggagcctgagctggccgccttccccaagcaggacggcggcacccaggagtacacagatgccaccctggaggaccacagaggagatgtgcaggaggccgacaccctgcaccggcagctgagcctgagccagtgcttccccctgctgatgacagaggagcagcagaaccctggagagcagatcagcaccaacatccacgccagcggggaggagaagtgctatgaggaggtgcaggtgcagaatgaggccagcttcagcaccctggagggggagatgattgagaccagcttcagccagaacatccccaagctggatgaggcccacaccacagaggccgctgagagcgagaccagcctgacccagtacctgctggccgccggcaagcgggaggtgcctgagaccaaggacacccgggaccaggccaagctggtgcagagcgagagcatcacctccatggaggtggaggaggtgaccttcaacacagtgtatgagtactacaaccagaagcaggagagcctgggccggcccctgagccctgagagtgacatcagcattggagtgggcagcaccaccagcgaggagatcagcgagctggaccagttctacaccccacccagctctgtggagtactttgagagccccaagagcccagacctgtacttcaaccccagcgacatcaccaagcagagcagcatccacagcggcggggagaccgtggagcgctacagcacccccctgggggaggtggccgagcgctacagcaccccatctgagggggaggtgggggagcgctacagcaccccacctggagagaccctggagcgctacagcaccccacctggagagaccctggagcgctacagcaccccacctggagagaccctggagcgctacagcaccccacctggagagaccctggagcgctacagcaccccacctggagagaccctggagcgctacagcaccccacctggagaggccctggagcgctacagcatccccactggaggccccaaccccaccggcaccttcaagacctaccccagcaagattgagcgggaggatggcaccccaaatgagcacttctacacccccacagaggagcggggcagcgcctatgagatctggaggagtgacagctttggcaccccaaatgaggccatcgagcccaaggacaatgagatgccacccagcttcatcgagcccctgaccaagaggaaggtgtatgagaacaccaccctgggcttcatcgtggaggtggagggcctgcctgtgcctggggtgaagtggtacagaaacaagagcctgctggagccagatgagcgcatcaagatggagcgggtgggcaatgtgtgcagcctggagatcagcaacatccagaagggggagggcggggagtacatgtgccacgctgtgaacatcattggagaggccaagagctttgccaacgtggacatcatgccccaggaggagcgggtggtggccctgcccccacctgtgacccaccagcacgtgatggagtttgacctggagcacaccaccagcagcaggacccccagcccccaggagatcgtgctggaggtggagctgtctgagaaggatgtgaaggagtttgagaagcaggtgaagatcgtgacagtgcctgagttcaccccagaccacaagtccatgattgtgtccctggatgtgctgcccttcaactttgtggaccccaacatggacagccgggagggggaggacaaggagctgaagattgacctggaggtgtttgagatgccaccccgcttcatcatgcccatctgtgacttcaagatcccagaaaattctgatgctgtgttcaagtgcagcgtcatcggcatccccaccccagaggtgaagtggtacaaggagtacatgtgcatcgagccagacaacatcaagtatgtgatcagcgaggagaagggcagccacaccctgaagatcagaaatgtgtgcctgagtgacagcgccacctaccgctgcagagctgtgaactgtgtgggggaggccatctgccggggcttcctgaccatgggagacagcgagatctttgctgtgattgccaagaagagcaaggtgaccctgagcagcctgatggaggagctggtgctgaagagcaactacacagacagcttctttgagttccaggtggtggagggccccccacgcttcatcaagggcatcagtgactgctacgcccccatcggcacagctgcctacttccagtgcctggtgcggggcagcccccggcccaccgtgtactggtacaaggatggcaagctggtgcagggccgccgcttcaccgtggaggagagcggcaccggcttccacaacctcttcatcaccagcctggtgaagagtgatgaaggagagtaccgctgtgtggccaccaacaagagcggcatggccgagagctttgctgccctgaccctgacctag

SEQ ID NO: 173366 - DNA, 1419 bp, Artificial Sequence
  Description of Artificial Sequence: Synthetic coding sequence
atgtacatctatgaggccagcgaggaggccgtgctggaggagaaggtgctggtgacccagccccagaagaccaagcccaagctggccaaggtgcctgagccccccaagaaggtggtgcctgaggacaagatctacgtgaccatccccaagaagcgggagaccccagccaccaaggagccagacaccacccggggcatcttccctgaggtggagcccccagaggccatccctgagatccctgagcaccccccaacagaggagtttgaggtgttcaaggaggtgattcctgagggggagacccccatcgtgaagaggaggaagacccccagccccacagcccctgaggccatgaaggaggtggtgcctgagatgaagatctttgaagatgtgcctgaggagcctgagacccccaggatgaagaccccagaggccccccaggagatcatcccagccaagacagtgcccagcaagaagcgggagcccccatctgtgaaggtgcctgaggccctgcaggagatcgtgcctgagaagaagaccctggtggtgcccctgaggaagccagaggtgctgcctgatgaggtgcctgaggccctgcgggaggtggtgcctgagaagaaggtgcaccccccccagagagctgaggtggtgcctgtgaaggtgcatgaggcccccaaggagatcatccctgagaagaaggtgtctgtggtgccccccaagaagccagaggtgccccctgtgaaggtgcctgaggccagcaaggaggtgatccgggaggagaaggtgcccctggccccacccaaggagcctgaggtgccccctgtgaaggtgcctgagccccccaaggaggtggtgcctgagaagaaggcccctgtggccccacccaaggagcctgaggtgccccctgtgaaggtgcctgaggcccccaaggaggtggtgcctgagaagaaggtgcctgtgcccccacccaagaagccagaggtgccccccaccaaggtgcctgaggtgcccaaggctgctgtgcctgagaagaagctgcctgaggccatcccccccaagccagagagccccccacctgaggtgcctgaggtgctgccccccaaggaggtggtgcctgagaagaaggtgcctgtgcccccagccaagaagccagaggcccccccacccaaggtgcctgaggcccccaaggaggtggtgctggagaagaaggcctctgtggccgtgcccaagaagccagaggccccccgggccaaggtgcctgaggccgcccaggaggtggtgcctgagaagaagatccccaaggcccccatcaagaagccagaggccccagctgtgacagtgcctgaggtgccccaggagatcgtgcctgagaagaagaccctggtgctgcccaagaagccagaggtgccccctgtgacctag

SEQ ID NO: 173367 - DNA, 1122 bp, Artificial Sequence
  Description of Artificial Sequence: Synthetic coding sequence
gtggtgcctgagaagaaggtgcccctggtggtgcccaagaagccagaggcccccccagccaaggtgcctgaggtgcccaaggaggtggtgcctgagaagaaggtggccgtgcccaagaagccagaggtgcccccagccaaggtgcctgaggtgcccaagaagcctgtgctggaggagaagccagctgtgcctgtgcctgagagagctgagagccccccacctgaggtgtatgaggagcctgaggagatcgcccctgaggaggagatcgcccctgaggaggagaagcctgtgcctgtggccgaggaggaggagcctgaggtgcccccacctgctgtgcctgaggagcccaagaagatcatccctgagaagaaggtgcctgtgatcaagaagccagaggcccccccacccaaggagcctgagatgcccaagaaggtggtgcctgtgaagaaggtgcccaccgtgaagaagccagagaccccagctgccaaggtgcctgaggtgcccaagaagctggtgcctgtgaagaaggagcctgtgcctgtgaccaagaagccagaggtgctgcctgagaaggtgcccaaggtgcctgagaagatcatccctgagaaggaggtgtctgtgcccatcccagctgagcctgaggtgcccccagctgaggtggaggagaccccagaggagatcatctatgaggagaaggccagcatcaccatcggcaggaaggagaccccacctgtggaggagcgggagattgagaagtacatcaagccagaggagcctgagcctgagccccagcctgaggagatccctgtgaaggagcctgagcctgagaaggtgattgagaagcccaagctgaagccccggcccccacctcctcctccagccccacccaaggaggatgtgaaggagaagatcttccagctgaaggccatccccaagaagaaggtgcctgagaagccccaggtgcctgagaaggtggagctgacccccctgaaggtgcctgagcccccaccacccaagcctgtggaggaggtggaggtgcccaccgtgaccaagcgggagaggaagatccctgagcccaccaaggtgcctgagatcaagccagccatccccctgcctgcctag

SEQ ID NO: 173368 - DNA, 543 bp, Artificial Sequence
  Description of Artificial Sequence: Synthetic coding sequence
aaggtgcctgaggtgcccaagaagcctgtgctggaggagaagccagctgtgcctgtgcctgagagagctgagagccccccacctgaggtgtatgaggagcctgaggagatcgcccctgaggaggagatcgcccctgaggaggagaagcctgtgcctgtggccgaggaggaggagcctgaggtgcccccacctgctgtgcctgaggagcccaagaagatcatccctgagaagaaggtgcctgtgatcaagaagccagaggcccccccacccaaggagcctgagcctgagaaggtgattgagaagcccaagctgaagccccggcccccacctcctcctccagccccacccaaggaggatgtgaaggagaagatcttccagctgaaggccatccccaagaagaaggtgcctgagaagccccaggtgcctgagaaggtggagctgacccccctgaaggtgcctggaggagagaagaaggtgaggaagctgctgcctgagaggaagccagagcccaaggaggaggtggtgctgaagagcggcatctag

SEQ ID NO: 173369 - DNA, 438 bp, Artificial Sequence
  Description of Artificial Sequence: Synthetic coding sequence
gaagacacctaccagctggagattgctgaggcctacccagaagatgagggcacctacacctttgtggccagcaatgctgtgggccaggtgagcagcacagccaacctgagcctggaggcccctgagagcatcctgcacgagagaattgagcaggagattgagatggagatgaaggagctgttcagcgagggggagagcgagcacagcgagcgggacaccagagatgccttcagtgacagtgaagatattgaccacaagtccatggccgccaagagatatgccagccgcatcagcagcaccagctcctggccagagtacttcaagcccagcttcacccagaagctgaccttcaagtatgtgctggagggggagcctgtggtgttcacctgccgcctgattgcctgccccaccccagagatgacctggttccacaactag

SEQ ID NO: 173370 - DNA, 546 bp, Artificial Sequence
  Description of Artificial Sequence: Synthetic coding sequence
atgttctttgccagccacacagaggaggaggtgtctgtgacagtgcctgaggtgcagaaggagatcgtgacagaggagaagatccacgtggccatcagcaagagggtggagcccccacccaaggtgcctgagctgcctgagaagccagcccctgaggaggtggcccctgtgcccatccccaagaaggtggagcccccagcccccaaggtgcctgaggtgcccaagaagcctgtgcctgaggagaagaagcctgtgcctgtgcccaagaaggagcctgctgccccacccaaggtgcctgaggtgcccaagaagcctgtgcctgaggagaagatccctgtgcctgtggccaagaagaaggaggcccccccagccaaggtgcctgagatccccaagaagaaggtgcctgaggagaggaagcctgtgcccaggaaggaggaggaggtgcccccaccacccaaggtgcctgccctgcccaagaagcctgtgcctgaggagaaggtggccgtgcctgtgcctgtggccaagaaggcccctcctccaagatag

SEQ ID NO: 173371 - DNA, 2490 bp, Artificial Sequence
  Description of Artificial Sequence: Synthetic coding sequence
gtggaggagttcatcaagctggagcagcaccgggtggaggaggagcaccgggtggagaaggtgcaccgggtgattgaggtgtttgaggccgaggaggtggaggtgtttgagaagcccaaggccccacccaagggccctgagatcagcgagaagatcatcccccccaagaagccacccaccaaggtggtgcccaggaaggagcccccagccaaggtgcctgaggtgcccaagaagatcgtggtggaggagaaggtgcgggtgcctgaggagccccgggtgccccccaccaaggcccctgaggtgcccaagaagatcgtgcctgaggagaaggtgcgggaggccgtgctgaagaagccagaggtgcccccagccaaggtgcccggcatgcccaagaagtctgtgcaggaggagaagagccccatcgtcatcagcgaggacacagagatgtacatctatgaggccagcgaggaggccgtgctggaggagaaggtgctggtgacccagccccagaagaccaagcccaagctggccaaggtgcctgagccccccaagaaggtggtgcctgaggacaagatctacgtgaccatccccaagaagcgggagaccccagccaccaaggagccagacaccacccggggcatcttccctgaggtggagcccccagaggccatccctgagatccctgagcaccccccaacagaggagtttgaggtgttcaaggaggtgattcctgagggggagacccccatcgtgaagaggaggaagacccccagccccacagcccctgaggccatgaaggaggtggtgcctgagatgaagatctttgaagatgtgcctgaggagcctgagacccccaggatgaagaccccagaggccccccaggagatcatcccagccaagacagtgcccagcaagaagcgggagcccccatctgtgaaggtgcctgaggccctgcaggagatcgtgcctgagaagaagaccctggtggtgcccctgaggaagccagaggtgctgcctgatgaggtgcctgaggccctgcgggaggtggtgcctgagaagaaggtgcaccccccccagagagctgaggtggtgcctgtgaaggtgcatgaggcccccaaggagatcatccctgagaagaaggtgtctgtggtgccccccaagaagccagaggtgccccctgtgaaggtgcctgaggccagcaaggaggtgatccgggaggagaaggtgcccctggccccacccaaggagcctgaggtgccccctgtgaaggtgcctgagccccccaaggaggtggtgcctgagaagaaggcccctgtggccccacccaaggagcctgaggtgccccctgtgaaggtgcctgaggcccccaaggaggtggtgcctgagaagaaggtgcctgtgcccccacccaagaagccagaggtgccccccaccaaggtgcctgaggtgcccaaggctgctgtgcctgagaagaagctgcctgaggccatcccccccaagccagagagccccccacctgaggtgcctgaggtgctgccccccaaggaggtggtgcctgagaagaaggtgcctgtgcccccagccaagaagccagaggcccccccacccaaggtgcctgaggcccccaaggaggtggtgctggagaagaaggcctctgtggccgtgcccaagaagccagaggccccccgggccaaggtgcctgaggccgcccaggaggtggtgcctgagaagaagatccccaaggcccccatcaagaagccagaggccccagctgtgacagtgcctgaggtgccccaggagatcgtgcctgagaagaagaccctggtgctgcccaagaagccagaggtgccccctgtgacagtgcctgaggcccccaaggaggtggtgctggagaagaaggtgcccagcgccccacccaagaagccagaggtgccccctgtgaaggtgcctgaggcccccaaggaggtggtgcctgagaagaaggtgcctgtgcccccacccaagaagccagaggtgccccccaccaaggtgcctgaggtgcccaaggctgctgtgcctgagaagaaggtgcctgaggccatcccccccaagccagagagccccccacctgaggtgcctgaggtgctgccccccaaggaggtggtgcctgagaagaaggtgcctgtgcccccagccaagaagccagaggcccccccacccaaggtgcctgaggcccccaaggaggtggtgctggagaagaaggcctctgtggccgtgcccaagaagccagaggccccccgggccaaggtgcctgaggccgcccaggaggtggtgcctgagaagaagatccccaaggcccccatcaagaagccagaggccccagctgtgacagtgcctgaggtgccccaggaggccgctgagaaggagatccctgtggccccacccaagaagccagaggcccccatcgtgcctgtgcctgaggcccaggaggtggtgcctgagaagaagtag

SEQ ID NO: 173372 - DNA, 504 bp, Artificial Sequence
  Description of Artificial Sequence: Synthetic coding sequence
atggccaccagcgagctgagctgtgaggtgtctgaggagaactgtgaaagaagagaggccttctgggccgagtggaaggacctgaccctgagcaccaggcctgaggagggctgcagcctgcacgaggaggacacccagagacatgagacctaccaccagcagggccagtgccaggtgctggtgcagaggagcccctggctgatgatgaggatgggcatcctgggccggggcctgcaggagtaccagctgccctaccagagggtgctgcccctgcccatcttcaccccagccaagatgggcgccaccaaggaggagcgggaggacacccccatccagctgcaggagctgctggccctggagacagccctgggcggccagtgtgtggaccggcaggaggtggccgagatcaccaagcagctgccccctgtggtgcctgtgtccaagccaggggccctgcggcgcagcctgagccgctccatgagccaggaggcccagaggggctag

SEQ ID NO: 173373 - DNA, 744 bp, Artificial Sequence
  Description of Artificial Sequence: Synthetic coding sequence
atggccggcggcgtgctgcccctgcggggcctgcgggccctgtgccgggtgctgctcttcctgagccagttctgcatcctgagcggcggggagcagagccaggccctggcccagagcatcaaggaccccggccccaccaggaccttcaccgtggtgcccagggctgctgagagcacagagatccccccctacgtgatgaagtgccccagcaatggcctgtgcagccggctgcctgctgactgcatcgactgcaccaccaacttcagctgcacctacggcaagcctgtgacctttgactgtgctgtgaagcccagcgtgacctgtgtggaccaggacttcaagagccagaagaacttcatcatcaacatgacctgccgcttctgctggcagctgcctgagacagattatgaatgtaccaacagcaccagctgcatgacagtgtcctgcccccggcagcgctacccagccaactgcaccgtgcgggaccacgtgcactgcctgggcaacagaaccttccccaagatgctgtactgcaactggacaggaggctacaagtggagcacagccctggccctgagcatcaccctgggcggctttggagctgaccgcttctacctgggccagtggagggagggcctgggcaagctgttctcctttggaggcctgggcatctggaccctgattgatgtgctgctgattggagtgggctacgtgggccctgcagatggcagcctgtacatctag

SEQ ID NO: 173374 - DNA, 666 bp, Artificial Sequence
  Description of Artificial Sequence: Synthetic coding sequence
atggccggcggcgtgctgcccctgcggggcctgcgggccctgtgccgggtgctgctcttcctgagccagttctgcatcctgagcggcggggagagcacagagatccccccctacgtgatgaagtgccccagcaatggcctgtgcagccggctgcctgctgactgcatcgactgcaccaccaacttcagctgcacctacggcaagcctgtgacctttgactgtgctgtgaagcccagcgtgacctgtgtggaccaggacttcaagagccagaagaacttcatcatcaacatgacctgccgcttctgctggcagctgcctgagacagattatgaatgtaccaacagcaccagctgcatgacagtgtcctgcccccggcagcgctacccagccaactgcaccgtgcgggaccacgtgcactgcctgggcaacagaaccttccccaagatgctgtactgcaactggacaggaggctacaagtggagcacagccctggccctgagcatcaccctgggcggctttggagctgaccgcttctacctgggccagtggagggagggcctgggcaagctgttctcctttggaggcctgggcatctggaccctgattgatgtgctgctgattggagtgggctacgtgggccctgcagatggcagcctgtacatctag

SEQ ID NO: 173375 - DNA, 1251 bp, Artificial Sequence
  Description of Artificial Sequence: Synthetic coding sequence
atggccagcagcagcggcagcagccccaggcctgccccagatgaaaatgagttccccttcggctgccccccaacagtgtgccaggaccccaaggagccccgggccctgtgctgtgccggctgcctgtctgagaaccccagaaatggagaggaccagatctgccccaagtgccgcggggaggacctgcagagcatcagccctggcagccggctgcggacccaggagaaggcccaccctgaggtggccgaggccggcatcggctgcccctttgctggggtgggctgcagcttcaagggcagcccccagagcgtgcaggagcacgaggtgaccagccagaccagccacctgaacctgctgctgggcttcatgaagcagtggaaggcccggctgggctgcggcctggagagcggccccatggccctggagcagaacctgagtgacctgcagctgcaggccgctgtggaggtggccggggacctggaggtggactgctaccgggccccctgcagcgagagccaggaggagctggccctgcagcacttcatgaaggagaagctgctggccgagctggagggcaagctgcgggtgtttgagaacatcgtggccgtgctgaacaaggaggtggaggccagccacctggccctggccaccagcatccaccagagccagctggaccgggagcgcatcctgagcctggagcagagggtggtggagctgcagcagaccctggcccagaaggaccaggccctgggcaagctggagcagagcctgcggctgatggaggaggccagctttgatggcaccttcctgtggaagatcaccaacgtgacccggcgctgccatgaaagtgcctgtggccgcacagtgtccctcttcagccctgccttctacacagccaagtatggctacaagctgtgcctgcggctgtacctgaatggagatggcaccgggaagaggacccacctgagcctcttcatcgtcatcatgagaggagaatatgatgccctgctgccctggcccttcaggaacaaggtgaccttcatgctgctggaccagaacaaccgggagcacgccattgatgccttccggccagacctgagcagcgccagcttccagaggccccagagcgagaccaacgtggccagcggctgccccctcttcttccccctgagcaagctgcagagccccaagcacgcctacgtgaaggatgacaccatgttcctgaagtgcatcgtggagaccagcacctag

SEQ ID NO: 173376 - DNA, 1251 bp, Artificial Sequence; identical to SEQ ID NO: 173375
  Description of Artificial Sequence: Synthetic coding sequence

SEQ ID NO: 173377 - DNA, 885 bp, Artificial Sequence
  Description of Artificial Sequence: Synthetic coding sequence
atgaagcagtggaaggcccggctgggctgcggcctggagagcggccccatggccctggagcagaacctgagtgacctgcagctgcaggccgctgtggaggtggccggggacctggaggtggactgctaccgggccccctgcagcgagagccaggaggagctggccctgcagcacttcatgaaggagaagctgctggccgagctggagggcaagctgcgggtgtttgagaacatcgtggccgtgctgaacaaggaggtggaggccagccacctggccctggccaccagcatccaccagagccagctggaccgggagcgcatcctgagcctggagcagagggtggtggagctgcagcagaccctggcccagaaggaccaggccctgggcaagctggagcagagcctgcggctgatggaggaggccagctttgatggcaccttcctgtggaagatcaccaacgtgacccggcgctgccatgaaagtgcctgtggccgcacagtgtccctcttcagccctgccttctacacagccaagtatggctacaagctgtgcctgcggctgtacctgaatggagatggcaccgggaagaggacccacctgagcctcttcatcgtcatcatgagaggagaatatgatgccctgctgccctggcccttcaggaacaaggtgaccttcatgctgctggaccagaacaaccgggagcacgccattgatgccttccggccagacctgagcagcgccagcttccagaggccccagagcgagaccaacgtggccagcggctgccccctcttcttccccctgagcaagctgcagagccccaagcacgcctacgtgaaggatgacaccatgttcctgaagtgcatcgtggagaccagcacctag

SEQ ID NO: 173378 - DNA, 2076 bp, Artificial Sequence
  Description of Artificial Sequence: Synthetic coding sequence
atgaatgctgctgtggtgcggaggacccaggaggccctgggcaaggtgatccggcggccccccctgacagagaagctgctgagcaagccacccttccgctacctgcatgacatcatcacagaggtgatccgcatgacaggcttcatgaagggcctgtacacagatgctgagatgaagagtgacaacgtgaaggacaaggatgccaagatctccttcctgcagaaggccattgatgtggtggtgatggtgtctggagagcccctgctggccaagccagccagaattgtggccggccacgagcctgagaggaccaatgagctgctgcagatcatcggcaagtgctgcctgaacaagctgagcagtgatgatgctgtgcggcgggtgctggccggggagaagggggaggtgaagggccgggccagcctgaccagccgcagccaggagctggacaacaagaatgtgcgggaggaggagagccgggtgcacaagaacacagaggacagaggagatgctgagatcaaggagaggagcaccagccgggacaggaagcagaaggaggagctgaaggaggacaggaagccccgggagaaggacaaggacaaggagaaggccaaggaaaatggaggcaacagacaccgggagggggagcgggagcgggccaaggcccgggcccggccagacaatgaaaggcagaaggaccggggcaaccgggagcgggaccgggacagcgagaggaagaaggagacagagaggaagtctgagggcggcaaggagaaggagcggctgcgggaccgggaccgggagcgggaccgggacaagggcaaggaccgggacagaagaagagtgaagaatggagagcacagctgggacctggaccgggagaagaaccgggagcatgacaagccagagaagaagagcgccagcagtggagagatgagcaagaagctgagtgatggcaccttcaaggacagcaaggccgagacagaaacagagatcagcacccgggccagcaagagcctgaccaccaagaccagcaagagaagaagcaagaacagcgtggagggcaggaaggaggacaacatcagcgccaagagcctggacagcatcgtgtctggcatcaacaatgagcccaaccaggagaccaccaccagcgagatcggcaccaaggaggccaacatcaacagcaccagcatcagtgatgacaacagcgccagcctgcgctgtgagaacatccagcccaaccccacagagaagcagaagggggacagcaccagtgatgctgaaggagatgctggccctgctggccaggacaagtctgaggtgcctgagaccccagagatccccaatgagctgagcagcaacatccgccgcatccccaggcctggcagcgcccggcctgccccaccccgggtgaagaggcaggacagcatggaggccctgcagatggacagaagtggcagcggcaagacagtgtccaatgtcatcacagagagccacaacagcgacaatgaagaagatgaccagtttgtggtggaggccgccccccagctgtctgagatgtctgaaattgagatggtgacagctgtggagctggaggaggaggagaagcatggaggcctggtgaagaagatcctggagaccaagaaggactatgagaagctgcagcagagccccaagccaggagagaaggagaggagcctgtttgagagcgcctggaagaaggagaaggacatcgtgtccaaggagattgagaagctgcggaccagcatccagaccctgtgcaagagcgccctgcccctgggcaagatcatggactacatccaggaggatgtggatgccatgcagaatgagctgcagatgtggcacagcgagaaccggcagcacgccgaggccctgcagcaggagcagaggatcacagactgtgctgtggagcccctgaaggccgagctggccgagctggagcagctgatcaaggaccagcaggacaagatctgtgctgtgaaggccaacatcctgaagaatgaggagaagatccagaagatggtgtacagcatcaacctgaccagcagaagatag

SEQ ID NO: 173379 - DNA, 1878 bp, Artificial Sequence
  Description of Artificial Sequence: Synthetic coding sequence
atgaatgctgctgtggtgcggaggacccaggaggccctgggcaaggtgatccggcggccccccctgacagagaagctgctgagcaagccacccttccgctacctgcatgacatcatcacagaggtgatccgcatgacaggcttcatgaagggcctgtacacagatgctgagatgaagagtgacaacgtgaaggacaaggatgccaagatctccttcctgcagaaggccattgatgtggtggtgatggtgtctggagagcccctgctggccaagccagccagaattgtggccggccacgagcctgagaggaccaatgagctgctgcagatcatcggcaagtgctgcctgaacaagctgagcagtgatgatgctgtgcggcgggtgctggccggggagaagggggaggtgaagggccgggccagcctgaccagccgcagccaggagctggacaacaagaatgtgcgggaggaggagagccgggtgcacaagaacacagaggacagaggagatgctgagatcaaggagaggagcaccagccgggacaggaagcagaaggaggagctgaaggaggacaggaagccccgggagaaggacaaggacaaggagaaggccaaggaaaatggaggcaacagacaccgggagggggagcgggagcgggccaaggcccgggcccggccagacaatgaaaggcagaaggaccggggcaaccgggagcgggaccgggacagcgagaggaagaaggagacagagaggaagtctgagggcggcaaggagaaggagcggctgcgggaccgggaccgggagcgggaccgggacaagggcaaggaccgggacagaagaagagtgaagaatggagagcacagctgggacctggaccgggagaagaaccgggagcatgacaagccagagaagaagagcgccagcagtggagagatgagcaagaagctgagtgatggcaccttcaaggacagcaaggccgagacagaaacagagatcagcacccgggccagcaagagcctgaccaccaagaccagcaagagaagaagcaagaacagcgtggagggggacagcaccagtgatgctgaaggagatgctggccctgctggccaggacaagtctgaggtgcctgagaccccagagatccccaatgagctgagcagcaacatccgccgcatccccaggcctggcagcgcccggcctgccccaccccgggtgaagaggcaggacagcatggaggccctgcagatggacagaagtggcagcggcaagacagtgtccaatgtcatcacagagagccacaacagcgacaatgaagaagatgaccagtttgtggtggaggccgccccccagctgtctgagatgtctgaaattgagatggtgacagctgtggagctggaggaggaggagaagcatggaggcctggtgaagaagatcctggagaccaagaaggactatgagaagctgcagcagagccccaagccaggagagaaggagaggagcctgtttgagagcgcctggaagaaggagaaggacatcgtgtccaaggagattgagaagctgcggaccagcatccagaccctgtgcaagagcgccctgcccctgggcaagatcatggactacatccaggaggatgtggatgccatgcagaatgagctgcagatgtggcacagcgagaaccggcagcacgccgaggccctgcagcaggagcagaggatcacagactgtgctgtggagcccctgaaggccgagctggccgagctggagcagctgatcaaggaccagcaggacaagatctgtgctgtgaaggccaacatcctgaagaatgaggagaagatccagaagatggtgtacagcatcaacctgaccagcagaagatag

SEQ ID NO: 173380 - DNA, 2076 bp, Artificial Sequence
  Description of Artificial Sequence: Synthetic coding sequence
atgaatgctgctgtggtgcggaggacccaggaggccctgggcaaggtgatccggcggccccccctgacagagaagctgctgagcaagccacccttccgctacctgcatgacatcatcacagaggtgatccgcatgacaggcttcatgaagggcctgtacacagatgctgagatgaagagtgacaacgtgaaggacaaggatgccaagatctccttcctgcagaaggccattgatgtggtggtgatggtgtctggagagcccctgctggccaagccagccagaattgtggccggccacgagcctgagaggaccaatgagctgctgcagatcatcggcaagtgctgcctgaacaagctgagcagtgatgatgctgtgcggcgggtgctggccggggagaagggggaggtgaagggccgggccagcctgaccagccgcagccaggagctggacaacaagaatgtgcgggaggaggagagccgggtgcacaagaacacagaggacagaggagatgctgagatcaaggagaggagcaccagccgggacaggaagcagaaggaggagctgaaggaggacaggaagccccgggagaaggacaaggacaaggagaaggccaaggaaaatggaggcaacagacaccgggagggggagcgggagcgggccaaggcccgggcccggccagacaatgaaaggcagaaggaccggggcaaccgggagcgggaccgggacagcgagaggaagaaggagacagagaggaagtctgagggcggcaaggagaaggagcggctgcgggaccgggaccgggagcgggaccgggacaagggcaaggaccgggacagaagaagagtgaagaatggagagcacagctgggacctggaccgggagaagaaccgggagcatgacaagccagagaagaagagcgccagcagtggagagatgagcaagaagctgagtgatggcaccttcaaggacagcaaggccgagacagaaacagagatcagcacccgggccagcaagagcctgaccaccaagaccagcaagagaagaagcaagaacagcgtggagggcaggaaggaggacaacatcagcgccaagagcctggacagcatcgtgtctggcatcaacaatgagcccaaccaggagaccaccaccagcgagatcggcaccaaggaggccaacatcaacagcaccagcatcagtgatgacaacagcgccagcctgcgctgtgagaacatccagcccaaccccacagagaagcagaagggcaagaatggaagtgagcgggagggagatgctggccctgctggccaggacaagtctgaggtgcctgagaccccagagatccccaatgagctgagcagcaacatccgccgcatccccaggcctggcagcgcccggcctgccccaccccgggtgaagaggcaggacagcatggaggccctgcagatggacagaagtggcagcggcaagacagtgtccaatgtcatcacagagagccacaacagcgacaatgaagaagatgaccagtttgtggtggaggccgccccccagctgtctgagatgtctgaaattgagatggtgacagctgtggagctggaggaggaggagaagcatggaggcctggtgaagaagatcctggagaccaagaaggactatgagaagctgcagcagagccccaagccaggagagaaggagaggagcctgtttgagagcgcctggaagaaggagaaggacatcgtgtccaaggagattgagaagctgcggaccagcatccagaccctgtgcaagagcgccctgcccctgggcaagatcatggactacatccaggaggatgtggatgccatgcagaatgagctgcagatgtggcacagcgagaaccggcagcacgccgaggccctgcagcaggagcagaggatcacagactgtgctgtggagcccctgaaggccgagctggccgagctggagcagctgatcaaggaccagcaggacaagatctgtgctgtgaaggccaacatcctgaagaatgaggagaagatccagaagatggtgtacagcatcaacctgaccagcagaagatag

SEQ ID NO: 173381 - DNA, 1878 bp, Artificial Sequence
  Description of Artificial Sequence: Synthetic coding sequence
atgaatgctgctgtggtgcggaggacccaggaggccctgggcaaggtgatccggcggccccccctgacagagaagctgctgagcaagccacccttccgctacctgcatgacatcatcacagaggtgatccgcatgacaggcttcatgaagggcctgtacacagatgctgagatgaagagtgacaacgtgaaggacaaggatgccaagatctccttcctgcagaaggccattgatgtggtggtgatggtgtctggagagcccctgctggccaagccagccagaattgtggccggccacgagcctgagaggaccaatgagctgctgcagatcatcggcaagtgctgcctgaacaagctgagcagtgatgatgctgtgcggcgggtgctggccggggagaagggggaggtgaagggccgggccagcctgaccagccgcagccaggagctggacaacaagaatgtgcgggaggaggagagccgggtgcacaagaacacagaggacagaggagatgctgagatcaaggagaggagcaccagccgggacaggaagcagaaggaggagctgaaggaggacaggaagccccgggagaaggacaaggacaaggagaaggccaaggaaaatggaggcaacagacaccgggagggggagcgggagcgggccaaggcccgggcccggccagacaatgaaaggcagaaggaccggggcaaccgggagcgggaccgggacagcgagaggaagaaggagacagagaggaagtctgagggcggcaaggagaaggagcggctgcgggaccgggaccgggagcgggaccgggacaagggcaaggaccgggacagaagaagagtgaagaatggagagcacagctgggacctggaccgggagaagaaccgggagcatgacaagccagagaagaagagcgccagcagtggagagatgagcaagaagctgagtgatggcaccttcaaggacagcaaggccgagacagaaacagagatcagcacccgggccagcaagagcctgaccaccaagaccagcaagagaagaagcaagaacagcgtggagggcacagccaagctgatcctggagggagatgctggccctgctggccaggacaagtctgaggtgcctgagaccccagagatccccaatgagctgagcagcaacatccgccgcatccccaggcctggcagcgcccggcctgccccaccccgggtgaagaggcaggacagcatggaggccctgcagatggacagaagtggcagcggcaagacagtgtccaatgtcatcacagagagccacaacagcgacaatgaagaagatgaccagtttgtggtggaggccgccccccagctgtctgagatgtctgaaattgagatggtgacagctgtggagctggaggaggaggagaagcatggaggcctggtgaagaagatcctggagaccaagaaggactatgagaagctgcagcagagccccaagccaggagagaaggagaggagcctgtttgagagcgcctggaagaaggagaaggacatcgtgtccaaggagattgagaagctgcggaccagcatccagaccctgtgcaagagcgccctgcccctgggcaagatcatggactacatccaggaggatgtggatgccatgcagaatgagctgcagatgtggcacagcgagaaccggcagcacgccgaggccctgcagcaggagcagaggatcacagactgtgctgtggagcccctgaaggccgagctggccgagctggagcagctgatcaaggaccagcaggacaagatctgtgctgtgaaggccaacatcctgaagaatgaggagaagatccagaagatggtgtacagcatcaacctgaccagcagaagatag

SEQ ID NO: 173382 - DNA, 1674 bp, Artificial Sequence
  Description of Artificial Sequence: Synthetic coding sequence
atggcctacagcgaggagcacaagggcatgccctgtggcttcatccggcagaacagcggcaacagcatcagcctggactttgagcccagcattgagtaccagtttgtggagcggctggaggagcgctacaagtgtgccttctgccacagcgtgctgcacaacccccaccagacaggctgcggccaccgcttctgccagcactgcatcctgagcctgcgggagctgaacacagtgcccatctgccctgtggacaaggaggtgatcaagagccaggaggtgttcaaggacaactgctgcaagcgggaggtgctgaacctgtatgtgtactgcagcaatgcccctggctgcaatgccaaggtgatcctgggccgctaccaggaccacctgcagcagtgcctcttccagcctgtgcagtgcagcaatgaaaaatgtcgggagcctgtgctgaggaaggacctgaaggagcacctgagcgccagctgccagttcaggaaggagaagtgcctgtactgcaagaaggatgtggtggtgatcaacctgcagaaccacgaggagaacctgtgcccagagtaccctgtgttctgccccaacaactgtgccaagatcatcctgaagacagaggtggatgagcacctggccgtgtgcccagaggccgagcaggactgccccttcaagcactacggctgtgctgtgacagacaagagaagaaacctgcagcagcacgagcacagcgccctgcgggagcacatgaggctggtgctggagaagaatgtgcagctggaggagcagatcagtgacctgcacaagagcctggagcagaaggagagcaagatccagcagctggccgagaccatcaagaagctggagaaggagttcaagcagtttgcccagctgtttgggaagaatggcagcttcctgcccaacatccaggtgtttgccagccacatcgacaagagcgcctggctggaggcccaggtgcaccagctgctgcagatggtgaaccagcagcagaacaagtttgacctgcggcccctgatggaggccgtggacacagtgaagcagaagatcaccctgctggagaacaatgaccagaggctggccgtgctggaggaggagaccaacaagcatgacacccacatcaacatccacaaggcccagctgagcaagaatgaggagcgcttcaagctgctggagggcacctgctacaacgggaagctgatctggaaggtgacagactacaagatgaagaagcgggaggccgtggatggccacacagtgtccatcttcagccagagcttctacaccagccgctgtggctaccgcctgtgtgcccgggcctacctgaatggagatggcagcggccggggcagccacctgagcctgtactttgtggtgatgagaggagaatttgacagcctgctgcagtggcccttccggcagagggtgaccctgatgctgctggaccagagcggcaagaagaacatcatggagaccttcaagccagaccccaacagcagcagcttcaagaggccagatggagagatgaacatcgccagcggctgccccaggtttgtggcccacagcgtgctggagaatgccaagaatgcctacatcaaggatgacaccctcttcctgaaggtggccgtggacctgacagacctggaggacctgtag

SEQ ID NO: 173383 - DNA, 1674 bp, Artificial Sequence; identical to SEQ ID NO: 173382
  Description of Artificial Sequence: Synthetic coding sequence

SEQ ID NO: 173384 - DNA, 1674 bp, Artificial Sequence; identical to SEQ ID NO: 173382
  Description of Artificial Sequence: Synthetic coding sequence

SEQ ID NO: 173385 - DNA, 1356 bp, Artificial Sequence
  Description of Artificial Sequence: Synthetic coding sequence
atggcctacagcgaggagcacaagggcatgccctgtggcttcatccggcagaacagcggcaacagcatcagcctggactttgagcccagcattgagtaccagtttgtggagcggctggaggagcgctacaagtgtgccttctgccacagcgtgctgcacaacccccaccagacaggctgcggccaccgcttctgccagcactgcatcctgagcctgcgggagctgaacacagtgcccatctgccctgtggacaaggaggtgatcaagagccaggaggtgttcaaggacaactgctgcaagcgggaggtgctgaacctgtatgtgtactgcagcaatgcccctggctgcaatgccaaggtgatcctgggccgctaccaggacaagagaagaaacctgcagcagcacgagcacagcgccctgcgggagcacatgaggctggtgctggagaagaatgtgcagctggaggagcagatcagtgacctgcacaagagcctggagcagaaggagagcaagatccagcagctggccgagaccatcaagaagctggagaaggagttcaagcagtttgcccagctgtttgggaagaatggcagcttcctgcccaacatccaggtgtttgccagccacatcgacaagagcgcctggctggaggcccaggtgcaccagctgctgcagatggtgaaccagcagcagaacaagtttgacctgcggcccctgatggaggccgtggacacagtgaagcagaagatcaccctgctggagaacaatgaccagaggctggccgtgctggaggaggagaccaacaagcatgacacccacatcaacatccacaaggcccagctgagcaagaatgaggagcgcttcaagctgctggagggcacctgctacaacgggaagctgatctggaaggtgacagactacaagatgaagaagcgggaggccgtggatggccacacagtgtccatcttcagccagagcttctacaccagccgctgtggctaccgcctgtgtgcccgggcctacctgaatggagatggcagcggccggggcagccacctgagcctgtactttgtggtgatgagaggagaatttgacagcctgctgcagtggcccttccggcagagggtgaccctgatgctgctggaccagagcggcaagaagaacatcatggagaccttcaagccagaccccaacagcagcagcttcaagaggccagatggagagatgaacatcgccagcggctgccccaggtttgtggcccacagcgtgctggagaatgccaagaatgcctacatcaaggatgacaccctcttcctgaaggtggccgtggacctgacagacctggaggacctgtag

SEQ ID NO: 173386 - DNA, 1569 bp, Artificial Sequence
  Description of Artificial Sequence: Synthetic coding sequence
atgagcctgctgaactgtgagaacagctgtggcagcagccagagcgagagtgactgctgcgtggccatggccagcagctgcagcgctgtgaccaaggatgattctgtgggcggcacagccagcacaggcaacctgagcagcagcttcatggaggagatccagggctatgatgtggagtttgacccccccctggagagcaaatatgaatgtcccatctgcctgatggccctgcgggaggccgtgcagaccccctgtggccaccgcttctgcaaggcctgcatcatcaagagcatcagagatgctggccacaagtgccctgtggacaatgagatcctgctggagaaccagctgttcccagacaactttgccaagcgggagatcctgagcctgatggtgaagtgccccaatgaaggctgcctgcacaagatggagctgcggcacctggaggaccaccaggcccactgtgaatttgccctgatggactgcccccagtgccagaggcccttccagaagttccacatcaacatccacatcctgaaggactgcccccggcggcaggtgtcctgtgacaactgtgccgcctccatggcctttgaggacaaggagatccatgaccagaactgccccctggccaacgtcatctgtgagtactgcaacaccatcctgatccgggagcagatgcccaaccactatgacctggactgccccacagcccccatcccctgcaccttcagcaccttcggctgccacgagaagatgcagaggaaccacctggcccggcacctgcaggagaacacccagagccacatgaggatgctggcccaggccgtgcacagcctgagcgtcatcccagacagcggctacatcagcgaggtgaggaacttccaggagaccatccaccagctggagggccgcctggtgcggcaggaccaccagatccgggagctgacagccaagatggagacccagagcatgtatgtgtctgagctgaagaggaccatccgcaccctggaggacaaggtggccgagattgaggcccagcagtgcaatggcatctacatctggaagattggcaactttggcatgcacctgaagtgccaggaggaggagaagcctgtggtgatccacagccctggcttctacaccgggaagccaggctacaagctgtgcatgaggctgcacctgcagctgcccacagcccagagatgtgccaactacatcagcctgtttgtgcacaccatgcagggcgagtatgacagccacctgccctggcccttccagggcaccatccggctgaccatcctggaccagagcgaggcccctgtgcggcagaaccacgaggagatcatggatgccaagccagagctgctggccttccagaggcccaccatccccaggaaccccaagggcttcggctacgtgaccttcatgcacctggaggccctgcggcagaggaccttcatcaaggatgacaccctgctggtgcgctgtgaggtgtccaccaggtttgacatgggcagcctgcggcgggagggcttccagcccaggagcacagatgctggggtgtag

SEQ ID NO: 173387 - DNA, 1569 bp, Artificial Sequence; identical to SEQ ID NO: 173386
  Description of Artificial Sequence: Synthetic coding sequence

SEQ ID NO: 173388 - DNA, 2013 bp, Artificial Sequence
  Description of Artificial Sequence: Synthetic coding sequence
atgagcagcggcaagagcgcccgctacaaccgcttcagcggcggccccagcaacctgcccaccccagatgtgaccaccggcaccaggatggagaccaccttcggccctgccttctctgctgtgaccaccatcaccaaggcagatggcaccagcacctacaagcagcactgcaggacccccagcagcagcagcaccctggcctacagccccagagatgaggaggacagcatgccacccatcagcaccccccggcggagtgacagcgccatctctgtgcgcagcctgcacagcgagagctccatgagcctgcggagcaccttcagcctgcctgaggaggaggaggagcctgagcccctggtgtttgctgagcagcccagcgtgaagctgtgctgccagctgtgctgcagcgtcttcaaggaccctgtgatcaccacctgtggccacaccttctgccgccgctgtgccctgaagtctgagaagtgccctgtggacaacgtgaagctgactgtggtggtgaacaacattgctgtggccgagcagattggagagctgttcatccactgccgccacggctgccgggtggccggcagcggcaagccacccatctttgaggtggacccccggggctgccccttcaccatcaagctgagcgccaggaaggaccacgagggcagctgtgactacagacctgtgcgctgccccaacaaccccagctgcccccccctgctgaggatgaacctggaggcccacctgaaggaatgtgagcacatcaagtgcccccacagcaaatatggctgcaccttcatcggcaaccaggacacctatgagacccacctggagacctgccgctttgagggcctgaaggagttcctgcagcagacagatgaccgcttccacgagatgcacgtggccctggcccagaaggaccaggagatcgccttcctgcgctccatgctgggcaagctgtctgagaagattgaccagctggagaagagcctggagctgaagtttgatgtgctggatgagaaccagagcaagctgtctgaggacctgatggagttcagaagagatgcctccatgctgaatgatgagctgagccacatcaatgcccggctgaacatgggcatcctgggcagctatgacccccagcagatcttcaagtgcaagggcacctttgtgggccaccagggccctgtgtggtgcctgtgtgtgtacagcatgggagacctgctcttcagcggcagcagtgacaagaccatcaaggtgtgggacacctgcaccacctacaagtgccagaagaccctggagggccatgatggcatcgtgctggccctgtgcatccagggctgcaagctgtacagcggcagcgctgactgcaccatcatcgtgtgggacatccagaacctgcagaaggtgaacaccatccgggcccatgacaaccctgtgtgcaccctggtgagcagccacaacgtgctcttcagcggcagcctgaaggccatcaaggtgtgggacatcgtgggcacagagctgaagctgaagaaggagctgaccggcctgaaccactgggtgcgggccctggtggccgcccagagctacctgtacagcggcagctaccagaccatcaagatctgggacatccgcaccctggactgcatccacgtgctgcagaccagcggcggctctgtgtacagcattgctgtgaccaaccaccacatcgtgtgtggcacctatgagaacctgatccacgtgtgggacatcgagagcaaggagcaggtgaggaccctgaccggccacgtgggcaccgtgtatgccctggccgtcatcagcaccccagaccagaccaaggtgttcagcgccagctatgacaggagcctgcgggtgtggagcatggacaacatgatctgcacccagaccctgctgcggcaccagggctctgtgacagccctggccgtgtcccggggccgcctcttcagcggggctgtggacagcacagtgaaggtgtggacctgctag

SEQ ID NO: 173389 - DNA, 2115 bp, Artificial Sequence
  Description of Artificial Sequence: Synthetic coding sequence
atggcccgggagctgcgggccctgctgctgtggggccgccgcctgcggcccctgctgcgggccccagccctggccgctgtgcctgggggcaagcccatcctgtgccccaggaggaccacagcccagctgggccccaggagaaatcctgcctggagcctgcaggccggccgcctcttcagcacccagacagctgaggacaaggaggagcccctgcacagcatcatcagcagcacagagagcgtgcagggcagcaccagcaagcatgagttccaggccgagaccaagaagctgctggacatcgtggcccggagcctgtacagcgagaaggaggtgttcatccgggagctgatcagcaatgccagtgatgccctggagaagctgcggcacaagctggtgtctgatggccaggccctgcctgagatggagatccacctgcagaccaatgctgagaagggcaccatcaccatccaggacacaggaattggcatgacccaggaggagctggtgagcaacctgggcaccatcgcccggagcggcagcaaggccttcctggatgccctgcagaaccaggccgaggccagcagcaagatcatcggccagtttggagtgggcttctacagcgccttcatggtggccgacagagtggaggtgtacagccgctctgctgcccctggcagcctgggctaccagtggctgagtgatggcagcggcgtgtttgaaattgctgaggccagcggcgtgaggacaggcaccaagatcatcatccacctgaagagtgactgcaaggagttcagcagcgaggcccgggtgagagatgtggtgaccaagtacagcaactttgtgtccttccccctgtacctgaatggccgcaggatgaacaccctgcaggccatctggatgatggaccccaaggatgtgcgggagtggcagcacgaggagttctaccgctacgtggcccaggcccatgacaagccccgctacaccctgcactacaagacagatgcccccctgaacatccgcagcatcttctacgtgcctgacatgaagcccagcatgtttgatgtgtcccgggagctgggcagctctgtggccctgtacagcaggaaggtgctgatccagaccaaggccacagacatcctgcccaagtggctgcgcttcatccggggcgtggtggacagcgaggacatccccctgaacctgagccgggagctgctgcaggagagcgccctgatcaggaagctgagagatgtgctgcagcagaggctcatcaagttcttcatcgaccagagcaagaaggatgctgagaagtatgccaagttctttgaggactatggcctcttcatgagggagggcatcgtgacagccacagagcaggaggtgaaggaggacatcgccaagctgctgcgctatgagagcagcgccctgcccagcggccagctgaccagcctgtctgaatatgccagcaggatgagagctggcaccaggaacatctactacctgtgtgcccccaacagacacctggccgagcacagcccctactatgaggccatgaagaagaaggacacagaggtgctcttctgctttgagcagtttgatgagctgaccctgctgcacctgcgggagtttgacaagaagaagctgatctctgtggagacagacatcgtggtggaccactacaaggaggagaagtttgaagatagaagccctgctgctgagtgcctgtctgagaaggagacagaggagctgatggcctggatgagaaatgtgctgggcagccgggtgaccaacgtgaaggtgaccctgcggctggacacccacccagccatggtgacagtgctggagatgggcgccgcccggcacttcctgaggatgcagcagctggccaagacccaggaggagcgggcccagctgctgcagcccaccctggagatcaaccccaggcatgccctgatcaagaagctgaaccagctgcgggccagcgagcccggcctggcccagctgctggtggaccagatctatgaaaatgccatgattgctgctggcctggtggatgacccccgggccatggtgggccgcctgaatgagctgctggtgaaggccctggagcggcactag

SEQ ID NO: 173390 - DNA, 1956 bp, Artificial Sequence
  Description of Artificial Sequence: Synthetic coding sequence
atggcccgggagctgcgggccctgctgctgtggggccgccgcctgcggcccctgctgcgggccccagccctggccgctgtgcctgggggcagcaccagcaagcatgagttccaggccgagaccaagaagctgctggacatcgtggcccggagcctgtacagcgagaaggaggtgttcatccgggagctgatcagcaatgccagtgatgccctggagaagctgcggcacaagctggtgtctgatggccaggccctgcctgagatggagatccacctgcagaccaatgctgagaagggcaccatcaccatccaggacaccggcatcggcatgacccaggaggagctggtgagcaacctgggcaccatcgcccggagcggcagcaaggccttcctggatgccctgcagaaccaggccgaggccagcagcaagatcatcggccagtttggagtgggcttctacagcgccttcatggtggccgacagagtggaggtgtacagccgctctgctgcccctggcagcctgggctaccagtggctgagtgatggcagcggcgtgtttgaaattgctgaggccagcggcgtgaggacaggcaccaagatcatcatccacctgaagagtgactgcaaggagttcagcagcgaggcccgggtgagagatgtggtgaccaagtacagcaactttgtgtccttccccctgtacctgaatggaagaaggatgaacaccctgcaggccatctggatgatggaccccaaggatgtgcgggagtggcagcacgaggagttctaccgctacgtggcccaggcccatgacaagccccgctacaccctgcactacaagacagatgcccccctgaacatccgcagcatcttctacgtgcctgacatgaagcccagcatgtttgatgtgtcccgggagctgggcagctctgtggccctgtacagcaggaaggtgctgatccagaccaaggccacagacatcctgcccaagtggctgcgcttcatccggggcgtggtggacagcgaggacatccccctgaacctgagccgggagctgctgcaggagagcgccctgatcaggaagctgagagatgtgctgcagcagaggctcatcaagttcttcatcgaccagagcaagaaggatgctgagaagtatgccaagttctttgaagattatggcctcttcatgagggagggcatcgtgacagccacagagcaggaggtgaaggaggacatcgccaagctgctgcgctatgagagcagcgccctgcccagcggccagctgaccagcctgtctgaatatgccagcaggatgagagctggcaccaggaacatctactacctgtgtgcccccaacagacacctggccgagcacagcccctactatgaggccatgaagaagaaggacacagaggtgctcttctgctttgagcagtttgatgagctgaccctgctgcacctgcgggagtttgacaagaagaagctgatctctgtggagacagacatcgtggtggaccactacaaggaggagaagtttgaggacaggagccctgctgctgaatgtctgtctgagaaggagacagaggagctgatggcctggatgagaaatgtgctgggcagccgggtgaccaacgtgaaggtgaccctgcggctggacacccacccagccatggtgacagtgctggagatgggcgccgcccggcacttcctgaggatgcagcagctggccaagacccaggaggagcgggcccagctgctgcagcccaccctggagatcaaccccaggcatgccctgatcaagaagctgaaccagctgcgggccagcgagcccggcctggcccagctgctggtggaccagatctatgaaaatgccatgattgctgctggcctggtggatgacccccgggccatggtgggccgcctgaatgagctgctggtgaaggccctggagcggcactag

SEQ ID NO: 173391 - DNA, 1911 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgcccagagaagatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaaggccagcggggagcgctaccacgtggagccccaccctgagcacctgtgtggggcctacccctatgcctacccacccatgcctgccatggtgccccaccacggctttgaggactggagccagatccgctacccacctccacccatggccatggagcaccccccacccctgcccaacagccgcctcttccacctgcctgagtacacctggaggctgccctgtggcggcgtgaggaaccccaaccagagcagccaggtgatggaccccccaacagcccggcccacagagcctgagagccccaagaatgaccgggagggcccccagtag

SEQ ID NO: 173392 - DNA, 1911 bp, Artificial Sequence; identical to SEQ ID NO: 173391
  Description of Artificial Sequence: Synthetic coding sequence

SEQ ID NO: 173393 - DNA, 1590 bp, Artificial Sequence
  Description of Artificial Sequence: Synthetic coding sequence
atgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagccagagtacacctggaggctgccctgtggcggcgtgaggaaccccaaccagagcagccaggtgatggaccccccaacagcccggcccacagagcctgagagccccaagaatgaccgggagggcccccagtag

SEQ ID NO: 173394 - DNA, 1908 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgcccagagaagatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaaggccagcggggagcgctaccacgtggagccccaccctgagcacctgtgtggggcctacccctatgcctacccacccatgcctgccatggtgccccaccacggctttgaggactggagccagatccgctacccacctccacccatggccatggagcaccccccacccctgcccaacagccgcctcttccacctgcctgagtacacctggaggctgccctgtggcggcgtgaggaaccccaaccagagcagccaggtgatggaccccccaacagcccggcccacagagcctgagcctgctgacctgcggctgcccaggaactag

SEQ ID NO: 173395 - DNA, 1479 bp, Artificial Sequence
  Description of Artificial Sequence: Synthetic coding sequence
atggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagggcacccaccggggctgccccaggcacctgcctgagaggaaggtgaagtag

SEQ ID NO: 173396 - DNA, 435 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgcctag

SEQ ID NO: 173397 - DNA, 1752 bp, Artificial Sequence
  Description of Artificial Sequence: Synthetic coding sequence
atggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaaggccagcggggagcgctaccacgtggagccccaccctgagcacctgtgtggggcctacccctatgcctacccacccatgcctgccatggtgccccaccacggctttgaggactggagccagatccgctacccacctccacccatggccatggagcaccccccacccctgcccaacagccgcctcttccacctgcctgagtacacctggaggctgccctgtggcggcgtgaggaaccccaaccagagcagccaggtgatggaccccccaacagcccggcccacagagcctgagagccccaagaatgaccgggagggcccccagtag

SEQ ID NO: 173398 - DNA, 402 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagtag

SEQ ID NO: 173399 - DNA, 1911 bp, Artificial Sequence; identical to SEQ ID NO: 173391
  Description of Artificial Sequence: Synthetic coding sequence

SEQ ID NO: 173400 - DNA, 774 bp, Artificial Sequence
  Description of Artificial Sequence: Synthetic coding sequence
atggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtag

SEQ ID NO: 173401 - DNA, 1911 bp, Artificial Sequence; identical to SEQ ID NO: 173391
  Description of Artificial Sequence: Synthetic coding sequence

SEQ ID NO: 173402 - DNA, 1719 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgcccagagaagatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagccagagtacacctggaggctgccctgtggcggcgtgaggaaccccaaccagagcagccaggtgatggaccccccaacagcccggcccacagagcctgagagccccaagaatgaccgggagggcccccagtag

SEQ ID NO: 173403 - DNA, 1908 bp, Artificial Sequence; identical to SEQ ID NO: 173394
  Description of Artificial Sequence: Synthetic coding sequence

SEQ ID NO: 173404 - DNA, 1671 bp, Artificial Sequence
  Description of Artificial Sequence: Synthetic coding sequence
atggagggccggggcccctaccgcatctatgaccccggcggctctgtgcccagcggggaggccagcgctgcctttgagcggctggtgaaggagaacagccggctgaaggagaagatgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgcccagagaagatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagagcctgcagaagatgacagtgcggggcctgtctgagacccggctgtgccacctggccccacccagcagctgccgggccagctag

SEQ ID NO: 173405 - DNA, 1797 bp, Artificial Sequence
  Description of Artificial Sequence: Synthetic coding sequence
atgcagggcatcaagatgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgcccagagaagatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaaggccagcggggagcgctaccacgtggagccccaccctgagcacctgtgtggggcctacccctatgcctacccacccatgcctgccatggtgccccaccacggctttgaggactggagccagatccgctacccacctccacccatggccatggagcaccccccacccctgcccaacagccgcctcttccacctgcctgagtacacctggaggctgccctgtggcggcgtgaggaaccccaaccagagcagccaggtgatggaccccccaacagcccggcccacagagcctgagagccccaagaatgaccgggagggcccccagtag

SEQ ID NO: 173406 - DNA, 1542 bp, Artificial Sequence
  Description of Artificial Sequence: Synthetic coding sequence
atgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagagcctgcagaagatgacagtgcggggcctgtctgagacccggctgtgccacctggccccacccagcagctgccgggccagctag

SEQ ID NO: 173407 - DNA, 1509 bp, Artificial Sequence
  Description of Artificial Sequence: Synthetic coding sequence
atgctgggggagctgctggaggagagccagatggaggccacccggctgcggcagaaggccgaggagctggtgaaggacaatgagctgctgcccccacccagccccagcctgggcagctttgaccccctggccgagctgaccgggaaggacagcaatgtgacagccagccccacagccccagcctgccccagcgacaagccagcccctgtgcagaagccacccagcagcggcaccagcagcgagtttgaggtggtgaccccagaggagcagaacagccctgagagcagcagccacgccaatgccatggccctgggccccctgccccgggaggatggcaacctgatgctgcacctgcagaggctggagaccaccctgtctgtgtgtgccgaggagccagaccacggccagctgttcacccacctgggccgcatggccctggagttcaaccggctggccagcaaggtgcacaagaatgagcagaggaccagcatcctgcagaccctgtgtgagcagctgaggaaagaaaatgaggccctgaaggccaagctggacaagggcctggagcagagggaccaggccgctgagcggctgcgggaggagaacctggagctgaagaagctgctgatgagcaatggaaacaaggagggcgccagcggccggcccggcagccccaagatggagggcaccgggaagaaggctgtggccggccagcagcaggcctctgtgacagctgggaaggtgcctgaggtggtggccctgggcgctgctgagaagaaggtgaagatgctggagcagcagaggtctgagctgctggaggtgaacaagcagtgggaccagcacttccgctccatgaagcagcagtatgagcagaagatcacagagctgcggcagaagctggccgacctgcagaagcaggtgacagacctggaggccgagcgggagcagaagcagagggactttgacaggaagctgctgctggccaagagcaagattgagatggaggagacagacaaggagcagctgacagctgaggccaaggagctgcggcagaaggtgaagtacctgcaggaccagctgagccccctgacccggcagcgggagtaccaggagaaggagatccagaggctgaacaaggccctggaggaggccctgagcatccagaccccacccagcagccccccaacagccttcggcagccctgagggcgctggggccctgctgaggaagcaggagctggtgacccagaatgagctgctgaagcagcaggtgaagatctttgaggaggacttccagcgggagaggagtgaccgggagaggatgaatgaggagaaggaggagctgaagaagcaggtggagaagctgcaggcccaggtgaccctgagcaatgcccagctgaaggccttcaaggatgaggagaaggcccgggaggccctgcggcagcagaagaggaaggccaagggcacccaccggggctgccccaggcacctgcctgagaggaaggtgaagtag

SEQ ID NO: 173408 - DNA, 1290 bp, Artificial Sequence
  Description of Artificial Sequence: Synthetic coding sequence
atgagccgggaccccggcagcggcggctgggaggaggcccccagggctgctgctgccctgtgcaccctgtaccatgaagctggccagaggctgcggcggctgcaggaccagctggccgccagagatgccctgattgcccggctgcgggcccggctggccgccctggagggagatgctgcccccagcctggtggatgccctgctggagcaggtggcccgcttccgggagcagctgcggcggcaggagggcggcgctgctgaggcccagatgaggcaggagattgaaaggctgacagagcggctggaggagaaggagcgggagatgcagcagctgctgagccagccccagcacgagcgggagaaggaggtggtgctgctgcggcgctccatggccgagggggagcgggcccgggccgccagtgatgtgctgtgccgcagcctggccaatgagacccaccagctgcggaggaccctgacagccacagcccacatgtgccagcacctggccaagtgcctggatgagcggcagcacgcccagagaaatgtgggggagaggagcccagaccagagcgagcacacagatggccacacctctgtgcagagcgtgattgagaagctgcaggaggagaaccggctgctgaagcagaaggtgacccacgtggaggacctgaatgccaagtggcagcgctacaatgccagcagagatgaatatgtgcggggcctgcacgcccagctgcggggcctgcagatcccccatgagcctgagctgatgaggaaggagatcagccggctgaaccggcagctggaggagaagatcaatgactgtgccgaggtgaagcaggagctggccgccagcaggacagccagagatgctgccctggagcgggtgcagatgctggagcagcagatcctggcctacaaggatgacttcatgtctgaaagagctgaccgggagcgggcccagagccgcatccaggagctggaggagaaggtggccagcctgctgcaccaggtgtcctggaggcaggacagccgggagccagatgctggccgcatccacgccggcagcaagacagccaagtacctggccgcagatgccctggagctgatggtgcctgggggctggaggcctggcaccggcagccagcagcctgagcccccagctgagggcggccaccctggagctgcccagaggggccagggcgacctgcagtgcccccactgcctgcagtgcttcagtgatgagcagggcgaggagctgctgcggcacgtggccgagtgctgccagtag

SEQ ID NO: 173409 - DNA, 969 bp, Artificial Sequence
  Description of Artificial Sequence: Synthetic coding sequence
atgcagcagctgctgagccagccccagcacgagcgggagaaggaggtggtgctgctgcggcgctccatggccgagggggagcgggcccgggccgccagtgatgtgctgtgccgcagcctggccaatgagacccaccagctgcggaggaccctgacagccacagcccacatgtgccagcacctggccaagtgcctggatgagcggcagcacgcccagagaaatgtgggggagaggagcccagaccagagcgagcacacagatggccacacctctgtgcagagcgtcatcgagaagctgcaggaggagaaccggctgctgaagcagaaggtgacccacgtggaggacctgaatgccaagtggcagcgctacaatgccagcagagatgaatatgtgcggggcctgcacgcccagctgcggggcctgcagatcccccatgagcctgagctgatgaggaaggagatcagccggctgaaccggcagctggaggagaagatcaatgactgtgccgaggtgaagcaggagctggccgccagcaggacagccagagatgctgccctggagcgggtgcagatgctggagcagcagatcctggcctacaaggatgacttcatgtctgaaagagctgaccgggagcgggcccagagccgcatccaggagctggaggagaaggtggccagcctgctgcaccaggtgtcctggaggcaggacagccgggagccagatgctggccgcatccatgctggcagcaagacagccaagtacctggccgcagatgccctggagctgatggtgcctgggggctggaggcctggcaccggcagccagcagcctgagcccccagctgagggcggccaccctggggccgcccagaggggccagggcgacctgcagtgcccccactgcctgcagtgcttcagtgatgagcagggcgaggagctgctgcggcacgtggccgagtgctgccagtag

SEQ ID NO: 173410 - DNA, 837 bp, Artificial Sequence
  Description of Artificial Sequence: Synthetic coding sequence
atggccgaggcccggagccagcccagcgctggcccccagctgaatgccctgcctgaccacagccccctgctgcagcccggcctggccgccctgcggcggcgggcccgggaggccggcgtgcccctggcccccctgcccctgacagacagcttcctgctgcgcttcctgcgggcccgggactttgacctggacctggcctggaggctgctgaagaactactacaagtggagggcagaatgtcctgagatctctgctgacctgcaccccaggagcatcatcggcctgctgaaggccggctaccatggagtgctgcggagccgggaccccaccggcagcaaggtgctgatctacagaattgcccactgggaccccaaggtgttcaccgcctatgatgtgttccgggtgtccctcatcaccagcgagctgattgtgcaggaggtggagacccagagaaatggcatcaaggccatctttgacctggagggctggcagttcagccacgccttccagatcacccccagcgtggccaagaagattgctgctgtgctgacagacagcttccccctgaaggtgcggggcatccacctgatcaatgagcccgtcatcttccacgctgtgttctccatgatcaagcccttcctgacagagaagatcaaggagcgcatccacatgcacggcaacaactacaagcagagcctgctgcagcacttcccagacatcctgcccctggagtatggaggagaggagttctccatggaggacatctgccaggagtggaccaacttcatcatgaagtctgaggactacctgagcagcatcagcgagagcatccagtag

SEQ ID NO: 173411 - DNA, 2361 bp, Artificial Sequence
  Description of Artificial Sequence: Synthetic coding sequence
atgaccagcatcttccactttgccatcatcttcatgctgatcctgcagatccgcatccagctgtctgaggagagcgagttcctggtggacaggagcaagaatggcctcatccacgtgcccaaggacctgagccagaagaccaccatcctgaacatcagccagaactacatcagcgagctgtggaccagtgacatcctgagcctgagcaagctgcgcatcctgatcatcagccacaaccgcatccagtacctggacatctctgtgttcaagttcaaccaggagctggagtacctggacctgagccacaacaagctggtgaagatcagctgccaccccaccgtgaacctgaagcacctggacctgtccttcaatgcctttgatgccctgcccatctgcaaggagtttggaaacatgagccagctgaagttcctgggcctgagcaccacccacctggagaagagctctgtgctgcccatcgcccacctgaacatcagcaaggtgctgctggtgctgggggagacctatggagagaaggaggaccctgagggcctgcaggacttcaacacagagagcctgcacatcgtgttccccaccaacaaggagttccacttcatcctggatgtgtctgtgaagacagtggccaacctggagctgagcaacatcaagtgtgtgctggaggacaacaagtgcagctacttcctgagcatcctggccaagctgcagaccaaccccaagctgagcaacctgaccctgaacaacatcgagaccacctggaacagcttcatccgcatcctgcagctggtgtggcacaccaccgtgtggtacttcagcatcagcaatgtgaagctgcagggccagctggacttccgggactttgactacagcggcaccagcctgaaggccctgagcatccaccaggtggtgtctgatgtgtttggcttcccccagagctacatctatgagatcttcagcaacatgaacatcaagaacttcaccgtgtctggcaccaggatggtgcacatgctgtgccccagcaagatcagccccttcctgcacctggacttcagcaacaacctgctgacagacacagtgtttgagaactgtggccacctgacagagctggagaccctcatcctgcagatgaaccagctgaaggagctgagcaagattgctgagatgaccacccagatgaagagcctgcagcagctggacatcagccagaacagcgtgtcctatgatgagaagaagggggactgctcctggaccaagagcctgctgagcctgaacatgagcagcaacatcctgacagacaccatcttccgctgcctgcccccacgcatcaaggtgctggacctgcacagcaacaagatcaagagcatccccaagcaggtggtgaagctggaggccctgcaggagctgaatgtggccttcaacagcctgacagacctgcccggctgcggcagcttcagcagcctgtctgtgctgatcatcgaccacaacagcgtgagccaccccagcgctgacttcttccagagctgccagaagatgaggagcatcaaggccggggacaaccccttccagtgcacctgtgagctgggggagtttgtgaagaacatcgaccaggtgagcagcgaggtgctggagggctggccagacagctacaagtgtgactacccagagagctaccggggcaccctgctgaaggacttccacatgtctgagctgagctgcaacatcaccctgctgattgtgaccatcgtggccaccatgctggtgctggccgtgacagtgaccagcctgtgcagctacctggacctgccctggtacctgaggatggtgtgccagtggacccagaccaggagaagagccaggaacatccccctggaggagctgcagaggaacctgcagttccacgccttcatctcctacagcggccatgacagcttctgggtgaagaatgagctgctgcccaacctggagaaggagggcatgcagatctgcctgcatgaaagaaactttgtgcctgggaagagcatcgtggagaacatcatcacctgcatcgagaagagctacaagagcatctttgtgctgagccccaactttgtgcagagcgagtggtgccactatgagctgtactttgcccaccacaacctcttccacgagggcagcaacagcctcatcctgatcctgctggagcccatcccccagtacagcatccccagcagctaccacaagctgaagagcctgatggcccggaggacctacctggagtggcccaaggagaagagcaagaggggcctcttctgggccaacctgcgggccgccatcaacatcaagctgacagagcaggccaagaagtag

SEQ ID NO: 173412 - DNA, 2361 bp, Artificial Sequence; identical to SEQ ID NO: 173411
  Description of Artificial Sequence: Synthetic coding sequence

SEQ ID NO: 173413 - DNA, 486 bp, Artificial Sequence
  Description of Artificial Sequence: Synthetic coding sequence
atgaccagcatcttccactttgccatcatcttcatgctgatcctgcagatccgcatccagctgtctgaggagagcgagttcctggtggacaggagcaagaatggcctcatccacgtgcccaaggacctgagccagaagaccaccatcctgaacatcagccagaactacatcagcgagctgtggaccagtgacatcctgagcctgagcaagctgcgcatcctgatcatcagccacaaccgcatccagtacctggacatctctgtgttcaagttcaaccaggagctggagtacctggacctgagccacaacaagctggtgaagatcagctgccaccccaccgtgaacctgaagcacctggacctgtccttcaatgcctttgatgccctgcccatctgcaaggagtttggaaacatgagccagctgaagttcctgggcctgagcaccacccacctggagaagagctctgtgctgcccatcgcccactag

SEQ ID NO: 173414 - DNA, 147 bp, Artificial Sequence
  Description of Artificial Sequence: Synthetic coding sequence
atgaccagcatcttccactttgccatcatcttcatgctgatcctgcagatccgcatccagctgtctgaggagagcgagttcctggtggacaggagcaagaatggcctcatccacgtgcccaaggacctgagccagaagaccacctag

SEQ ID NO: 173415 - DNA, 72 bp, Artificial Sequence
  Description of Artificial Sequence: Synthetic coding sequence
atgaccagcatcttccactttgccatcatcttcatgctgatcctgcagatccgcatccagctgtctgagtag

SEQ ID NO: 173416 - DNA, 273 bp, Artificial Sequence
  Description of Artificial Sequence: Synthetic coding sequence
atgaccagcatcttccactttgccatcatcttcatgctgatcctgcagatccgcatccagctgtctgaggagagcgagttcctggtggacaggagcaagaatggcctcatccacgtgcccaaggacctgagccagaagaccaccatcctgaacatcagccagaactacatcagcgagctgtggaccagtgacatcctgagcctgagcaagctgcgcatcctgatcatcagccacaaccgcatccagtacctggacatctctgtgttcaagtag

SEQ ID NO: 173417 - DNA, 2355 bp, Artificial Sequence
  Description of Artificial Sequence: Synthetic coding sequence
atgccccacaccctgtggatggtgtgggtgctgggcgtcatcatcagcctgagcaaggaggagagcagcaaccaggccagcctgagctgtgacagaaatggcatctgcaagggcagcagcggcagcctgaacagcatccccagcggcctgacagaagctgtgaagagcctggacctgagcaacaaccgcatcacctacatcagcaacagcgacctgcagagatgtgtgaacctgcaggccctggtgctgaccagcaatggcatcaacaccattgaagaagattccttcagcagcctgggcagcctggagcacctggacctgagctacaactacctgagcaacctgagcagctcctggttcaagcccctgagcagcctgaccttcctgaacctgctgggcaacccctacaagaccctgggggagaccagcctcttcagccacctgaccaagctgcagatcctgcgggtgggcaacatggacaccttcaccaagatccagaggaaggactttgctggcctgaccttcctggaggagctggagattgatgccagtgacctgcagagctatgagcccaagagcctgaagagcatccagaatgtgagccacctgatcctgcacatgaagcagcacatcctgctgctggagatctttgtggatgtgaccagctctgtggagtgcctggagctgcgggacacagacctggacaccttccacttcagcgagctgagcactggagagaccaacagcctcatcaagaagttcaccttcagaaatgtgaagatcacagatgagagcctcttccaggtgatgaagctgctgaaccagatcagcggcctgctggagctggagtttgatgactgcaccctgaatggagtgggcaacttccgggccagtgacaatgacagagtcatcgaccccgggaaggtggagaccctgaccatccggcggctgcacatcccccgcttctacctgttctatgacctgagcaccctgtacagcctgacagagcgggtgaagaggatcaccgtggagaacagcaaggtgttcctggtgccctgcctgctgagccagcacctgaagagcctggagtacctggacctgtctgagaacctgatggtggaggagtacctgaagaacagcgcctgtgaagatgcctggcccagcctgcagaccctcatcctgcggcagaaccacctggccagcctggagaagacaggagagaccctgctgaccctgaagaacctgaccaacatcgacatcagcaagaacagcttccacagcatgcctgagacctgccagtggccagagaagatgaagtacctgaacctgagcagcacccgcatccacagcgtgacaggctgcatccccaagaccctggagatcctggatgtgagcaacaacaacctgaacctcttcagcctgaacctgccccagctgaaggagctgtacatcagcaggaacaagctgatgaccctgcctgatgccagcctgctgcccatgctgctggtgctgaagatcagcagaaatgccatcaccaccttcagcaaggagcagctggacagcttccacaccctgaagaccctggaggccggcggcaacaacttcatctgcagctgtgagttcctgtccttcacccaggagcagcaggccctggccaaggtgctgattgactggccagccaactacctgtgtgacagccccagccacgtgcggggccagcaggtgcaggatgtgcggctgtctgtgtctgagtgccacaggacagccctggtgtctggcatgtgctgtgccctcttcctgctgatcctgctgactggagtgctgtgccaccgcttccacggcctgtggtacatgaagatgatgtgggcctggctgcaggccaagaggaagcccaggaaggcccccagcaggaacatctgctatgatgcctttgtgtcctacagcgagagagatgcctactgggtggagaacctgatggtgcaggagctggagaacttcaacccccccttcaagctgtgcctgcacaagagggacttcatccctgggaagtggatcatcgacaacatcatcgacagcattgagaagagccacaagacagtgtttgtgctgtctgaaaattttgtgaagtctgagtggtgcaagtatgagctggacttcagccacttccggctgtttgatgaaaataatgatgctgccatcctgatcctgctggagcccatcgagaagaaggccatcccccagcgcttctgcaagctgaggaagatcatgaacaccaagacctacctggagtggcccatggatgaggcccagcgggagggcttctgggtgaacctgcgggccgccatcaagagctag

SEQ ID NO: 173418 - DNA, 2715 bp, Artificial Sequence
  Description of Artificial Sequence: Synthetic coding sequence
atgaggcagaccctgccctgcatctacttctggggcggcctgctgcccttcggcatgctgtgtgccagcagcaccaccaagtgcaccgtgtcccatgaggtggccgactgcagccacctgaagctgacccaggtgcctgatgacctgcccaccaacatcaccgtgctgaacctgacccacaaccagctgcggcggctgcctgctgccaacttcacccgctacagccagctgaccagcctggatgtgggcttcaacaccatcagcaagctggagcctgagctgtgccagaagctgcccatgctgaaggtgctgaacctgcagcacaatgagctgagccagctgagtgacaagacctttgccttctgcaccaacctgacagagctgcacctgatgagcaacagcatccagaagatcaagaacaacccctttgtgaagcagaagaacctgatcaccctggacctgagccacaacggcctgagcagcaccaagctgggcacccaggtgcagctggagaacctgcaggagctgctgctgagcaacaacaagatccaggccctgaagtctgaggagctggacatctttgccaacagcagcctgaagaagctggagctgagcagcaaccagatcaaggagttcagccctggctgcttccacgccatcggccgcctgtttggcctcttcctgaacaacgtgcagctgggccccagcctgacagagaagctgtgcctggagctggccaacaccagcatccggaacctgagcctgagcaacagccagctgagcaccaccagcaacaccaccttcctgggcctgaagtggaccaacctgaccatgctggacctgagctacaacaacctgaatgtggtgggcaatgacagctttgcctggctgccccagctggagtacttcttcctggagtacaacaacatccagcacctgttcagccacagcctgcacggcctcttcaacgtgcgctacctgaacctgaagaggagcttcaccaagcagagcatcagcctggccagcctgcccaagattgatgacttctccttccagtggctgaagtgcctggagcacctgaacatggaggacaatgacatccctggcatcaagagcaacatgttcaccggcctcatcaacctgaagtacctgagcctgagcaacagcttcaccagcctgcggaccctgaccaatgagacctttgtgtccctggcccacagccccctgcacatcctgaacctgaccaagaacaagatcagcaagattgaaagtgatgccttctcctggctgggccacctggaggtgctggacctgggcctgaatgaaattggccaggagctgaccggccaggagtggaggggcctggagaacatctttgagatctacctgagctacaacaagtacctgcagctgaccagaaattcctttgccctggtgcccagcctgcagaggctgatgctgcggcgggtggccctgaagaatgtggacagcagccccagccccttccagcccctgaggaacctgaccatcctggacctgagcaacaacaacatcgccaacatcaatgatgacatgctggagggcctggagaagctggagatcctggacctgcagcacaacaacctggcccggctgtggaagcacgccaaccctgggggccccatctacttcctgaagggcctgagccacctgcacatcctgaacctggagagcaatggatttgatgagatccctgtggaggtgttcaaggacctgtttgagctgaagatcatcgacctgggcctgaacaacctgaacaccctgcctgccagcgtcttcaacaaccaggtgtccctgaagagcctgaacctgcagaagaacctgatcacctctgtggagaagaaggtgtttggacctgccttcaggaacctgacagagctggacatgaggttcaacccctttgactgcacctgtgagagcatcgcctggtttgtgaactggatcaatgagacccacaccaacatccctgagctgagcagccactacctgtgcaacaccccaccccactaccacggcttccctgtgcggctgtttgacaccagcagctgcaaggacagcgccccctttgagctgttcttcatgatcaacaccagcatcctgctgatcttcatcttcatcgtgctgctgatccactttgagggctggaggatctccttctactggaatgtgtctgtgcaccgggtgctgggcttcaaggagattgaccggcagacagagcagtttgaatatgctgcctacatcatccacgcctacaaggacaaggactgggtgtgggagcacttcagctccatggagaaggaggaccagagcctgaagttctgcctggaggagcgggactttgaagctggggtgtttgagctggaggccatcgtgaacagcatcaagaggagcaggaagatcatctttgtgatcacccaccacctgctgaaggaccccctgtgcaagcgcttcaaggtgcaccacgctgtgcagcaggccatcgagcagaacctggacagcatcatcctggtgttcctggaggagatcccagactacaagctgaaccacgccctgtgcctgcggcggggcatgttcaagagccactgcatcctgaactggcctgtgcagaaggagcgcatcggggccttccgccacaagctgcaggtggccctgggcagcaagaacagcgtgcactag

SEQ ID NO: 173419 - DNA, 1884 bp, Artificial Sequence
  Description of Artificial Sequence: Synthetic coding sequence
atgctggacctgagctacaacaacctgaatgtggtgggcaatgacagctttgcctggctgccccagctggagtacttcttcctggagtacaacaacatccagcacctgttcagccacagcctgcacggcctcttcaacgtgcgctacctgaacctgaagaggagcttcaccaagcagagcatcagcctggccagcctgcccaagattgatgacttctccttccagtggctgaagtgcctggagcacctgaacatggaggacaatgacatccctggcatcaagagcaacatgttcaccggcctcatcaacctgaagtacctgagcctgagcaacagcttcaccagcctgcggaccctgaccaatgagacctttgtgtccctggcccacagccccctgcacatcctgaacctgaccaagaacaagatcagcaagattgaaagtgatgccttctcctggctgggccacctggaggtgctggacctgggcctgaatgagatcggccaggagctgaccggccaggagtggaggggcctggagaacatctttgagatctacctgagctacaacaagtacctgcagctgaccaggaacagctttgccctggtgcccagcctgcagaggctgatgctgcggcgggtggccctgaagaatgtggacagcagccccagccccttccagcccctgaggaacctgaccatcctggacctgagcaacaacaacatcgccaacatcaatgatgacatgctggagggcctggagaagctggagatcctggacctgcagcacaacaacctggcccggctgtggaagcacgccaaccctgggggccccatctacttcctgaagggcctgagccacctgcacatcctgaacctggagagcaatggatttgatgagatccctgtggaggtgttcaaggacctgtttgagctgaagatcatcgacctgggcctgaacaacctgaacaccctgcctgcctctgtgttcaacaaccaggtgtccctgaagagcctgaacctgcagaagaacctgatcacctctgtggagaagaaggtgtttggacctgccttcaggaacctgacagagctggacatgaggttcaacccctttgactgcacctgtgagagcatcgcctggtttgtgaactggatcaatgagacccacaccaacatccctgagctgagcagccactacctgtgcaacaccccaccccactaccacggcttccctgtgcggctgtttgacaccagcagctgcaaggacagcgccccctttgagctgttcttcatgatcaacaccagcatcctgctgatcttcatcttcatcgtgctgctgatccactttgagggctggaggatctccttctactggaatgtgtctgtgcaccgggtgctgggcttcaaggagattgaccggcagacagagcagtttgaatatgctgcctacatcatccacgcctacaaggacaaggactgggtgtgggagcacttcagctccatggagaaggaggaccagagcctgaagttctgcctggaggagcgggactttgaggccggcgtgtttgagctggaggccatcgtgaacagcatcaagaggagcaggaagatcatcttcgtcatcacccaccacctgctgaaggaccccctgtgcaagcgcttcaaggtgcaccacgctgtgcagcaggccatcgagcagaacctggacagcatcatcctggtgttcctggaggagatcccagactacaagctgaaccacgccctgtgcctgcggcggggcatgttcaagagccactgcatcctgaactggcctgtgcagaaggagagaattggagccttccgccacaagctgcaggtggccctgggcagcaagaacagcgtgcactag

SEQ ID NO: 173420 - DNA, 2613 bp, Artificial Sequence
  Description of Artificial Sequence: Synthetic coding sequence
atgaggcagaccctgccctgcatctacttctggggcggcctgctgcccttcggcatgctgtgtgccagcagcaccaccaagtgcaccgtgtcccatgaggtggccgactgcagccacctgaagctgacccaggtgcctgatgacctgcccaccaacatcaccgtgctgaacctgacccacaaccagctgcggcggctgcctgctgccaacttcacccgctacagccagctgaccagcctggatgtgggcttcaacaccatcagcaagctggagcctgagctgtgccagaagctgcccatgctgaaggtgctgaacctgcagcacaatgagctgagccagctgagtgacaagacctttgccttctgcaccaacctgacagagctgcacctgatgagcaacagcatccagaagatcaagaacaacccctttgtgaagcagaagaacctgatcaccctggacctgagccacaacggcctgagcagcaccaagctgggcacccaggtgcagctggagaacctgcaggagctgctgctgagcaacaacaagatccaggccctgaagtctgaggagctggacatctttgccaacagcagcctgaagaagctggagctgagcagcaaccagatcaaggagttcagccctggctgcttccacgccatcggccgcctgtttggcctcttcctgaacaacgtgcagctgggccccagcctgacagagaagctgtgcctggagctggccaacaccagcatccggaacctgagcctgagcaacagccagctgagcaccaccagcaacaccaccttcctgggcctgaagtggaccaacctgaccatgctggacctgagctacaacaacctgaatgtggtgggcaatgacagctttgcctggctgccccagctggagtacttcttcctggagtacaacaacatccagcacctgttcagccacagcctgcacggcctcttcaacgtgcgctacctgaacctgaagaggagcttcaccaagcagagcatcagcctggccagcctgcccaagattgatgacttctccttccagtggctgaagtgcctggagcacctgaacatggaggacaatgacatccctggcatcaagagcaacatgttcaccggcctcatcaacctgaagtacctgagcctgagcaacagcttcaccagcctgcggaccctgaccaatgagacctttgtgtccctggcccacagccccctgcacatcctgaacctgaccaagaacaagatcagcaagattgaaagtgatgccttctcctggctgggccacctggaggtgctggacctgggcctgaatgaaattggccaggagctgaccggccaggagtggaggggcctggagaacatctttgagatctacctgagctacaacaagtacctgcagctgaccagaaattcctttgccctggtgcccagcctgcagaggctgatgctgcggcgggtggccctgaagaatgtggacagcagccccagccccttccagcccctgaggaacctgaccatcctggacctgagcaacaacaacatcgccaacatcaatgatgacatgctggagggcctggagaagctggagatcctggacctgcagcacaacaacctggcccggctgtggaagcacgccaaccctgggggccccatctacttcctgaagggcctgagccacctgcacatcctgaacctggagagcaatggatttgatgagatccctgtggaggtgttcaaggacctgtttgagctgaagatcatcgacctgggcctgaacaacctgaacaccctgcctgccagcgtcttcaacaaccaggtgtccctgaagagcctgaacctgcagaagaacctgatcacctctgtggagaagaaggtgtttggacctgccttcaggaacctgacagagctggacatgaggttcaacccctttgactgcacctgtgagagcatcgcctggtttgtgaactggatcaatgagacccacaccaacatccctgagctgagcagccactacctgtgcaacaccccaccccactaccacggcttccctgtgcggctgtttgacaccagcagctgcaaggacagcgccccctttgagctgttcttcatgatcaacaccagcatcctgctgatcttcatcttcatcgtgctgctgatccactttgagggctggaggatctccttctactggaatgtgtctgtgcaccgggtgctgggcttcaaggagattgaccggcagacagagcagtttgaatatgctgcctacatcatccacgcctacaaggacaaggactgggtgtgggagcacttcagctccatggagaaggaggaccagagcctgaagttctgcctggaggagcgggactttgaagctggggtgtttgagctggaggccatcgtgaacagcatcaagaggagcaggaagatcatctttgtgatcacccaccacctgctgaaggaccccctgtgcaagcgcttcaaggtgcaccacgctgtgcagcaggccatcgagcagaacctggacagcatcatcctggtgttcctggaggagatcccagactacaagctgaaccacgccctgtgcctgcggcgggccaagtag

SEQ ID NO: 173421 - DNA, 2391 bp, Artificial Sequence
  Description of Artificial Sequence: Synthetic coding sequence
atgaccaaggacaaggagcccatcgtgaagagcttccactttgtgtgcctgatgatcatcatcgtgggcacccgcatccagttcagtgatggaaatgaatttgctgtggacaagagcaagaggggcctcatccacgtgcccaaggacctgcccctgaagaccaaggtgctggacatgagccagaactacatcgccgagctgcaggtgtctgacatgtccttcctgtctgagctgactgtgctgcggctgagccacaaccgcatccagctgctggacctgagcgtcttcaagttcaaccaggacctggagtacctggacctgagccacaaccagctgcagaagatcagctgccaccccatcgtgtccttccgccacctggacctgtccttcaatgacttcaaggccctgcccatctgcaaggagtttggaaacctgagccagctgaacttcctgggcctgagcgccatgaagctgcagaagctggacctgctgcccatcgcccacctgcacctgagctacatcctgctggacctgaggaactactacatcaaggaaaatgaaacagagagcctgcagatcctgaatgccaagaccctgcacctggtgttccaccccaccagcctgtttgccatccaggtgaacatctctgtgaacaccctgggctgcctgcagctgaccaacatcaagctgaatgatgacaactgccaggtgttcatcaagttcctgtctgagctgacccggggcagcaccctgctgaacttcaccctgaaccacatcgagaccacctggaagtgcctggtgcgggtcttccagttcctgtggcccaagcctgtggagtacctgaacatctacaacctgaccatcatcgagagcatccgggaggaggacttcacctacagcaagaccaccctgaaggccctgaccatcgagcacatcaccaaccaggtgttcctgttcagccagacagccctgtacaccgtcttcagcgagatgaacatcatgatgctgaccatcagtgacacccccttcatccacatgctgtgcccccacgcccccagcaccttcaagttcctgaacttcacccagaatgtgttcacagacagcatctttgagaagtgcagcaccctggtgaagctggagaccctcatcctgcagaagaatggcctgaaggacctcttcaaggtgggcctgatgaccaaggacatgcccagcctggagatcctggatgtgtcctggaacagcctggagagcggccgccacaaggagaactgcacctgggtggagagcatcgtggtgctgaacctgagcagcaacatgctgacagattctgtgttccgctgcctgcccccacgcatcaaggtgctggacctgcacagcaacaagatcaagtctgtgcccaagcaggtggtgaagctggaggccctgcaggagctgaatgtggccttcaacagcctgacagacctgcccggctgcggcagcttcagcagcctgtctgtgctgatcatcgaccacaacagcgtgagccaccccagcgctgacttcttccagagctgccagaagatgaggagcatcaaggccggggacaaccccttccagtgcacctgtgagctgcgggagtttgtgaagaacatcgaccaggtgtcctctgaggtgctggagggctggccagacagctacaagtgtgactacccagagagctaccggggcagccccctgaaggacttccacatgtctgagctgagctgcaacatcaccctgctgattgtgaccatcggggccaccatgctggtgctggccgtgacagtgaccagcctgtgcatctacctggacctgccctggtacctgaggatggtgtgccagtggacccagacccggcggcgggccaggaacatccccctggaggagctgcagaggaacctgcagttccacgccttcatctcctacagcgagcatgattctgcctgggtgaagtctgagctggtgccctacctggagaaggaggacatccagatctgcctgcacgagaggaactttgtgcctgggaagagcatcgtggagaacatcatcaactgcatcgagaagagctacaagagcatctttgtgctgagccccaactttgtgcagagcgagtggtgccactatgagctgtactttgcccaccacaacctcttccacgagggcagcaacaacctgatcctgatcctgctggagcccatcccccagaacagcatccccaacaagtaccacaagctgaaggccctgatgacccagaggacctacctgcagtggcccaaggagaagagcaagaggggcctcttctgggccaacatccgggccgccttcaacatgaagctgaccctggtgacagagaacaatgatgtgaagagctag

SEQ ID NO: 173422 - DNA, 2391 bp, Artificial Sequence; identical to SEQ ID NO: 173421
  Description of Artificial Sequence: Synthetic coding sequence

SEQ ID NO: 173423 - DNA, 453 bp, Artificial Sequence
  Description of Artificial Sequence: Synthetic coding sequence
atgaccaaggacaaggagcccatcgtgaagagcttccactttgtgtgcctgatgatcatcatcgtgggcacccgcatccagttcagtgatggaaatgaatttgctgtggacaagagcaagaggggcctcatccacgtgcccaaggacctgcccctgaagaccaaggtgctggacatgagccagaactacatcgccgagctgcaggtgtctgacatgtccttcctgtctgagctgactgtgctgcggctgagccacaaccgcatccagctgctggacctgagcgtcttcaagttcaaccaggacctggagtacctggacctgagccacaaccagctgcagaagatcagctgccaccccatcgtgtccttccgccacctggacctgtccttcaatgacttcaaggccctgcccatctgcaaggagtttggaaacctgagccagctgaacttctag

SEQ ID NO: 173424 - DNA, 1443 bp, Artificial Sequence
  Description of Artificial Sequence: Synthetic coding sequence
atgaccaaggacaaggagcccatcgtgaagagcttccactttgtgtgcctgatgatcatcatcgtgggcacccgcatccagttcagtgatggaaatgaatttgctgtggacaagagcaagaggggcctcatccacgtgcccaaggacctgcccctgaagaccaaggtgctggacatgagccagaactacatcgccgagctgcaggtgtctgacatgtccttcctgtctgagctgactgtgctgcggctgagccacaaccgcatccagctgctggacctgagcgtcttcaagttcaaccaggacctggagtacctggacctgagccacaaccagctgcagaagatcagctgccaccccatcgtgtccttccgccacctggacctgtccttcaatgacttcaaggccctgcccatctgcaaggagtttggaaacctgagccagctgaacttcctgggcctgagcgccatgaagctgcagaagctggacctgctgcccatcgcccacctgcacctgagctacatcctgctggacctgaggaactactacatcaaggaaaatgaaacagagagcctgcagatcctgaatgccaagaccctgcacctggtgttccaccccaccagcctgtttgccatccaggtgaacatctctgtgaacaccctgggctgcctgcagctgaccaacatcaagctgaatgatgacaactgccaggtgttcatcaagttcctgtctgagctgacccggggcagcaccctgctgaacttcaccctgaaccacatcgagaccacctggaagtgcctggtgcgggtcttccagttcctgtggcccaagcctgtggagtacctgaacatctacaacctgaccatcatcgagagcatccgggaggaggacttcacctacagcaagaccaccctgaaggccctgaccatcgagcacatcaccaaccaggtgttcctgttcagccagacagccctgtacaccgtcttcagcgagatgaacatcatgatgctgaccatcagtgacacccccttcatccacatgctgtgcccccacgcccccagcaccttcaagttcctgaacttcacccagaatgtgttcacagacagcatctttgagaagtgcagcaccctggtgaagctggagaccctcatctttgtgctgagccccaactttgtgcagagcgagtggtgccactatgagctgtactttgcccaccacaacctcttccacgagggcagcaacaacctgatcctgatcctgctggagcccatcccccagaacagcatccccaacaagtaccacaagctgaaggccctgatgacccagaggacctacctgcagtggcccaaggagaagagcaagaggggcctcttctgggccaacatccgggccgccttcaacatgaagctgaccctggtgacagagaacaatgatgtgaagagctag

SEQ ID NO: 173425 - DNA, 276 bp, Artificial Sequence
  Description of Artificial Sequence: Synthetic coding sequence
atgaccaaggacaaggagcccatcgtgaagagcttccactttgtgtgcctgatgatcatcatcgtgggcacccgcatccagttcagtgatggaaatgaatttgctgtggacaagagcaagaggggcctcatccacgtgcccaaggacctgcccctgaagaccaaggtgctggacatgagccagaactacatcgccgagctgcaggtgtctgacatgtccttcctgtctgagctgactgtgctgcggctgagccacaaccgcatccagctgctgtag

SEQ ID NO: 173426 - DNA, 3150 bp, Artificial Sequence
  Description of Artificial Sequence: Synthetic coding sequence
atggtgttccccatgtggaccctgaagaggcagatcctgatcctcttcaacatcatcctgatcagcaagctgctgggcgcccgctggttccccaagaccctgccctgtgatgtgaccctggatgtgcccaagaaccacgtgattgtggactgcacagacaagcacctgacagagatccctgggggcatccccaccaacaccaccaacctgaccctgaccatcaaccacatcccagacatcagccctgccagcttccaccggctggaccacctggtggagattgacttccgctgcaactgtgtgcccatccccctgggcagcaagaacaacatgtgcatcaagaggctgcagatcaagcccaggagcttcagcggcctgacctacctgaagagcctgtacctggatggcaaccagctgctggagatcccccagggcctgccccccagcctgcagctgctgagcctggaggccaacaacatcttcagcatcaggaaggagaacctgacagagctggccaacatcgagatcctgtacctgggccagaactgctactacagaaacccctgctacgtgtcctacagcattgagaaggatgccttcctgaacctgaccaagctgaaggtgctgagcctgaaggacaacaacgtgacagctgtgcccaccgtgctgcccagcaccctgacagagctgtacctgtacaacaacatgattgccaagatccaggaggatgacttcaacaacctgaaccagctgcagatcctggacctgagcggcaactgcccccgctgctacaatgcccccttcccctgtgccccctgcaagaacaacagccccctgcagatccctgtgaatgcctttgatgccctgacagagctgaaggtgctgcggctgcacagcaacagcctgcagcacgtgcccccacgctggttcaagaacatcaacaagctgcaggagctggacctgagccagaacttcctggccaaggagattggagatgccaagttcctgcacttcctgcccagcctcatccagctggacctgtccttcaactttgagctgcaggtgtaccgggcctccatgaacctgagccaggccttcagcagcctgaagagcctgaagatcctgcgcatccggggctacgtgttcaaggagctgaagagcttcaacctgagccccctgcacaacctgcagaacctggaggtgctggacctgggcaccaacttcatcaagatcgccaacctgtccatgttcaagcagttcaagaggctgaaggtgattgacctgtctgtgaacaagatcagccccagcggggacagcagcgaggtgggcttctgcagcaatgcccggacctctgtggagagctatgagccccaggtgctggagcagctgcactacttccgctatgacaagtatgcccggagctgccgcttcaagaacaaggaggccagcttcatgtctgtgaatgaaagctgctacaagtatggccagaccctggacctgagcaagaacagcatcttctttgtgaagagcagtgacttccagcacctgtccttcctgaagtgcctgaacctgagcggcaacctgatcagccagaccctgaatggcagcgagttccagcccctggccgagctgcgctacctggacttcagcaacaaccggctggacctgctgcacagcacagcctttgaggagctgcacaagctggaggtgctggacatcagcagcaacagccactacttccagagcgagggcatcacccacatgctgaacttcaccaagaacctgaaggtgctgcagaagctgatgatgaatgacaatgacatcagcagcagcaccagcaggaccatggagagcgagagcctgcggaccctggagttccggggcaaccacctggatgtgctgtggagggagggggacaaccgctacctgcagctgttcaagaacctgctgaagctggaggagctggacatcagcaagaacagcctgtccttcctgcccagcggcgtgtttgatggcatgccacccaacctgaagaacctgagcctggccaagaatggcctgaagagcttctcctggaagaagctgcagtgcctgaagaacctggagaccctggacctgagccacaaccagctgaccaccgtgcctgagcggctgagcaactgcagccgcagcctgaagaacctgatcctgaagaacaaccagatccgcagcctgaccaagtacttcctgcaggatgccttccagctgcgctacctggacctgagcagcaacaagatccagatgatccagaagaccagcttcccagaaaatgtgctgaacaacctgaagatgctgctgctgcaccacaaccgcttcctgtgcacctgtgatgctgtgtggtttgtgtggtgggtgaaccacacagaggtgaccatcccctacctggccacagatgtgacctgtgtgggccctggggcccacaagggccagagcgtcatcagcctggacctgtacacctgtgagctggacctgaccaacctgatcctcttcagcctgagcatctctgtgtccctcttcctgatggtgatgatgacagccagccacctgtacttctgggatgtgtggtacatctaccacttctgcaaggccaagatcaagggctaccagaggctcatcagcccagactgctgctatgatgccttcatcgtgtatgacaccaaggaccctgctgtgacagagtgggtgctggccgagctggtggccaagctggaggacccccgggagaagcacttcaacctgtgcctggaggagcgggactggctgcccggccagcctgtgctggagaacctgagccagagcatccagctgagcaagaagacagtgtttgtgatgacagacaagtatgccaagacagagaacttcaagatcgccttctacctgagccaccagaggctgatggatgagaaggtggatgtgatcatcctgatcttcctggagaagcccttccagaagagcaagttcctgcagctgaggaagaggctgtgtggcagctctgtgctggagtggcccaccaacccccaggcccacccctacttctggcagtgcctgaagaatgccctggccacagacaaccacgtggcctacagccaggtgttcaaggagaccgtgtag

SEQ ID NO: 173427 - DNA, 1074 bp, Artificial Sequence
  Description of Artificial Sequence: Synthetic coding sequence
atgaggcggcagctgcggagccggcgggcccccagcttcccctacagctaccgctaccgcctggatgatcctgatgaggccaaccagaactacctggctgatgaggaggaggaggccgaggaggaggcccgggtgacagtggtgcccaagtctgaggaggaggaggaggaggaggagaaggaggaggaggaggaggaggagaaggaggaggaggagggccagggccagcccactggaaatgcctggtggcagaagctgcagatcatgtctgagtacctgtgggaccctgagaggaggatgttcctggccaggacaggccagagctggagcctcatcctgctgatctacttcttcttctacgccagcctggccgctgtgatcaccctgtgcatgtacaccctcttcctgaccatcagcccctacatccccaccttcacagagcgggtgaagcccccaggagtgatgatccggccctttgcccacagcctgaacttcaacttcaacgtgtctgagccagacacctggcagcactacgtgatcagcctgaatggcttcctgcagggctacaatgacagcctgcaggaggagatgaatgtggactgccccccaggccagtacttcatccaggatggaaatgaagatgaggacaagaaggcctgccagttcaagaggagcttcctgaagaactgcagcggcctggaggaccccaccttcggctacagcacaggccagccctgcatcctgctgaagatgaaccgcatcgtgggcttccggcctgagctgggggaccctgtgaaggtgtcctgcaaggtgcagagaggagatgaaaatgacatccgcagcatctcctactacccagagagcgccagctttgacctgcgctactacccctactacggcaagctgacccacgtgaactacaccagccccctggtggccatgcacttcacagatgtggtgaagaaccaggccgtgcctgtgcagtgccagctgaagggcaagggcgtcatcaatgatgtgatcaatgacagatttgtgggccgggtcatcttcaccctgaacatcgagacctag

SEQ ID NO: 173428 - DNA, 3180 bp, Artificial Sequence
  Description of Artificial Sequence: Synthetic coding sequence
atgaaggagagcagcctgcagaacagcagctgcagcctgggcaaggagaccaagaaggagaacatgttcctgcagagctccatgctgacctgcatcttcctgctgatcagcggcagctgtgagctgtgtgccgaggagaacttcagccgcagctacccctgtgatgagaagaagcagaatgacagcgtgattgctgagtgcagcaacagaaggctgcaggaggtgccccagacagtgggcaagtatgtgacagagctggacctgagtgacaacttcatcacccacatcaccaatgaaagcttccagggcctgcagaacctgaccaagatcaacctgaaccacaaccccaacgtgcagcaccagaatggaaatcctggcatccagagcaatggcctgaacatcacagatggagccttcctgaacctgaagaacctgcgggagctgctgctggaggacaaccagctgccccagatccccagcggcctgcctgagagcctgacagagctgagcctcatccagaacaacatctacaacatcaccaaggagggcatcagccgcctcatcaacctgaagaacctgtacctggcctggaactgctacttcaacaaggtgtgtgagaagaccaacattgaagatggagtgtttgagaccctgaccaacctggagctgctgagcctgtccttcaacagcctgagccacgtgccccccaagctgcccagcagcctgaggaagctgttcctgagcaacacccagatcaagtacatcagcgaggaggacttcaagggcctcatcaacctgaccctgctggacctgagcggcaactgcccccgctgcttcaatgcccccttcccctgtgtgccctgtgatggaggagccagcatcaacatcgacagatttgccttccagaacctgacccagctgcgctacctgaacctgagcagcaccagcctgaggaagatcaatgctgcctggttcaagaacatgccccacctgaaggtgctggacctggagttcaactacctggtgggggagatcgccagcggggccttcctgaccatgctgccccggctggagatcctggacctgtccttcaactacatcaagggcagctacccccagcacatcaacatcagcaggaacttcagcaagctgctgagcctgcgggccctgcacctgcggggctacgtgttccaggagctgcgggaggatgacttccagcccctgatgcagctgcccaacctgagcaccatcaacctgggcatcaacttcatcaagcagattgacttcaagctgttccagaacttcagcaacctggagatcatctacctgtctgaaaatcgcatcagccccctggtgaaggacacccggcagagctatgccaacagcagcagcttccagaggcacatcaggaagaggaggagcacagactttgaatttgacccccacagcaacttctaccacttcacccggcccctcatcaagccccagtgtgccgcctacggcaaggccctggacctgagcctgaacagcatcttcttcatcggccccaaccagtttgagaacctgcctgacatcgcctgcctgaacctgagcgccaacagcaatgcccaggtgctgagcggcacagagttcagcgccatcccccacgtgaagtacctggacctgaccaacaaccggctggactttgacaatgccagcgccctgacagagctgagtgacctggaggtgctggacctgagctacaacagccactacttcagaattgctggggtgacccaccacctggagttcatccagaacttcaccaacctgaaggtgctgaacctgagccacaacaacatctacaccctgacagacaagtacaacctggagagcaagagcctggtggagctggtgttcagcggcaaccggctggacatcctgtggaatgatgatgacaaccgctacatcagcatcttcaagggcctgaagaacctgacccggctggacctgagcctgaaccggctgaagcacatccccaatgaggccttcctgaacctgcctgccagcctgacagagctgcacatcaatgacaacatgctgaagttcttcaactggaccctgctgcagcagttcccccggctggagctgctggacctgcggggcaacaagctgctcttcctgacagacagcctgagtgacttcaccagcagcctgcggaccctgctgctgagccacaaccgcatcagccacctgcccagcggcttcctgtctgaggtgagcagcctgaagcacctggacctgagcagcaacctgctgaagaccatcaacaagagcgccctggagaccaagaccaccaccaagctgtccatgctggagctgcacggcaacccctttgaatgtacctgtgacatcggggacttccgccgctggatggatgagcacctgaatgtgaagatcccccggctggtggatgtgatctgtgccagccctggggaccagaggggcaagagcatcgtgtccctggagctgaccacctgtgtgtctgatgtgacagctgtgatcctcttcttcttcaccttcttcatcaccaccatggtgatgctggccgccctggcccaccacctgttctactgggatgtgtggttcatctacaacgtgtgcctggccaaggtgaagggctaccgcagcctgagcaccagccagaccttctatgatgcctacatctcctatgacaccaaggatgcctctgtgacagactgggtgatcaatgagctgcgctaccacctggaggagagccgggacaagaatgtgctgctgtgcctggaggagcgggactgggaccccggcctggccatcatcgacaacctgatgcagagcatcaaccagagcaagaagacagtgtttgtgctgaccaagaagtatgccaagtcctggaacttcaagacagccttctacctggccctgcagaggctgatggatgagaacatggatgtgatcatcttcatcctgctggagcctgtgctgcagcacagccagtacctgcggctgcggcagaggatctgcaagagcagcatcctgcagtggccagacaaccccaaggccgagggcctcttctggcagaccctgagaaatgtggtgctgacagaaaatgacagccgctacaacaacatgtatgtggacagcatcaagcagtactag

SEQ ID NO: 173429 - DNA, 3099 bp, Artificial Sequence
  Description of Artificial Sequence: Synthetic coding sequence
atgggcttctgccgcagcgccctgcaccccctgagcctgctggtgcaggccatcatgctggccatgaccctggccctgggcaccctgcctgccttcctgccctgtgagctgcagccccacggcctggtgaactgcaactggctgttcctgaagtctgtgccccacttctccatggccgcccccagaggaaatgtgaccagcctgagcctgagcagcaaccgcatccaccacctgcatgacagcgactttgcccacctgcccagcctgcggcacctgaacctgaagtggaactgcccccctgtgggcctgagccccatgcacttcccctgccacatgaccatcgagcccagcaccttcctggccgtgcccaccctggaggagctgaacctgagctacaacaacatcatgacagtgcctgccctgcccaagagcctcatcagcctgagcctgagccacaccaacatcctgatgctggacagcgccagcctggccggcctgcacgccctgcgcttcctgttcatggatggcaactgctactacaagaacccctgccggcaggccctggaggtggcccctggggccctgctgggcctgggcaacctgacccacctgagcctgaagtacaacaacctgactgtggtgcccaggaacctgcccagcagcctggagtacctgctgctgagctacaaccgcatcgtgaagctggcccctgaggacctggccaacctgacagccctgcgggtgctggatgtgggcggcaactgccgccgctgtgaccacgcccccaacccctgcatggagtgccccaggcacttcccccagctgcacccagacaccttcagccacctgagccggctggagggcctggtgctgaaggacagcagcctgtcctggctgaatgcctcctggttccggggcctgggcaacctgcgggtgctggacctgtctgagaacttcctgtacaagtgcatcaccaagaccaaggccttccagggcctgacccagctgaggaagctgaacctgtccttcaactaccagaagagggtgtcctttgcccacctgagcctggcccccagctttggcagcctggtggccctgaaggagctggacatgcacggcatcttcttccgcagcctggatgagaccaccctgcggcccctggcccggctgcccatgctgcagaccctgcggctgcagatgaacttcatcaaccaggcccagctgggcatcttccgggccttccctggcctgcgctacgtggacctgagtgacaaccgcatcagcggggccagcgagctgacagccaccatgggagaggctgatggaggagagaaggtgtggctgcagcccggggacctggccccagcccctgtggacacccccagcagcgaggacttccggcccaactgcagcaccctgaacttcaccctggacctgagcaggaacaacctggtgacagtgcagcctgagatgtttgcccagctgagccacctgcagtgcctgcggctgagccacaactgcatcagccaggccgtgaatggcagccagttcctgcccctgaccggcctgcaggtgctggacctgagccacaacaagctggacctgtaccacgagcacagcttcacagagctgccccggctggaggccctggacctgagctacaacagccagcccttcggcatgcagggcgtgggccacaacttctcctttgtggcccacctgcggaccctgcggcacctgagcctggcccacaacaacatccacagccaggtgtcccagcagctgtgcagcaccagcctgcgggccctggacttctctggaaatgccctgggccacatgtgggccgagggggacctgtacctgcacttcttccagggcctgagcggcctcatctggctggacctgagccagaaccggctgcacaccctgctgccccagaccctgaggaacctgcccaagagcctgcaggtgctgcggctgcgggacaactacctggccttcttcaagtggtggagcctgcacttcctgcccaagctggaggtgctggacctggccggcaaccagctgaaggccctgaccaacggcagcctgcctgctggcacccggctgcggcggctggatgtgtcctgcaacagcatcagctttgtggcccctggcttcttcagcaaggccaaggagctgcgggagctgaacctgagcgccaatgccctgaagacagtggaccacagctggtttggccccctggccagcgccctgcagatcctggatgtgtctgccaaccccctgcactgtgcctgtggggccgccttcatggacttcctgctggaggtgcaggccgctgtgcccggcctgcccagccgggtgaagtgtggcagccctggccagctgcagggcctgagcatctttgcccaggacctgcggctgtgcctggatgaggccctgtcctgggactgctttgccctgagcctgctggccgtggccctgggcctgggcgtgcccatgctgcaccacctgtgtggctgggacctgtggtactgcttccacctgtgcctggcctggctgccctggaggggccggcagagcggcagagatgaagatgccctgccctatgatgcctttgtggtgtttgacaagacccagagcgctgtggccgactgggtgtacaatgagctgcggggccagctggaggagtgccggggccgctgggccctgcggctgtgcctggaggagcgggactggctgcccgggaagaccctgtttgagaacctgtgggcctctgtgtatggcagcaggaagaccctgtttgtgctggcccacacagacagagtgtctggcctgctgcgggccagcttcctgctggcccagcagaggctgctggaggacaggaaggatgtggtggtgctggtgatcctgagcccagatggccgccgcagccgctacgtgcggctgcggcagaggctgtgccggcagagcgtgctgctgtggccccaccagcccagcggccagaggagcttctgggcccagctgggcatggccctgacccgggacaaccaccacttctacaacagaaacttctgccagggccccacagctgagtag

SEQ ID NO: 173430 - DNA, 2139 bp, Artificial Sequence
  Description of Artificial Sequence: Synthetic coding sequence
atggcctgcaccggccccagcctgcccagcgcctttgacatcctgggcgccgccggccaggacaagctgctgtacctgaagcacaagctgaagacccccaggcctggctgccagggccaggacctgctgcacgccatggtgctgctgaagctgggccaggagacagaggcccgcatcagcctggaggccctgaaggcagatgctgtggcccggctggtggcccggcagtgggccggcgtggacagcacagaggaccctgaggagcccccagatgtgtcctgggccgtggcccggctgtaccacctgctggccgaggagaagctgtgcccagccagcctgagagatgtggcctaccaggaggccgtgaggaccctgagcagcagagatgaccaccggctgggggagctgcaggatgaggccaggaacagatgtggctgggacattgctggggaccccggcagcatccgcaccctgcagagcaacctgggctgcctgccccccagcagcgccctgcccagcggcaccaggagcctgccccggcccattgatggagtgtctgactggagccagggctgcagcctgcggagcacaggcagccctgccagcctggccagcaacctggagatcagccagagccccaccatgcccttcctgagcctgcacaggagcccccacggccccagcaagctgtgtgatgacccccaggccagcctggtgcctgagcctgtgcctgggggctgccaggagcctgaggagatgtcctggccacccagcggggagatcgccagccccccagagctgcccagcagccccccacctggcctgcctgaggtggccccagatgccaccagcacaggcctgcctgacaccccagctgcccctgagaccagcaccaactaccctgtggagtgcacagagggcagcgctggcccccagagcctgcccctgcccatcctggagcctgtgaagaacccctgcagcgtgaaggaccagacccccctgcagctgtctgtggaggacaccaccagccccaacaccaagccctgcccccccacccccaccaccccagagaccagccccccacctcctcctcctccacccagcagcaccccctgcagcgcccacctgacccccagcagcctcttccccagcagcctggagagcagcagcgagcagaagttctacaactttgtgatcctgcacgcccgggcagatgagcacatcgccctgcgggtgcgggagaagctggaggccctgggcgtgcctgatggagccaccttctgtgaggacttccaggtgcccggccgcggggagctgagctgcctgcaggatgccatcgaccacagcgccttcatcatcctgctgctgaccagcaactttgactgccgcctgagcctgcaccaggtgaaccaggccatgatgagcaacctgacccggcagggcagcccagactgtgtgatccccttcctgcccctggagagcagccctgcccagctgagcagtgacacagccagcctgctgagcggcctggtgcggctggatgagcacagccagatctttgccaggaaggtggccaacaccttcaagccccaccggctgcaggccaggaaggccatgtggaggaaggagcaggacacccgggccctgcgggagcagagccagcacctggatggagagaggatgcaggccgccgccctgaatgctgcctacagcgcctacctgcagagctacctgagctaccaggcccagatggagcagctgcaggtggccttcggcagccacatgagctttggaactggagccccctatggagccaggatgccctttggaggccaggtgcccctgggcgcccccccacccttccccacctggccaggctgcccccagcccccacccctgcacgcctggcaggccggcaccccacctccacccagcccccagcctgctgccttcccccagagcctgcccttcccccagagccctgccttccccacagccagccctgccccaccccagagccctggcctgcagcccctcatcatccaccacgcccagatggtgcagctgggcctgaacaaccacatgtggaaccagaggggcagccaggcccctgaggacaagacccaggaggccgagtag

SEQ ID NO: 173431 - DNA, 3042 bp, Artificial Sequence
  Description of Artificial Sequence: Synthetic coding sequence
atgggcctgggcaccctgagccccaggatgctggtgtggctggtggccagcggcatcgtgttctacggggagctgtgggtgtgtgccggcctggactatgactacacctttgatggaaatgaggaggacaagacagagaccatcgactacaaggacccctgcaaggctgctgtgttctggggagacatcgccctggatgatgaggacctgaacatcttccagattgacaggaccatcgacctgacccagaaccccttcggcaacctgggccacaccactggaggcctgggggaccacgccatgagcaagaagagaggagccctgtaccagctgattgaccgcatccgccgcatcggcttcggcctggagcagaacaacacagtgaagggcaaggtgcccctgcagttcagcggccagaatgagaagaacagagtgccccgggccgccaccagcaggacagagcgcatctggccaggcggcgtcatcccctacgtgattggaggcaacttcaccggcagccagagggccatgttcaagcaggccatgaggcactgggagaagcacacctgtgtgaccttcatcgagaggagtgatgaggagagctacatcgtgttcacctaccggccctgtggctgctgcagctatgtgggcagaagaggaaatggcccccaggccatcagcatcggcaagaactgtgacaagtttggaattgtggtgcatgagctgggccacgtgattggcttctggcatgagcacaccaggccagaccgggacaaccacgtgaccatcatccgggagaacatccagcccggccaggagtacaacttcctgaagatggagcctggagaggtgaacagcctgggggagagatatgactttgacagcatcatgcactacgccaggaacaccttcagccggggcatgttcctggacaccatcctgcccagcagagatgacaatggcatccggcctgccatcggccagaggacccggctgagcaagggggacatcgcccaggccaggaagctgtaccgctgcccagcctgtggggagaccctgcaggagagcaatggaaacctgagcagccctggcttccccaacggctaccccagctacacccactgcatctggagggtgtctgtgaccccaggagagaagatcgtgctgaacttcaccaccatggacctgtacaagagcagcctgtgctggtatgactacatcgaggtgagagatggctactggaggaagagccccctgctgggccgcttctgtggggacaagctgcctgaggtgctgaccagcacagacagcaggatgtggattgagttccgcagcagcagcaactgggtgggcaagggctttgctgctgtgtatgaggccatctgtggcggggagatcaggaagaatgaaggccagatccagagccccaactacccagatgactaccggcccatgaaggaatgtgtgtggaagatcaccgtgtctgagagctaccacgtgggcctgaccttccagagctttgaaattgaaagacatgacaactgtgcctatgactacctggaggtgagagatggcaccagcgagaacagccccctgattggccgcttctgtggctatgacaagccagaggacatccgcagcaccagcaacaccctgtggatgaagtttgtgtctgatggcaccgtgaacaaggccggctttgctgccaacttcttcaaggaggaggatgaatgtgccaagccagaccggggcggctgtgagcagcgctgcctgaacaccctgggcagctaccagtgtgcctgtgagcccggctatgagctgggccctgacagaagaagctgtgaggccgcctgtggcggcctgctgaccaagctgaatggcaccatcaccaccccaggctggcccaaggagtacccacccaacaagaactgtgtgtggcaggtggtggcccccacccagtaccgcatctctgtgaagtttgagttctttgagctggagggcaatgaggtgtgcaagtatgactatgtggagatctggagcggcctgagcagcgagagcaagctgcacggcaagttctgtggggctgaggtgcctgaggtgatcaccagccagttcaacaacatgagaattgagttcaagagtgacaacacagtgtccaagaagggcttcaaggcccacttcttcagtgacaaggatgaatgttccaaggacaatggaggctgccagcatgaatgtgtgaacaccatgggcagctacatgtgccagtgcagaaatggatttgtgctgcatgacaacaagcatgactgcaaggaggctgaatgtgagcagaagatccacagccccagcggcctcatcaccagccccaactggccagacaagtaccccagcaggaaagaatgtacctgggagatcagcgccaccccaggccaccgcatcaagctggccttcagcgagtttgaaattgagcagcaccaggagtgtgcctatgaccacctggaggtgtttgatggagaaacagagaagagccccatcctgggccgcctgtgtggcaacaagatcccagaccccctggtggccaccggcaacaagatgtttgtgcgctttgtgtctgatgcctctgtgcagaggaagggcttccaggccacccacagcacagaatgtggcggccgcctgaaggccgagagcaagccccgggacctgtacagccacgcccagtttggagacaacaactacccaggccaggtggactgtgagtggctgctggtgtctgagcggggcagccggctggagctgtccttccagacctttgaggtggaggaggaggccgactgtggctatgactatgtggagctgtttgatggcctggacagcacagctgtgggcctgggccgcttctgtggcagcggccccccagaggagatctacagcattggagacagcgtgctgatccacttccacacagatgacaccatcaacaagaagggcttccacatccgctacaagagcatccgctacccagacaccacccacaccaagaagtag

SEQ ID NO: 173432 - DNA, 1179 bp, Artificial Sequence
  Description of Artificial Sequence: Synthetic coding sequence
atgggcctgggcaccctgagccccaggatgctggtgtggctggtggccagcggcatcgtgttctacggggagctgtgggtgtgtgccggcctggactatgactacacctttgatggaaatgaggaggacaagacagagaccatcgactacaaggacccctgcaaggctgctgtgttctggggagacatcgccctggatgatgaggacctgaacatcttccagattgacaggaccatcgacctgacccagaaccccttcggcaacctgggccacaccactggaggcctgggggaccacgccatgagcaagaagagaggagccctgtaccagctgattgaccgcatccgccgcatcggcttcggcctggagcagaacaacacagtgaagggcaaggtgcccctgcagttcagcggccagaatgagaagaacagagtgccccgggccgccaccagcaggacagagcgcatctggccaggcggcgtcatcccctacgtgattggaggcaacttcaccggcagccagagggccatgttcaagcaggccatgaggcactgggagaagcacacctgtgtgaccttcatcgagaggagtgatgaggagagctacatcgtgttcacctaccggccctgtggctgctgcagctatgtgggcagaagaggaaatggcccccaggccatcagcatcggcaagaactgtgacaagtttggaattgtggtgcatgagctgggccacgtgattggcttctggcatgagcacaccaggccagaccgggacaaccacgtgaccatcatccgggagaacatccagcccggccaggagtacaacttcctgaagatggagcctggagaggtgaacagcctgggggagagatatgactttgacagcatcatgcactacgccaggaacaccttcagccggggcatgttcctggacaccatcctgcccagcagagatgacaatggcatccggcctgccatcggccagaggacccggctgagcaagggggacatcgcccaggccaggaagctgtaccgctgcccagcctgtggggagaccctgcaggagagcaatggaaacctgagcagccctggcttccccaacggctaccccagctacacccactgcatctggagggtgtctgtgaccccaggagagaaggtggtgttcagcctgtgctag

SEQ ID NO: 173433 - DNA, 3048 bp, Artificial Sequence
  Description of Artificial Sequence: Synthetic coding sequence
atgccccgggccacagccctgggcgccctggtgtccctgctgctgctgctgcccctgcccagaggagctgggggcctgggggagaggccagatgccacagctgactacagcgagctggatggagaggagggcacagagcagcagctggagcactaccatgacccctgcaaggctgctgtgttctggggagacatcgccctggatgaagatgacctgaagctgttccacatcgacaaggcccgggactggaccaagcagacagtgggcgccaccggccacagcactggaggcctggaggagcaggccagcgagagcagcccagacaccacagccatggacaccggcaccaaggaggccggcaaggatggaagagagaacaccaccctgctgcacagccctggcaccctgcacgccgccgccaagaccttcagcccccgggtgcggcgggccaccaccagcaggacagagcgcatctggccaggcggcgtcatcccctacgtgattggaggcaacttcaccggcagccagagggccatcttcaagcaggccatgaggcactgggagaagcacacctgtgtgaccttcatcgagaggacagatgaggagagcttcatcgtgttctcctaccgcacctgtggctgctgcagctatgtgggccggcggggcggcggcccccaggccatcagcatcggcaagaactgtgacaagtttggaattgtggcccacgagctgggccacgtggtgggcttctggcatgagcacaccaggccagaccgggaccagcacgtgaccatcatccgggagaacatccagcccggccaggagtacaacttcctgaagatggaggccggggaggtgagcagcctgggggagacctatgactttgacagcatcatgcactacgccaggaacaccttcagcagaggagtcttcctggacaccatcctgccccggcaggatgacaacggggtgcggcccaccatcggccagagggtgcggctgagccagggcgacatcgcccaggccaggaagctgtacaagtgcccagcctgtggggagaccctgcaggacaccactggaaacttcagcgcccctggcttccccaacggctaccccagctacagccactgtgtgtggaggatctctgtgaccccaggagagaagatcgtgctgaacttcacctccatggacctcttcaagagccggctgtgctggtatgactatgtggaggtgagagatggctactggaggaaggcccccctgctgggccgcttctgtggggacaagatccctgagcccctggtgtccacagacagccggctgtgggtggagttccgcagcagcagcaacatcctgggcaagggcttctttgctgcctatgaggccacctgtggcggggacatgaacaaggatgctggccagatccagagccccaactacccagatgactaccggcccagcaaagaatgtgtgtggaggatcaccgtgtctgagggcttccacgtgggcctgaccttccaggcctttgaaattgaaagacatgacagctgtgcctatgactacctggaggtgagagatggccccacagaggagagcgccctgattggccacttctgtggctatgagaagccagaagatgtgaagagcagcagcaaccggctgtggatgaagtttgtgtctgatggcagcatcaacaaggccggctttgctgccaacttcttcaaggaggtggatgaatgttcctggccagaccatggaggctgtgagcaccgctgtgtgaacaccctgggcagctacaagtgtgcctgtgaccccggctatgagctggccgctgacaagaagatgtgtgaggtggcctgtggcggcttcatcaccaagctgaatggcaccatcaccagccctggctggcccaaggagtaccccaccaacaagaactgtgtgtggcaggtggtggccccagcccagtaccgcatcagcctgcagtttgaggtgtttgagctggagggcaatgatgtgtgcaagtatgactttgtggaggtgcgcagcggcctgagcccagatgccaagctgcacggccgcttctgtggcagcgagaccccagaggtgatcaccagccagagcaacaacatgagggtggagttcaagagtgacaacacagtgtccaagaggggcttccgggcccacttcttcagtgacaaggatgaatgtgccaaggacaatggaggctgccagcatgaatgtgtgaacaccttcggcagctacctgtgccgctgcagaaatggctactggctgcatgaaaatggacatgactgcaaggaggccggctgtgcccacaagatcagctctgtggagggcaccctggccagccccaactggccagacaagtaccccagcagaagagaatgtacctggaacatcagcagcacagctggccaccgggtgaagctgaccttcaatgaatttgaaattgagcagcaccaggagtgtgcctatgaccacctggagatgtatgatggccctgacagcctggcccccatcctgggccgcttctgtggcagcaagaagccagaccccaccgtggccagcggcagctccatgttcctgcgcttctacagtgatgcctctgtgcagaggaagggcttccaggccgtgcacagcacagaatgtggcggccgcctgaaggccgaggtgcagaccaaggagctgtacagccacgcccagtttggagacaacaactaccccagcgaggcccgctgtgactgggtgattgtggccgaggatggctatggagtggagctgaccttccgcacctttgaggtggaggaggaggccgactgtggctatgactacatggaggcctatgatggctatgacagcagcgccccccggctgggccgcttctgtggcagcggccccctggaggagatctacagcgctggggacagcctgatgatccgcttcagaacagatgacaccatcaacaagaagggcttccacgcccgctacaccagcaccaagttccaggatgccctgcacatgaagaagtag

SEQ ID NO: 173434 - DNA, 2298 bp, Artificial Sequence
  Description of Artificial Sequence: Synthetic coding sequence
atgtctggggaccacctgcacaatgacagccagatcgaggccgacttccggctgaatgacagccacaagcacaaggacaagcacaaggaccgggagcaccgccacaaggagcacaagaaggagaaggaccgggagaagagcaagcacagcaacagcgagcacaaggacagcgagaagaagcacaaggagaaggagaagaccaagcacaaggatggcagcagcgagaagcacaaggacaagcacaaggaccgggacaaggagaagaggaaggaggagaaggtgcgggccagcggagatgccaagatcaagaaggagaaggaaaatggcttcagcagccccccccagatcaaggatgagccagaagatgatggctactttgtgccccccaaggaggacatcaagcccctgaagaggcccagagatgaagatgatgctgactacaagcccaagaagatcaagacagaggacaccaagaaggagaagaagaggaagctggaggaggaggaggatggcaagctgaagaagcccaagaacaaggacaaggacaagaaggtgcctgagccagacaacaagaagaagaagcccaagaaggaggaggagcagaagtggaagtggtgggaggaggagcgctacccagagggcatcaagtggaagttcctggagcacaagggccctgtgtttgccccaccctatgagcccctgcctgaaaatgtgaagttctactatgatggcaaggtgatgaagctgagccccaaggccgaggaggtggccaccttctttgccaagatgctggaccacgagtacaccaccaaggagatcttcaggaagaacttcttcaaggactggaggaaggagatgaccaatgaggagaagaacatcatcaccaacctgagcaaatgtgacttcacccagatgagccagtacttcaaggcccagacagaggccaggaagcagatgagcaaggaggagaagctgaagatcaaggaggagaatgagaagctgctgaaggagtatggcttctgcatcatggacaaccacaaggagcgcatcgccaacttcaagattgagcccccaggcctcttccggggccggggcaaccaccccaagatgggcatgctgaagaggcgcatcatgcctgaggacatcatcatcaactgcagcaaggatgccaaggtgcccagccccccacctggccacaagtggaaggaggtgagacatgacaacaaggtgacctggctggtgtcctggacagagaacatccagggcagcatcaagtacatcatgctgaaccccagcagccgcatcaagggggagaaggactggcagaagtatgaaacagcccggcggctgaagaagtgtgtggacaagatccggaaccagtaccgggaggactggaagagcaaggagatgaaggtgcggcagagagctgtggccctgtacttcatcgacaagctggccctgcgggctggaaatgagaaggaggagggggagacagctgacacagtgggctgctgcagcctgcgggtggagcacatcaacctgcaccctgagctggatggccaggagtatgtggtggagtttgacttcctgggcaaggacagcatccgctactacaacaaggtgcctgtggagaagagggtcttcaagaacctgcagctgttcatggagaacaagcagccagaagatgacctgtttgaccggctgaacacaggcatcctgaacaagcacctgcaggacctgatggagggcctgacagccaaggtgttccgcacctacaatgccagcatcaccctgcagcagcagctgaaggagctgacagccccagatgagaacatcccagccaagatcctgagctacaacagagccaacagagctgtggccatcctgtgcaaccaccagagggccccacccaagacctttgagaagtccatgatgaacctgcagaccaagattgatgccaagaaggagcagctggctgatgcccggcgggacctgaagagcgccaaggcagatgccaaggtgatgaaggatgccaagaccaagaaggtggtggagagcaagaagaaggctgtgcagaggctggaggagcagctgatgaagctggaggtgcaggccacagaccgggaggagaacaagcagatcgccctgggcaccagcaagctgaactacctggacccccgcatcaccgtggcctggtgcaagaagtggggcgtgcccatcgagaagatctacaacaagacccagcgggagaagtttgcctgggccatcgacatggctgatgaagattatgagttctag

SEQ ID NO: 173435 - DNA, 1806 bp, Artificial Sequence
  Description of Artificial Sequence: Synthetic coding sequence
atgagggtggtgcggctgctgcggctgcgggccgccctgaccctgctgggggaggtgcccaggaggcctgccagcagaggagtgcccggcagcaggaggacccagaagggcagcggggcccgctgggagaaggagaagcatgaagatggagtgaagtggaggcagctggagcacaagggcccctactttgccccaccctatgagcccctgcctgatggagtgcgcttcttctatgagggccggcctgtgcggctgtctgtggccgctgaggaggtggccaccttctacggccgcatgctggaccacgagtacaccaccaaggaggtgttcaggaagaacttcttcaatgactggaggaaggagatggctgtggaggagcgggaggtgatcaagagcctggacaagtgtgacttcacagagatccaccgctactttgtggacaaggccgccgccaggaaggtgctgagccgggaggagaagcagaagctgaaggaggaggccgagaagctgcagcaggagtttggctactgcatcctggatggccaccaggagaagattggcaacttcaagattgagcccccaggcctcttccggggccgcggggaccaccccaagatgggcatgctgaagaggcgcatcaccccagaagatgtggtgatcaactgcagccgggacagcaagatccctgagcccccagctggccaccagtggaaggaggtgcggagtgacaacacagtgacctggctggccgcctggacagaatctgtgcagaacagcatcaagtacatcatgctgaacccctgcagcaagctgaagggggagacagcctggcagaagtttgaaacagcccggcggctgcggggctttgtggatgagatccgcagccagtacagagctgactggaagagccgggagatgaagacccggcagagagctgtggccctgtacttcatcgacaagctggccctgcgggctggaaatgagaaggaggatggagaggccgctgacacagtgggctgctgcagcctgcgggtggagcacgtgcagctgcaccctgaggctgatggctgccagcacgtggtggagtttgacttcctgggcaaggactgcatccgctactacaacagagtgcctgtggagaagcctgtgtacaagaacctgcagctgttcatggagaacaaggaccccagagatgacctgtttgaccggctgaccaccaccagcctgaacaagcacctgcaggagctgatggatggcctgacagccaaggtgttccgcacctacaatgccagcatcaccctgcaggagcagctgcgggccctgaccagggcagaagattccattgctgccaagatcctgagctacaacagagccaacagagtggtggccatcctgtgcaaccaccagagggccacccccagcacctttgagaagtccatgcagaacctgcagaccaagatccaggccaagaaggagcaggtggccgaggcccgggcagagctgcggcgggcccgggcagagcacaaggcccagggagatggcaagagccgctctgtgctggagaagaagaggcggctgctggagaagctgcaggagcagctggcccagctgtctgtgcaggccacagacaaggaggagaacaagcaggtggccctgggcaccagcaagctgaactacctggacccccgcatcagcatcgcctggtgcaagcgcttccgggtgcctgtggagaagatctacagcaagacccagcgggagagatttgcctgggccctggccatggctggagaagattttgagttctag

SEQ ID NO: 173436 - DNA, 1512 bp, Artificial Sequence
  Description of Artificial Sequence: Synthetic coding sequence
atgctggaccacgagtacaccaccaaggaggtgttcaggaagaacttcttcaatgactggaggaaggagatggctgtggaggagcgggaggtgatcaagagcctggacaagtgtgacttcacagagatccaccgctactttgtggacaaggccgccgccaggaaggtgctgagccgggaggagaagcagaagctgaaggaggaggccgagaagctgcagcaggagtttggctactgcatcctggatggccaccaggagaagattggcaacttcaagattgagcccccaggcctcttccggggccgcggggaccaccccaagatgggcatgctgaagaggcgcatcaccccagaagatgtggtgatcaactgcagccgggacagcaagatccctgagcccccagctggccaccagtggaaggaggtgcggagtgacaacacagtgacctggctggccgcctggacagaatctgtgcagaacagcatcaagtacatcatgctgaacccctgcagcaagctgaagggggagacagcctggcagaagtttgaaacagcccggcggctgcggggctttgtggatgagatccgcagccagtacagagctgactggaagagccgggagatgaagacccggcagagagctgtggccctgtacttcatcgacaagctggccctgcgggctggaaatgagaaggaggatggagaggccgctgacacagtgggctgctgcagcctgcgggtggagcacgtgcagctgcaccctgaggctgatggctgccagcacgtggtggagtttgacttcctgggcaaggactgcatccgctactacaacagagtgcctgtggagaagcctgtgtacaagaacctgcagctgttcatggagaacaaggaccccagagatgacctgtttgaccggctgaccaccaccagcctgaacaagcacctgcaggagctgatggatggcctgacagccaaggtgttccgcacctacaatgccagcatcaccctgcaggagcagctgcgggccctgaccagggcagaagattccattgctgccaagatcctgagctacaacagagccaacagagtggtggccatcctgtgcaaccaccagagggccacccccagcacctttgagaagtccatgcagaacctgcagaccaagatccaggccaagaaggagcaggtggccgaggcccgggcagagctgcggcgggcccgggcagagcacaaggcccagggagatggcaagagccgctctgtgctggagaagaagaggcggctgctggagaagctgcaggagcagctggcccagctgtctgtgcaggccacagacaaggaggagaacaagcaggtggccctgggcaccagcaagctgaactacctggacccccgcatcagcatcgcctggtgcaagcgcttccgggtgcctgtggagaagatctacagcaagacccagcgggagagatttgcctgggccctggccatggctggagaagattttgagttctag

SEQ ID NO: 173437 - DNA, 1512 bp, Artificial Sequence; identical to SEQ ID NO: 173436
  Description of Artificial Sequence: Synthetic coding sequence

SEQ ID NO: 173438 - DNA, 1512 bp, Artificial Sequence; identical to SEQ ID NO: 173436
  Description of Artificial Sequence: Synthetic coding sequence

SEQ ID NO: 173439 - DNA, 4569 bp, Artificial Sequence
  Description of Artificial Sequence: Synthetic coding sequence
atgagcagaaatgacaaggagcccttctttgtgaagttcctgaagagcagtgacaacagcaagtgcttcttcaaggccctggagagcatcaaggagttccagagcgaggagtacctgcagatcatcacagaggaggaggccctgaagatcaaggaaaatgacaggagcctgtacatctgtgaccccttcagcggcgtggtgtttgaccacctgaagaagctgggctgccgcatcgtgggcccccaggtggtgatcttctgcatgcaccaccagagatgtgtgcccagggctgagcaccctgtgtacaacatggtgatgtctgatgtgaccatcagctgcaccagcctggagaaggagaagcgggaggaggtgcacaagtatgtgcagatgatgggcggccgggtgtacagagacctgaatgtgtctgtgacccacctgattgctggggaggtgggcagcaagaagtacctggtggccgccaacctgaagaagcccatcctgctgcccagctggatcaagaccctgtgggagaagagccaggagaagaagatcacccgctacacagacatcaacatggaggacttcaagtgccccatcttcctgggctgcatcatctgtgtgacaggcctgtgtggcctggacaggaaggaggtgcagcagctgactgtgaagcatggaggccagtacatgggccagctgaagatgaatgaatgtacccacctgattgtgcaggagcccaagggccagaagtatgaatgtgccaagcgctggaatgtgcactgtgtgaccacccagtggttctttgacagcattgagaagggcttctgccaggatgagagcatctacaagacagagcccaggcctgaggccaagaccatgcccaacagcagcacccccaccagccagatcaacaccatcgacagcaggaccctgagtgatgtgagcaacatcagcaacatcaatgccagctgtgtgtctgagagcatctgcaacagcctgaacagcaagctggagcccaccctggagaacctggagaacctggatgtgtctgccttccaggcccctgaggacctgctggatggctgccgcatctacctgtgtggcttcagcggcaggaagctggacaagctgcggcggctcatcaacagcggcggcggcgtgcgcttcaaccagctgaatgaagatgtgacccacgtgattgtgggggactatgatgatgagctgaagcagttctggaacaagagcgcccaccggccccacgtggtgggcgccaagtggctgctggagtgcttcagcaagggctacatgctgtctgaggagccctacatccacgccaactaccagcctgtggagatccctgtgagccacaagccagagagcaaggccgccctgctgaagaagaagaacagcagcttcagcaagaaggactttgcccccagcgagaagcatgagcaggctgatgaggacctgctgagccagtatgaaaatggcagcagcacagtggtggaggccaagaccagcgaggcccggcccttcaatgacagcacccacgccgagcccctgaatgacagcacccacatcagcctgcaggaggagaaccagagctctgtgagccactgtgtgcctgatgtgtccaccatcacagaggagggcctcttcagccagaagagcttcctggtgctgggcttcagcaatgaaaatgaaagcaacatcgccaacatcatcaaggaaaatgccggcaagatcatgagcctgctgagcaggacagtggccgactatgctgtggtgcccctgctgggctgtgaggtggaggccaccgtgggggaggtggtgaccaacacctggctggtgacctgcatcgactaccagaccctgtttgaccccaagagcaaccccctcttcacccctgtgcctgtgatgacaggcatgacccccctggaggactgtgtgatctccttcagccagtgtgccggggctgagaaggagagcctgaccttcctggccaacctgctgggcgcctctgtgcaggagtactttgtgaggaagagcaatgccaagaagggcatgtttgccagcacccacctgatcctgaaggagcggggcggcagcaaatatgaagctgccaagaagtggaacctgcctgctgtgaccatcgcctggctgctggagacagccaggacaggcaagagagcagatgagagccacttcctgattgagaacagcaccaaggaggagaggagcctggagacagagatcaccaacggcatcaacctgaacagcgacacagctgagcaccctggcacccggctgcagacccacaggaagacagtggtgacccccctggacatgaaccgcttccagagcaaggccttccgggctgtggtgtcccagcacgcccggcaggtggccgccagccctgctgtgggccagcccctgcagaaggagcccagcctgcacctggacacccccagcaagttcctgagcaaggacaagctgttcaagcccagctttgatgtgaaggatgccctggccgccctggagaccccaggccggcccagccagcagaagaggaagcccagcacccccctgtctgaggtgattgtgaagaacctgcagctggccctggccaacagcagcagaaatgctgtggccctgagcgccagcccccagctgaaggaggcccagagcgagaaggaggaggcccccaagcccctgcacaaggtggtggtgtgtgtgtccaagaagctgagcaagaagcagagcgagctgaatggaattgctgccagcctgggcgctgactaccgctggagctttgatgaaacagtgacccacttcatctaccagggccggcccaatgacaccaaccgggagtacaagtctgtgaaggagcggggcgtgcacatcgtgtctgagcactggctgctggactgtgcccaggagtgcaagcacctgcctgagagcctgtacccccacacctacaaccccaagatgagcctggacatctctgctgtgcaggacggccgcctgtgcaacagccggctgctgtctgctgtgagcagcaccaaggatgatgagccagaccccctcatcctggaggagaatgatgtggacaacatggccaccaacaacaaggagagcgcccccagcaatggcagcggcaagaatgacagcaagggcgtgctgacccagaccctggagatgagggagaacttccagaagcagctgcaggagatcatgtctgccaccagcatcgtgaagccccagggccagaggaccagcctgagccgcagcggctgcaacagcgccagcagcaccccagacagcaccaggtctgcccggagcggccgcagccgggtgctggaggccctgcggcagagccggcagacagtgcctgatgtgaacacagagcccagccagaatgagcagatcatctgggatgaccccacagcccgggaggagcgggcccggctggccagcaacctgcagtggcccagctgccccacccagtacagcgagctgcaggtggacatccagaacctggaggacagccccttccagaagcccctgcatgacagcgagatcgccaagcaggccgtgtgtgaccccggcaacatccgggtgacagaggcccccaagcaccccatcagcgaggagctggagacccccatcaaggacagccacctgatccccaccccccaggcccccagcatcgccttccccctggccaacccccctgtggccccccacccccgggagaagatcatcaccatcgaggagacccatgaggagctgaagaagcagtacatcttccagctgagcagcctgaacccccaggagagaattgactactgccacctgattgagaagctgggcggcctggtgattgagaagcagtgctttgaccccacctgcacccacatcgtggtgggccaccccctgagaaatgagaagtacctggcctctgtggccgccggcaagtgggtgctgcacaggagctacctggaggcctgcaggacagctggccactttgtgcaggaggaggactatgagtggggcagcagcagcatcctggatgtgctgaccggcatcaacgtgcagcagaggcggctggccctggccgccatgcgctggaggaagaagatccagcagaggcaggagagcggcatcgtggagggcgccttcagcggctggaaggtgatcctgcacgtggaccagagccgggaggccggcttcaagaggctgctgcagagcggcggggccaaggtgctgcccggccacagcgtgcccctcttcaaggaggccacccacctgttcagtgacctgaacaagctgaagccagatgattctggagtgaacattgctgaggccgccgcccagaatgtgtactgcctgaggacagagtacatcgctgactacctgatgcaggagagccccccccacgtggagaactactgcctgcctgaggccatctccttcatccagaacaacaaggagctgggcaccggcctgagccagaagaggaaggcccccacagagaagaacaagatcaagaggccccgggtgcactag

SEQ ID NO: 173440 - DNA, 3138 bp, Artificial Sequence
  Description of Artificial Sequence: Synthetic coding sequence
atgggcagccagccccccctgggcagccccctgagccgggaggagggggaggcccctcctccagccccagccagcgagggcagaagaagaagccggcgggtgcggctgcggggcagctgccgccaccggcccagcttcctgggctgccgggagctggccgccagcgccccagcccggcctgccccagccagcagcgagatcatggccagcgctgccaaggagttcaagatggacaacttcagccccaaggccggcaccagcaagctgcagcagacagtgcctgcagatgccagcccagacagcaagtgccccatctgcctggacagatttgacaacgtgtcctacctggaccgctgcctgcacaagttctgcttccgctgtgtgcaggagtggagcaagaacaaggcagaatgtcccctgtgcaagcagccctttgacagcatcttccacagcgtgcgggcagaagatgacttcaaggagtatgtgctgcggcccagctacaacggcagctttgtgaccccagaccggcgcttccgctaccgcaccaccctgacccgggagagaaatgcctctgtgtacagccccagcggccctgtgaacagaaggaccaccaccccaccagattctggagtgctgtttgagggcctgggcatcagcacccggcccagagatgtggagatcccccagttcatgaggcagattgctgtgagaagacccaccacagcagatgagaggagcctgaggaagatccaggagcaggacatcatcaacttccggaggaccctgtacagagctggggcccgggtgaggaacattgaagatggcggccgctacagagacatctctgctgagttcttcagaagaaatcctgcctgcctgcaccggctggtgccctggctgaagcgggagctgactgtgctgtttggagcccacggcagcctggtgaacatcgtgcagcacatcatcatgagcaatgtgaccaggtatgacctggagagccaggcctttgtgtctgacctgcggcccttcctgctgaacagaacagagcacttcatccacgagttcatcagctttgcccggagccccttcaacatggccgcctttgaccagcacgccaactatgactgcccagcccccagctatgaggagggcagccacagcgacagcagcgtcatcaccatcagcccagatgaagctgagacccaggagctggacatcaacgtggccaccgtgtcccaggccccctgggatgatgagaccccaggccccagctacagcagcagcgagcaggtgcacgtgaccatgagcagcctgctgaacaccagtgacagcagtgatgaggagctggtgactggaggagccaccagccagatccagggcgtgcagaccaatgatgacctgaacaatgacagtgatgacagcagtgacaactgtgtgattgtgggctttgtgaagcccctggccgagaggaccccagagctggtggagctgagcagtgacagcgaggacctgggcagctatgagaagatggagaccgtgaagacccaggagcaggagcagagctacagcagcggggacagtgatgtgagccgctgcagcagcccccacagcgtgctgggcaaggatgagcagatcaacaagggccactgtgacagcagcacccgcatcaagagcaagaaggaggagaagaggagcaccagcctgagcagccccaggaacctgaacagctctgtgcggggggacagagtgtacagcccctacaaccaccgccacaggaagaggggccgcagccgcagcagtgacagccgcagccagagccgcagcggccatgaccagaagaaccacaggaagcaccacggcaagaagaggatgaagagcaagaggagccgcagccgggagagcagccggccccggggccggcgggacaagaagaggagcaggacccgggacagctcctggagcagaagaagccagaccctgagcctgagcagcgagagcaccagccgcagccgcagccgcagcagtgaccacggcaagaggaggagccgcagcaggaacagagaccgctactacctgaggaacaactacggcagccgctacaagtgggagtacacctactacagcaggaacaaggacagagatggctatgagagcagctacagaagaaggaccctgagccgggcccactacagccggcagagcagcagccctgagttccgggtgcagagcttcagcgagaggaccaatgccaggaagaagaacaaccacagcgagaggaagtactactactatgaaagacacaggagccgcagcctgagcagcaacagaagcaggacagccagcactggaacagacagagtgagaaatgagaagccaggcggcaagaggaagtacaagaccaggcacctggagggcaccaatgaggtggcccagcccagccgggagtttgccagcaaggccaaggacagccactaccagaagagcagcagcaagctggatggcaactacaagaatgaaagtgacaccttcagtgacagccgcagcagtgaccgggagaccaagcacaagaggaggaagaggaagaccaggagcctgtctgtggagatcgtgtatgagggcaaggccacagacaccaccaagcaccacaagaagaagaagaagaagcacaagaagaagcacaagaagcaccacggggacaatgccagccgcagccctgtggtgatcaccatcgacagcgacagcgacaaggacagcgaggtgaaggaggacacagaatgtgacaacagcggcccccaggaccccctgcagaatgagttcctggcccccagcctggagccctttgagaccaaggatgtggtgaccattgaagctgagtttggagtgctggacaaggaatgtgacatcgccaccctgagcaacaacctgaacaatgccaacaagacagtggacaacatcccccccctggccgcctctgtggagcagaccctggatgtgcgggaggagagcacctttgtgtctgacctggagaaccagcccagcaacatcgtgtccctgcagacagagcccagccggcagctgcccagccccaggaccagcctgatgtctgtgtgcctgggccgggactgtgacatgtcctag

SEQ ID NO: 173441 - DNA, 2943 bp, Artificial Sequence
  Description of Artificial Sequence: Synthetic coding sequence
atgatcatggccagcgctgccaaggagttcaagatggacaacttcagccccaaggccggcaccagcaagctgcagcagacagtgcctgcagatgccagcccagacagcaaatgtcccatctgcctggacagatttgacaacgtgtcctacctggaccgctgcctgcacaagttctgcttccgctgtgtgcaggagtggagcaagaacaaggccgagtgccccctgtgcaagcagccctttgacagcatcttccacagcgtgcgggcagaagatgacttcaaggagtatgtgctgcggcccagctacaacggcagctttgtgaccccagaccggcgcttccgctaccgcaccaccctgacccgggagagaaatgcctctgtgtacagccccagcggccctgtgaacagaaggaccaccaccccaccagacagcggcgtgctgtttgagggcctgggcatcagcacccggcccagagatgtggagatcccccagttcatgaggcagattgctgtgcggcggcccaccacagcagatgagaggagcctgaggaagatccaggagcaggacatcatcaacttccggaggaccctgtaccgggccggggcccgggtgagaaatattgaagatggcggccgctacagagacatctctgctgagttcttcagaagaaatcctgcctgcctgcaccggctggtgccctggctgaagcgggagctgactgtgctgtttggagcccacggcagcctggtgaacatcgtgcagcacatcatcatgagcaatgtgaccaggtatgacctggagagccaggcctttgtgtctgacctgcggcccttcctgctgaacagaacagagcacttcatccacgagttcatcagctttgcccggagccccttcaacatggccgcctttgaccagcacgccaactatgactgcccagcccccagctatgaggagggcagccacagcgacagcagcgtcatcaccatcagcccagatgaggccgagacccaggagctggacatcaacgtggccaccgtgtcccaggccccctgggatgatgagaccccaggccccagctacagcagcagcgagcaggtgcacgtgaccatgagcagcctgctgaacaccagtgacagcagtgatgaggagctggtgactggaggagccaccagccagatccagggcgtgcagaccaatgatgacctgaacaatgacagtgatgacagcagtgacaactgtgtgattgtgggctttgtgaagcccctggccgagaggaccccagagctggtggagctgagcagtgacagcgaggacctgggcagctatgagaagatggagaccgtgaagacccaggagcaggagcagagctacagcagcggggacagtgatgtgagccgctgcagcagcccccacagcgtgctgggcaaggatgagcagatcaacaagggccactgtgacagcagcacccgcatcaagagcaagaaggaggagaagaggagcaccagcctgagcagccccaggaacctgaacagctctgtgcggggggacagagtgtacagcccctacaaccaccgccacaggaagaggggccgcagccgcagcagtgacagccgcagccagagccgcagcggccatgaccagaagaaccacaggaagcaccacggcaagaagaggatgaagagcaagaggagccgcagccgggagagcagccggccccggggcagaagagacaagaagaggagcaggacccgggacagctcctggagccgccgcagccagaccctgagcctgagcagcgagagcaccagccgcagccgcagccgcagcagtgaccacggcaagagaagaagccgcagcaggaacagagaccgctactacctgaggaacaactacggcagccgctacaagtgggagtacacctactacagcaggaacaaggacagagatggctatgagagcagctacagaagaaggaccctgagccgggcccactacagccggcagagcagcagccctgagttccgggtgcagagcttcagcgagaggaccaatgccaggaagaagaacaaccacagcgagaggaagtactactactatgagcggcacaggagccgcagcctgagcagcaacagaagcaggacagccagcactggaacagacagagtgagaaatgagaagccaggcggcaagaggaagtacaagaccaggcacctggagggcaccaatgaggtggcccagcccagccgggagtttgccagcaaggccaaggacagccactaccagaagagcagcagcaagctggatggcaactacaagaatgaaagtgacaccttcagtgacagccgcagcagtgaccgggagaccaagcacaagaggaggaagaggaagaccaggagcctgtctgtggagatcgtgtatgagggcaaggccacagacaccaccaagcaccacaagaagaagaagaagaagcacaagaagaagcacaagaagcaccacggggacaatgccagccgcagccctgtggtgatcaccatcgacagcgacagcgacaaggacagcgaggtgaaggaggacacagaatgtgacaacagcggcccccaggaccccctgcagaatgagttcctggcccccagcctggagccctttgagaccaaggatgtggtgaccatcgaggccgagtttggagtgctggacaaggaatgtgacatcgccaccctgagcaacaacctgaacaatgccaacaagacagtggacaacatcccccccctggccgcctctgtggagcagaccctggatgtgcgggaggagagcacctttgtgtctgacctggagaaccagcccagcaacatcgtgtccctgcagacagagcccagccggcagctgcccagccccaggaccagcctgatgtctgtgtgcctgggccgggactgtgacatgtcctag

SEQ ID NO: 173442 - DNA, 999 bp, Artificial Sequence
  Description of Artificial Sequence: Synthetic coding sequence
atgaagctgggccgggctgtgctgggcctgctgctgctggcccccagcgtggtgcaggccgtggagcccatcagcctgggcctggccctggccggcgtgctgaccggctacatctacccccggctgtactgcctgtttgctgagtgctgcggccagaagaggagcctgagccgggaggccctgcagaaggacctggatgacaacctgtttggccagcacctggccaagaagatcatcctgaatgctgtgtttggcttcatcaacaaccccaagcccaagaagcccctgaccctgagcctgcacggctggacaggcaccgggaagaactttgtgtccaagatcatcgccgagaacatctatgagggcggcctgaacagcgactatgtgcacctgtttgtggccaccctgcacttcccccacgccagcaacatcaccctgtacaaggaccagctgcagctgtggatcagaggaaatgtgtctgcctgtgcccggagcatcttcatctttgatgagatggacaagatgcatgctggcctgattgatgccatcaagcccttcctggactactatgacctggtggatggagtgtcctaccagaaggccatgttcatcttcctgagcaatgctggagctgagcgcatcacagatgtggccctggacttctggaggtctgggaagcagcgggaggacatcaagctgaaggacatcgagcacgccctgtctgtgtctgtgttcaacaacaagaacagcggcttctggcacagcagcctgattgacaggaacctgattgactactttgtgcccttcctgcccctggagtacaagcacctgaagatgtgcatccgggtggagatgcagagccggggctatgaaattgatgaggacatcgtgtcccgggtggccgaggagatgaccttcttccccaaggaggagagggtcttcagtgacaagggctgcaagacagtgttcaccaagctggactactactatgatgactag

SEQ ID NO: 173443 - DNA, 906 bp, Artificial Sequence
  Description of Artificial Sequence: Synthetic coding sequence
atgaagctgggccgggctgtgctgggcctgctgctgctggcccccagcgtggtgcaggccgtggagcccatcagcctgggcctggccctggccggcgtgctgaccggctacatctacccccggctgtactgcctgtttgctgagtgctgcggccagaagaggagcctgagccgggaggccctgcagaaggacctggatgacaacctgtttggccagcacctggccaagaagatcatcctgaatgctgtgtttggcttcatcaacaaccccaagcccaagaagcccctgaccctgagcctgtttgtggccaccctgcacttcccccacgccagcaacatcaccctgtacaaggaccagctgcagctgtggatcagaggaaatgtgtctgcctgtgcccggagcatcttcatctttgatgagatggacaagatgcacgccggcctgattgatgccatcaagcccttcctggactactatgacctggtggatggagtgtcctaccagaaggccatgttcatcttcctgagcaatgctggagctgagcgcatcacagatgtggccctggacttctggaggtctgggaagcagcgggaggacatcaagctgaaggacattgaacatgccctgtctgtgtctgtgttcaacaacaagaacagcggcttctggcacagcagcctgattgacaggaacctgattgactactttgtgcccttcctgcccctggagtacaagcacctgaagatgtgcatccgggtggagatgcagagccggggctatgaaattgatgaagatattgtgtcccgggtggccgaggagatgaccttcttccccaaggaggagagggtcttcagtgacaagggctgcaagacagtgttcaccaagctggactactactatgatgactag

SEQ ID NO: 173444 - DNA, 1011 bp, Artificial Sequence
  Description of Artificial Sequence: Synthetic coding sequence
atgctgcgggccggctggctgcggggagctgctgccctggccctgctgctggccgcccgggtggtggccgcctttgagcccatcaccgtgggcctggccatcggggccgccagcgccatcaccggctacctgagctacaatgacatctactgccgctttgctgagtgctgccgggaggagcggcccctgaatgccagcgccctgaagctggacctggaggagaagctgtttggccagcacctggccacagaggtgatcttcaaggccctgaccggcttcaggaacaacaagaaccccaagaagcccctgaccctgagcctgcacggctgggccggcaccgggaagaactttgtgtcccagatcgtggccgagaacctgcaccccaagggcctgaagagcaactttgtgcacctgtttgtgtccaccctgcacttcccccatgagcagaagatcaagctgtaccaggaccagctgcagaagtggatcagaggaaatgtgtctgcctgtgccaacagcgtcttcatctttgatgagatggacaagctgcaccctggcatcattgatgccatcaagcccttcctggactactatgagcaggtggatggagtgtcctacaggaaggccatcttcatcttcctgagcaatgctggaggagacctgatcaccaagacagccctggacttctggagggctggcaggaagcgggaggacatccagctgaaggacctggagcctgtgctgtctgtgggcgtcttcaacaacaagcacagcggcctgtggcacagcggcctgattgacaagaacctgattgactacttcatccccttcctgcccctggagtacagacatgtgaagatgtgtgtgcgggcagagatgagggcccggggcagcgccattgatgaagatattgtgaccagggtggccgaggagatgaccttcttccccagagatgagaagatctacagcgacaagggctgcaagacagtgcagagccggctggacttccactag

SEQ ID NO: 173445 - DNA, 426 bp, Artificial Sequence
  Description of Artificial Sequence: Synthetic coding sequence
tgaagagtggtggccgcctttgagcccatcaccgtgggcctggccatcggggccgccagcgccatcaccggctacctgagctacaatgacatctactgccgctttgctgagtgctgccgggaggagcggcccctgaatgccagcgccctgaagctggacctggaggagaagctgtttggccagcacctggccacagaggtgatcttcaaggccctgaccggcttcaggaacaacaagaaccccaagaagcccctgaccctgagcctgcacggctgggccggcaccgggaagaactttgtgtcccagatcgtggccgagaacctgcaccccaagggcctgaagagcaactttgtgcacctgtttgtgtccaccctgcacttcccccatgagcagaagatcaagctgtaccagagcagcctgacctag

SEQ ID NO: 173446 - DNA, 918 bp, Artificial Sequence
  Description of Artificial Sequence: Synthetic coding sequence
atgctgcgggccggctggctgcggggagctgctgccctggccctgctgctggccgcccgggtggtggccgcctttgagcccatcaccgtgggcctggccatcggggccgccagcgccatcaccggctacctgagctacaatgacatctactgccgctttgctgagtgctgccgggaggagcggcccctgaatgccagcgccctgaagctggacctggaggagaagctgtttggccagcacctggccacagaggtgatcttcaaggccctgaccggcttcaggaacaacaagaaccccaagaagcccctgaccctgagcctgtttgtgtccaccctgcacttcccccatgagcagaagatcaagctgtaccaggaccagctgcagaagtggatcagaggaaatgtgtctgcctgtgccaacagcgtcttcatctttgatgagatggacaagctgcaccctggcatcattgatgccatcaagcccttcctggactactatgagcaggtggatggagtgtcctacaggaaggccatcttcatcttcctgagcaatgccggcggggacctgatcaccaagacagccctggacttctggagggctggcaggaagcgggaggacatccagctgaaggacctggagcctgtgctgtctgtgggcgtcttcaacaacaagcacagcggcctgtggcacagcggcctgattgacaagaacctgattgactacttcatccccttcctgcccctggagtaccgccacgtgaagatgtgtgtgcgggcagagatgagggcccggggcagcgccattgatgaggacatcgtgaccagggtggccgaggagatgaccttcttccccagagatgagaagatctacagcgacaagggctgcaagacagtgcagagccggctggacttccactag

SEQ ID NO: 173447 - DNA, 1011 bp, Artificial Sequence
  Description of Artificial Sequence: Synthetic coding sequence
atgctgcggggcccctggaggcagctgtggctgttcttcctgctgctgctgcccggggcccctgagcccaggggggccagccggccctgggagggcacagatgagcccggcagcgcctgggcctggccaggcttccagaggctgcaggagcagctgcgggctgctggggccctgagcaagcgctactggaccctcttcagctgccaggtgtggccagatgactgtgatgaagatgaggaggccgccaccggccccctgggctggaggctgcccctgctgggccagcgctacctggacctgctgaccacctggtactgcagcttcaaggactgctgccccaggggggactgccgcatcagcaacaacttcaccggcctggagtgggacctgaatgtgcggctgcacggccagcacctggtgcagcagctggtgctgaggacagtgcggggctacctggagaccccccagcctgagaaggccctggccctgtccttccacggctggagcggcaccgggaagaactttgtggccaggatgctggtggagaacctgtacagagatggcctgatgtctgactgtgtgaggatgttcatcgccaccttccacttcccccaccccaagtatgtggacctgtacaaggagcagctgatgagccagatccgggagacccagcagctgtgccaccagaccctcttcatctttgatgaagctgagaagctgcaccctggcctgctggaggtgctgggcccccacctggagcggcgggcccctgagggccacagagctgagagcccctggaccatcttcctgttcctgagcaacctgcggggggacatcatcaatgaggtggtgctgaagctgctgaaggccggctggagccgggaggagatcaccatggagcacctggagccccacctgcaggccgagatcgtggagaccatcggcttctccttcctgaccacccgctggccccacctggacctgcccaccagctctgtggcccccacctag

SEQ ID NO: 173448 - DNA, 462 bp, Artificial Sequence
  Description of Artificial Sequence: Synthetic coding sequence
atgctgcggggcccctggaggcagctgtggctgttcttcctgctgctgctgcccggggcccctgagcccaggggggccagccggccctgggagggcacagatgagcccggcagcgcctgggcctggccaggcttccagaggctgcaggagcagctgcgggctgctggggccctgagcaagcgctactggaccctcttcagctgccaggtgtggccagatgactgtgatgaagatgaggaggccgccaccggccccctgggctggaggctgcccctgctgggccagcgctacctggacctgctgaccacctggtactgcagcttcaaggactgctgccccaggggggactgccgcatcagcaacaacttcaccgggaagaactttgtggccaggatgctggtggagaacctgtacagagatggcctgatgtctgactgtgtgaggatgtttattgccacctag

SEQ ID NO: 173449 - DNA, 1194 bp, Artificial Sequence
  Description of Artificial Sequence: Synthetic coding sequence
atgctgcggggcccctggaggcagctgtggctgttcttcctgctgctgctgcccggggcccctgagcccaggggggccagccggccctgggagggcacagatgagcccggcagcgcctgggcctggccaggcttccagaggctgcaggagcagctgcgggctgctggggccctgagcaagcgctactggaccctcttcagctgccaggtgtggccagatgactgtgatgaagatgaggaggccgccaccggccccctgggctggaggctgcccctgctgggccagcgctacctggacctgctgaccacctggtactgcagcttcaaggactgctgccccaggggggactgccgcatcagcaacaacttcaccggcctggagtgggacctgaatgtgcggctgcacggccagcacctggtgcagcagctggtgctgaggacagtgcggggctacctggagaccccccagcctgagaaggccctggccctgtccttccacggctggagcggcaccgggaagaactttgtggccaggatgctggtggagaacctgtacagagatggcctgatgtctgactgtgtgaggatgttcatcgccaccttccacttcccccaccccaagtatgtggacctgtacaaggagcagctgatgagccagatccgggagacccagcagctgtgccaccagaccctcttcatctttgatgaagctgagaagctgcaccctggcctgctggaggtgctgggcccccacctggagcggcgggcccctgagggccacagagctgagagcccctggaccatcttcctgttcctgagcaacctgcggggggacatcatcaatgaggtggtgctgaagctgctgaaggccggctggagccgggaggagatcaccatggagcacctggagccccacctgcaggccgagatcgtggagaccatcgacaatggcttcggccacagccggctggtgaaggagaacctgattgactacttcatccccttcctgcccctggagtaccgccacgtgcggctgtgtgccagagatgccttcctgagccaggagctgctgtacaaggaggagaccctggatgagatcgcccagatgatggtgtatgtgcccaaggaggagcagctgttcagcagccagggctgcaagagcatcagccagaggatcaactacttcctgtcctag

SEQ ID NO: 173450 - DNA, 525 bp, Artificial Sequence
  Description of Artificial Sequence: Synthetic coding sequence
atgggcctgtgtgtgccctttgctgtgaccaccagcttcctgagcctgggcctggagtgggacctgaatgtgcggctgcacggccagcacctggtgcagcagctggtgctgaggacagtgcggggctacctggagaccccccagcctgagaaggccctggccctgtccttccacggctggagcggcaccgggaagaactttgtggccaggatgctggtggagaacctgtacagagatggcctgatgtctgactgtgtgaggatgttcatcgccaccttccacttcccccaccccaagtatgtggacctgtacaaggagcagctgatgagccagatccgggagacccagcagctgtgccaccagaccctcttcatctttgatgaagctgagaagctgcaccctggcctgctggaggtgctgggcccccacctggagcggcgggcccctgagggccacagagctgagagcccctggaccatcttcctgttcctgagcaacctgcggggggacatcatcaatgaatag

SEQ ID NO: 173451 - DNA, 1866 bp, Artificial Sequence
  Description of Artificial Sequence: Synthetic coding sequence
atggagttccctggaggaaatgacaactacctgaccatcaccggccccagccaccccttcctgagcggggctgagaccttccacacccccagcctgggagatgaggagtttgagatcccccccatcagcctggacagcgaccccagcctggccgtgtctgatgtggtgggccactttgatgacctggccgaccccagcagcagccaggacggcagcttcagcgcccagtatggagtgcagaccctggacatgcctgtgggcatgacccacggcctgatggagcagggcggcggcctgctgagcggcggcctgaccatggacctggaccacagcatcggcacccagtacagcgccaacccccctgtgaccattgatgtgcccatgacagacatgaccagcggcctgatgggccacagccagctgaccaccatcgaccagagcgagctgagcagccagctgggcctgagcctgggcggcggcaccatcctgcccccagcccagagccctgaggaccggctgagcaccacccccagccccaccagcagcctgcatgaagatggagtggaggacttccggcggcagctgcccagccagaagacagtggtggtggaggccggcaagaagcagaaggcccccaagaagaggaagaagaaggaccccaatgagccccagaagcctgtgtctgcctatgccctcttcttccgggacacccaggccgccatcaagggccagaaccccaatgccaccttcggggaggtgtccaagatcgtggcctccatgtgggacagcctgggggaggagcagaagcaggtgtacaagaggaagacagaggccgccaagaaggagtacctgaaggccctggccgcctacaaggacaaccaggagtgccaggccaccgtggagaccgtggagctggaccctgccccacccagccagacccccagccccccacccatggccaccgtggaccctgccagccctgccccagccagcattgagcccccagccctgagccccagcatcgtggtgaacagcaccctgagcagctatgtggccaaccaggccagcagtggagctgggggccagcccaacatcaccaagctgatcatcaccaagcagatgctgcccagcagcatcaccatgagccagggcggcatggtgaccgtcatcccagccaccgtggtgaccagccggggcctgcagctgggccagaccagcacagccaccatccagcccagccagcaggcccagatcgtgaccaggtctgtgctgcaggccgctgctgctgctgctgctgctgcctccatgcagctgcccccaccccggctgcagcccccacccctgcagcagatgccccagccccccacccagcagcaggtgaccatcctgcagcagcccccacccctgcaggccatgcagcagcccccaccccagaaggtgcgcatcaacctgcagcagcagcccccacccctgcagatcaagtctgtgcccctgcccaccctgaagatgcagaccaccctggtgcccccaacagtggagagcagccctgagcggcccatgaacaacagccctgaggcccacacagtggaggcccccagccctgagaccatctgtgagatgatcacagatgtggtgcctgaggtggagagccccagccagatggatgtggagctggtgtctggcagccctgtggccctgagcccccagccccgctgtgtgcgcagcggctgtgagaacccccccatcgtgtccaaggactgggacaatgagtactgcagcaatgaatgtgtggtgaagcactgcagagatgtgttcctggcctgggtggccagcaggaacagcaacacagtggtgtttgtgaagtag

SEQ ID NO: 173452 - DNA, 1866 bp, Artificial Sequence; identical to SEQ ID NO: 173451
  Description of Artificial Sequence: Synthetic coding sequence

SEQ ID NO: 173453 - DNA, 1797 bp, Artificial Sequence
  Description of Artificial Sequence: Synthetic coding sequence
atggagaccttccacacccccagcctgggagatgaggagtttgagatcccccccatcagcctggacagcgaccccagcctggccgtgtctgatgtggtgggccactttgatgacctggccgaccccagcagcagccaggacggcagcttcagcgcccagtatggagtgcagaccctggacatgcctgtgggcatgacccacggcctgatggagcagggcggcggcctgctgagcggcggcctgaccatggacctggaccacagcatcggcacccagtacagcgccaacccccctgtgaccattgatgtgcccatgacagacatgaccagcggcctgatgggccacagccagctgaccaccatcgaccagagcgagctgagcagccagctgggcctgagcctgggcggcggcaccatcctgcccccagcccagagcccagaagatcggctgagcaccacccccagccccaccagcagcctgcatgaagatggagtggaggacttccggcggcagctgcccagccagaagacagtggtggtggaggccggcaagaagcagaaggcccccaagaagaggaagaagaaggaccccaatgagccccagaagcctgtgtctgcctatgccctcttcttccgggacacccaggccgccatcaagggccagaaccccaatgccacctttggagaggtgtccaagatcgtggcctccatgtgggacagcctgggggaggagcagaagcaggtgtacaagaggaagacagaagctgccaagaaggagtacctgaaggccctggccgcctacaaggacaaccaggagtgccaggccaccgtggagaccgtggagctggaccctgccccacccagccagacccccagccccccacccatggccaccgtggaccctgccagccctgccccagccagcattgagcccccagccctgagccccagcatcgtggtgaacagcaccctgagcagctatgtggccaaccaggccagcagcggggccggcggccagcccaacatcaccaagctgatcatcaccaagcagatgctgcccagcagcatcaccatgagccagggcggcatggtgaccgtcatcccagccaccgtggtgaccagccggggcctgcagctgggccagaccagcacagccaccatccagcccagccagcaggcccagatcgtgaccaggtctgtgctgcaggccgctgctgctgctgctgctgctgcctccatgcagctgcccccaccccggctgcagcccccacccctgcagcagatgccccagccccccacccagcagcaggtgaccatcctgcagcagcccccacccctgcaggccatgcagcagcccccaccccagaaggtgcgcatcaacctgcagcagcagcccccacccctgcagatcaagtctgtgcccctgcccaccctgaagatgcagaccaccctggtgccccccaccgtggagagcagccctgagcggcccatgaacaacagccctgaggcccacacagtggaggcccccagccctgagaccatctgtgagatgatcacagatgtggtgcctgaggtggagagccccagccagatggatgtggagctggtgtctggcagccctgtggccctgagcccccagccccgctgtgtgcgcagcggctgtgaaaatccacccatcgtgtccaaggactgggacaatgagtactgcagcaatgaatgtgtggtgaagcactgcagagatgtgttcctggcctgggtggccagcaggaacagcaacacagtggtgtttgtgaagtag

SEQ ID NO: 173454 - DNA, 1650 bp, Artificial Sequence
  Description of Artificial Sequence: Synthetic coding sequence
atgaggaacctgaagagccacctgagcccctggatcctgatcccccactggctgagccagatgtggctggccaccctgatgacctggcagttcttctccccagacctggaccacagcatcggcacccagtacagcgccaacccccctgtgaccattgatgtgcccatgacagacatgaccagcggcctgatgggccacagccagctgaccaccatcgaccagagcgagctgagcagccagctgggcctgagcctgggcggcggcaccatcctgcccccagcccagagccctgaggaccggctgagcaccacccccagccccaccagcagcctgcatgaagatggagtggaggacttccggcggcagctgcccagccagaagacagtggtggtggaggccggcaagaagcagaaggcccccaagaagaggaagaagaaggaccccaatgagccccagaagcctgtgtctgcctatgccctcttcttccgggacacccaggccgccatcaagggccagaaccccaatgccaccttcggggaggtgtccaagatcgtggcctccatgtgggacagcctgggggaggagcagaagcaggtgtacaagaggaagacagaggccgccaagaaggagtacctgaaggccctggccgcctacaaggacaaccaggagtgccaggccaccgtggagaccgtggagctggaccctgccccacccagccagacccccagccccccacccatggccaccgtggaccctgccagccctgccccagccagcattgagcccccagccctgagccccagcatcgtggtgaacagcaccctgagcagctatgtggccaaccaggccagcagtggagctgggggccagcccaacatcaccaagctgatcatcaccaagcagatgctgcccagcagcatcaccatgagccagggcggcatggtgaccgtcatcccagccaccgtggtgaccagccggggcctgcagctgggccagaccagcacagccaccatccagcccagccagcaggcccagatcgtgaccaggtctgtgctgcaggccgctgctgctgctgctgctgctgcctccatgcagctgcccccaccccggctgcagcccccacccctgcagcagatgccccagccccccacccagcagcaggtgaccatcctgcagcagcccccacccctgcaggccatgcagcagcccccaccccagaaggtgcgcatcaacctgcagcagcagcccccacccctgcagatcaagtctgtgcccctgcccaccctgaagatgcagaccaccctggtgcccccaacagtggagagcagccctgagcggcccatgaacaacagccctgaggcccacacagtggaggcccccagccctgagaccatctgtgagatgatcacagatgtggtgcctgaggtggagagccccagccagatggatgtggagctggtgtctggcagccctgtggccctgagcccccagccccgctgtgtgcgcagcggctgtgagaacccccccatcgtgtccaaggactgggacaatgagtactgcagcaatgaatgtgtggtgaagcactgcagagatgtgttcctggcctgggtggccagcaggaacagcaacacagtggtgtttgtgaagtag

SEQ ID NO: 173455 - DNA, 1020 bp, Artificial Sequence
  Description of Artificial Sequence: Synthetic coding sequence
atgatgcccttctgccacaacatcatcaacatcagctgtgtgaagaacaactggagcaatgatgtgcgggccagcctgtacagcctgatggtgctgatcatcctgaccaccctggtgggcaacctgattgtgattgtgtccatcagccacttcaagcagctgcacacccccaccaactggctgatccacagcatggccaccgtggacttcctgctgggctgcctggtgatgccctacagcatggtgcgctctgctgagcactgctggtactttggagaggtgttctgcaagatccacaccagcacagacatcatgctgagcagcgccagcatcttccacctgtccttcatcagcattgaccgctactatgctgtgtgtgaccccctgcgctacaaggccaagatgaacatcctggtgatctgtgtgatgatcttcatctcctggagcgtgcctgctgtgtttgccttcggcatgatcttcctggagctgaacttcaagggagctgaggagatctactacaagcacgtgcactgccggggcggctgcagcgtcttcttcagcaagatcagcggcgtgctgaccttcatgaccagcttctacatccctggcagcatcatgctgtgtgtgtactaccgcatctacctgattgccaaggagcaggcccggctcatcagtgatgccaaccagaagctgcagatcggcctggagatgaagaatggcatcagccagagcaaggagaggaaggctgtgaagaccctgggcatcgtgatgggcgtcttcctgatctgctggtgccccttcttcatctgcaccgtgatggaccccttcctgcactacatcatcccccccaccctgaatgatgtgctgatctggtttggctacctgaacagcaccttcaaccccatggtgtatgccttcttctacccctggttcaggaaggccctgaagatgatgctgtttgggaagatcttccagaaggacagcagccgctgcaagctgttcctggagctgagcagctag

SEQ ID NO: 173456 - DNA, 921 bp, Artificial Sequence
  Description of Artificial Sequence: Synthetic coding sequence
atgtacagcttcatggccggcagcatcttcatcaccatcttcggcaacctggccatgatcatcagcatctcctacttcaagcagctgcacacccccaccaacttcctgatcctgtccatggccatcacagacttcctgctgggcttcaccatcatgccctacagcatgatccgctctgtggagaactgctggtacttcggcctgaccttctgcaagatctactacagctttgacctgatgctgagcatcaccagcatcttccacctgtgcagcgtggccatcgaccgcttctacgccatctgctaccccctgctgtacagcaccaagatcaccatccctgtgatcaagaggctgctgctgctgtgctggagcgtgcctggggcctttgcctttggagtggtgttcagcgaggcctatgcagatggcatcgagggctatgacatcctggtggcctgcagcagcagctgccctgtgatgttcaacaagctgtggggcaccaccctcttcatggccggcttcttcaccccaggctccatgatggtgggcatctacggcaagatctttgctgtgtccaggaagcacgcccacgccatcaacaacctgcgggagaaccagaacaaccaggtgaagaaggacaagaaggccgccaagaccctgggcatcgtgattggagtcttcctgctgtgctggttcccctgcttcttcaccatcctgctggaccccttcctgaacttcagcacccctgtggtgctgtttgatgccctgacctggtttggctacttcaacagcacctgcaaccccctcatctacggcttcttctacccctggttccggcgggccctgaagtacatcctgctgggcaagatcttcagcagctgcttccacaacaccatcctgtgcatgcagaaggagagcgagtag

SEQ ID NO: 173457 - DNA, 1056 bp, Artificial Sequence
  Description of Artificial Sequence: Synthetic coding sequence
atggctgtgtcctctgagcagcacgagctgagccacttcaagaggacccagaccaagaaggagaagttcaactgcagtgaatatggcaacagaagctgcccagaaaatgaaagaagcctgggcgtgcgggtggccatgtacagcttcatggccggcagcatcttcatcaccatctttggaaacctggccatgatcatcagcatctcctacttcaagcagctgcacacccccaccaacttcctgatcctgtccatggccatcacagacttcctgctgggcttcaccatcatgccctacagcatgatccgctctgtggagaactgctggtacttcggcctgaccttctgcaagatctactacagctttgacctgatgctgagcatcaccagcatcttccacctgtgcagcgtggccatcgaccgcttctacgccatctgctaccccctgctgtacagcaccaagatcaccatccctgtgatcaagaggctgctgctgctgtgctggagcgtgcctggggcctttgccttcggcgtggtgttttctgaggcctatgcagatggcatcgagggctatgacatcctggtggcctgcagcagcagctgccctgtgatgttcaacaagctgtggggcaccaccctcttcatggccggcttcttcaccccaggctccatgatggtgggcatctacggcaagatctttgctgtgtccaggaagcacgcccacgccatcaacaacctgcgggagaaccagaacaaccaggtgaagaaggacaagaaggccgccaagaccctgggcatcgtcatcggggtcttcctgctgtgctggttcccctgcttcttcaccatcctgctggaccccttcctgaacttcagcacccctgtggtgctgtttgatgccctgacctggtttggctacttcaacagcacctgcaaccccctcatctacggcttcttctacccctggttcagaagagccctgaagtacatcctgctgggcaagatcttcagcagctgcttccacaacaccatcctgtgcatgcagaaggagagcgagtag

SEQ ID NO: 173458 - DNA, 921 bp, Artificial Sequence; identical to SEQ ID NO: 173456
  Description of Artificial Sequence: Synthetic coding sequence

SEQ ID NO: 173459 - DNA, 1038 bp, Artificial Sequence
  Description of Artificial Sequence: Synthetic coding sequence
atgagcagcaacagcagcctgctggtggccgtgcagctgtgctacgccaacgtgaatggcagctgtgtgaagatccccttcagccctggcagcagggtcatcctgtacatcgtgtttggatttggagctgtgctggccgtgtttggaaacctgctggtgatgatcagcatcctgcacttcaagcagctgcacagccccaccaacttcctggtggccagcctggcctgtgccgacttcctggtgggcgtgacagtgatgcccttctccatggtgaggacagtggagagctgctggtacttcggccgctccttctgcaccttccacacctgctgtgatgtggccttctgctacagcagcctcttccacctgtgcttcatcagcattgaccgctacatcgctgtgacagaccccctggtgtaccccaccaagttcaccgtgtctgtgtctggcatctgcatctctgtgtcctggatcctgcccctgatgtacagcggggctgtgttctacacaggagtgtatgatgatggcctggaggagctgagtgatgccctgaactgcattggaggctgccagacagtggtgaaccagaactgggtgctgacagacttcctgtccttcttcatccccaccttcatcatgatcatcctgtatggcaacatcttcctggtggcccggcggcaggccaagaagattgagaacacaggcagcaagacagagagcagcagcgagagctacaaggcccgggtggcccggcgggagaggaaggccgccaagaccctgggcgtgacagtggtggccttcatgatctcctggctgccctacagcattgacagcctgattgatgccttcatgggcttcatcaccccagcctgcatctatgagatctgctgctggtgtgcctactacaacagcgccatgaaccccctcatctatgccctcttctacccctggttcaggaaggccatcaaggtgattgtgacaggccaggtgctgaagaacagcagcgccaccatgaacctcttcagcgagcacatctag

SEQ ID NO: 173460 - DNA, 957 bp, Artificial Sequence
  Description of Artificial Sequence: Synthetic coding sequence
gtgaatggcagctgtgtgaagatccccttcagccctggcagcagggtcatcctgtacatcgtgtttggatttggagctgtgctggccgtgtttggaaacctgctggtgatgatcagcatcctgcacttcaagcagctgcacagccccaccaacttcctggtggccagcctggcctgtgccgacttcctggtgggcgtgacagtgatgcccttctccatggtgaggacagtggagagctgctggtacttcggccgctccttctgcaccttccacacctgctgtgatgtggccttctgctacagcagcctcttccacctgtgcttcatcagcattgaccgctacatcgctgtgacagaccccctggtgtaccccaccaagttcaccgtgtctgtgtctggcatctgcatctctgtgtcctggatcctgcccctgatgtacagcggggctgtgttctacacaggagtgtatgatgatggcctggaggagctgagtgatgccctgaactgcatcggcggctgccagacagtggtgaaccagaactgggtgctgacagacttcctgtccttcttcatccccaccttcatcatgatcatcctgtatggcaacatcttcctggtggcccggcggcaggccaagaagattgaaaatacagagagctacaaggcccgggtggcccggcgggagaggaaggccgccaagaccctgggcgtgacagtggtggccttcatgatctcctggctgccctacagcattgacagcctgattgatgccttcatgggcttcatcaccccagcctgcatctatgagatctgctgctggtgtgcctactacaacagcgccatgaaccccctcatctatgccctcttctacccctggttcaggaaggccatcaaggtgattgtgacaggccaggtgctgaagaacagcagcgccaccatgaacctcttcagcgagtag

SEQ ID NO: 173461 - DNA, 1410 bp, Artificial Sequence
  Description of Artificial Sequence: Synthetic coding sequence
atgcccatccgggccctgtgcaccatctgcagcgacttctttgaccacagcagagatgtggccgccatccactgcggccacaccttccacctgcagtgcctgatccagtggtttgaaacagcccccagcaggacctgcccccagtgccgcatccaggtgggcaagaggaccatcatcaacaagctgttctttgacctggcccaggaggaggagaatgtgctggatgctgagttcctgaagaatgagctggacaacgtgcgggcccagctgagccagaaggacaaggagaagagggacagccaggtgatcatcgacaccctgcgggacaccctggaggagagaaatgccaccgtggtgtccctgcagcaggccctgggcaaggccgagatgctgtgcagcaccctgaagaagcagatgaagtacctggagcagcagcaggatgagaccaagcaggcccaggaggaggcccggcggctgcggagcaagatgaagaccatggagcagatcgagctgctgctgcagagccagaggcctgaggtggaggagatgatccgggacatgggcgtgggccagagcgctgtggagcagctggccgtgtactgtgtgtccctgaagaaggagtatgagaacctgaaggaggccaggaaggccagcggggaggtggccgacaagctgaggaaggacctcttcagcagccgcagcaagctgcagacagtgtacagcgagctggaccaggccaagctggagctgaagagcgcccagaaggacctgcagagcgctgacaaggagatcatgagcctgaagaagaagctgaccatgctgcaggagaccctgaacctgccccctgtggccagcgagaccgtggaccggctggtgctggagagccctgcccctgtggaggtgaacctgaagctgcggcggcccagcttcagagatgacatcgacctgaatgccacctttgatgtggacaccccaccagcccggcccagcagcagccagcacggctactatgagaagctgtgcctggagaagagccacagccccatccaggatgtgcccaagaagatctgcaagggccccaggaaggagagccagctgagcctgggcggccagagctgtgccggggagccagatgaggagctggtgggcgccttccccatctttgtgagaaatgccatcctgggccagaagcagcccaagaggcccaggtctgagagcagctgcagcaaggatgtggtgaggactggatttgatggcctgggcggccgcaccaagttcatccagcccacagacacagtgatgatccggcccctgcctgtgaagcccaagaccaaggtgaagcagagggtgcgggtgaagacagtgcccagcctcttccaggccaagctggacaccttcctgtggagctag

SEQ ID NO: 173462 - DNA, 4059 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacatccggcggcagctggaggaggagcagaggcagctggagatcctgcagcagcagctgctgcacgagcaggccctgctgctggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggaggtggaggagaggagccggctgaaccggcagagcagccctgccatgccccacaaggtggccaaccgcatcagtgaccccaacctgcccccaagaagtgagagcttcagcatcagcggcgtgcagcctgcccggaccccacccatgctgcggcctgtggacccccagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagtgaaaatccacccctgcccaccagaattgagaagtttgacaggagctcctggctgcggcaggaggaggacatcccccccaaggtgccccagaggaccaccagcatcagccctgccctggccaggaagaacagccctggaaatggaagtgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173463 - DNA, 3831 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagtgaaaatccacccctgcccaccagaattgagaagtttgacaggagctcctggctgcggcaggaggaggacatcccccccaaggtgccccagaggaccaccagcatcagccctgccctggccaggaagaacagccctggaaatggaagtgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgccagctacaagaaggccattgatgaggacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173464 - DNA, 3996 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggaggtggaggagaggagccggctgaaccggcagagcagccctgccatgccccacaaggtggccaaccgcatcagtgaccccaacctgccccccaggtctgagagcttcagcatctctggagtgcagcctgcccggaccccacccatgctgcggcctgtggacccccagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgccagctacaagaaggccattgatgaggacctgacagccctggccaaggagctgcgggagctgagaattgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccactggagcccctggcagcaatgagcagtacaacgtgggcatggtgggcacccacggcctggagaccagccatgctgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggacagcggcacagaatatggcatgggcagcagcaccaaggccagcttcaccccatttgtggacccccgggtgtaccagaccagccccacagatgaagatgaagaagatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacagaagtggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgagcgcatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcaccccccacgccatcgtcatcctgcccaagacagatggcatggagatgctggtgtgctatgaagatgaaggagtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaattccatgatgaactggtag

SEQ ID NO: 173465 - DNA, 4017 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagatcgtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggaggtggaggagaggagccggctgaaccggcagagcagccctgccatgccccacaaggtggccaaccgcatcagtgaccccaacctgccccccaggtctgagagcttcagcatctctggagtgcagcctgcccggaccccacccatgctgcggcctgtggacccccagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgtgtctgccttcctgagcaagagctttgagctgctgatctaccaggacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173466 - DNA, 4083 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacatccggcggcagctggaggaggagcagaggcagctggagatcctgcagcagcagctgctgcacgagcaggccctgctgctggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggaggtggaggagaggagccggctgaaccggcagagcagccctgccatgccccacaaggtggccaaccgcatcagtgaccccaacctgcccccaagaagtgagagcttcagcatcagcggcgtgcagcctgcccggaccccacccatgctgcggcctgtggacccccagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagtgaaaatccacccctgcccaccagaattgagaagtttgacaggagctcctggctgcggcaggaggaggacatcccccccaaggtgccccagaggaccaccagcatcagccctgccctggccaggaagaacagccctggaaatggaagtgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgccagctacaagaaggccattgatgaggacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173467 - DNA, 3894 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacatccggcggcagctggaggaggagcagaggcagctggagatcctgcagcagcagctgctgcacgagcaggccctgctgctggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgacctgacagccctggccaaggagctgcgggagctgagaattgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccactggagcccctggcagcaatgagcagtacaacgtgggcatggtgggcacccacggcctggagaccagccatgctgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggacagcggcacagaatatggcatgggcagcagcaccaaggccagcttcaccccatttgtggacccccgggtgtaccagaccagccccacagatgaagatgaagaagatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacagaagtggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgagcgcatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcaccccccacgccatcgtcatcctgcccaagacagatggcatggagatgctggtgtgctatgaagatgaaggagtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaattccatgatgaactggtag

SEQ ID NO: 173468 - DNA, 3972 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggaggtggaggagaggagccggctgaaccggcagagcagccctgccatgccccacaaggtggccaaccgcatcagtgaccccaacctgccccccaggtctgagagcttcagcatctctggagtgcagcctgcccggaccccacccatgctgcggcctgtggacccccagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgacctgacagccctggccaaggagctgcgggagctgagaattgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccactggagcccctggcagcaatgagcagtacaacgtgggcatggtgggcacccacggcctggagaccagccatgctgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggacagcggcacagaatatggcatgggcagcagcaccaaggccagcttcaccccatttgtggacccccgggtgtaccagaccagccccacagatgaagatgaagaagatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacagaagtggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgagcgcatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcaccccccacgccatcgtcatcctgcccaagacagatggcatggagatgctggtgtgctatgaagatgaaggagtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaattccatgatgaactggtag

SEQ ID NO: 173469 - DNA, 3807 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagtgaaaatccacccctgcccaccagaattgagaagtttgacaggagctcctggctgcggcaggaggaggacatcccccccaaggtgccccagaggaccaccagcatcagccctgccctggccaggaagaacagccctggaaatggaagtgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173470 - DNA, 3918 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagctggtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacatccggcggcagctggaggaggagcagaggcagctggagatcctgcagcagcagctgctgcacgagcaggccctgctgctggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgccagctacaagaaggccattgatgaggacctgacagccctggccaaggagctgcgggagctgagaattgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccactggagcccctggcagcaatgagcagtacaacgtgggcatggtgggcacccacggcctggagaccagccatgctgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggacagcggcacagaatatggcatgggcagcagcaccaaggccagcttcaccccatttgtggacccccgggtgtaccagaccagccccacagatgaagatgaagaagatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacagaagtggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgagcgcatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcaccccccacgccatcgtcatcctgcccaagacagatggcatggagatgctggtgtgctatgaagatgaaggagtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaattccatgatgaactggtag

SEQ ID NO: 173471 - DNA, 3939 bp, Artificial Sequence
  Description of Artificial Sequence: Synthetic coding sequence
atggccagtgacagccctgcccggagcctggatgaaattgacctgagcgccctgcgggaccctgctggcatctttgagctggtggagctggtgggcaatggcacctacggccaggtgtacaagggccgccacgtgaagacaggccagctggccgccatcaaggtgatggatgtgactggagatgaggaggaggagatcaagcaggagatcaacatgctgaagaagtacagccaccacaggaacatcgccacctactacggggccttcatcaagaagaaccccccaggcatggatgaccagctgtggctggtgatggagttctgtggggccggctctgtgacagacctgatcaagaacaccaagggcaacaccctgaaggaggagtggatcgcctacatctgccgggagatcctgcggggcctgagccacctgcaccagcacaaggtgatccaccgggacatcaagggccagaatgtgctgctgacagaaaatgctgaggtgaagatcgtggactttggagtgtctgcccagctggacagaacagtgggcagaagaaacaccttcatcggcaccccctactggatggcccctgaggtgattgcctgtgatgagaacccagatgccacctatgacttcaagagtgacctgtggagcctgggcatcacagccatcgagatggccgagggcgccccacccctgtgtgacatgcaccccatgagggccctcttcctgatccccagaaatcctgccccccggctgaagagcaagaagtggagcaagaagttccagagcttcatcgagagctgcctggtgaagaaccacagccagaggcctgccacagagcagctgatgaagcaccccttcatccgggaccagcccaatgaaaggcaggtgcgcatccagctgaaggaccacatcgacaggaccaagaagaagagaggagagaaggatgaaacagaatatgagtacagcggcagcgaggaggaggaggaggagaatgattctggagagcccagcagcatcctgaacctgcctggagagagcaccctgcggcgggacttcctgcggctgcagctggccaacaaggagaggtctgaggccctgcggcggcagcagctggagcagcagcagagagaaaatgaggagcacaagaggcagctgctggccgagcggcagaagagaattgaggagcagaaggagcagaggcggcggctggaggagcagcagaggcgggagaaggagctgaggaagcagcaggagcgggagcagaggaggcactatgaggagcagatgaggcgggaggaggagcggcggcgggcagagcacgagcaggagtacatccggcggcagctggaggaggagcagaggcagctggagatcctgcagcagcagctgctgcacgagcaggccctgctgctggagtacaagaggaagcagctggaggagcagaggcaggccgagcggctgcagaggcagctgaagcaggagcgggactacctggtgtccctgcagcaccagaggcaggagcagaggcctgtggagaagaagcccctgtaccactacaaggagggcatgagccccagcgagaagccagcctgggccaaggagatcccccacctggtggccgtgaagagccagggccctgccctgacagccagccagagcgtgcatgagcagcccaccaagggcctgagcggcttccaggaggccctgaatgtgaccagccaccgggtggagatgccccggcagaacagcgaccccaccagcgagaacccccccctgcccacccgcatcgagaagtttgacaggagctcctggctgcggcaggaggaggacatcccccccaaggtgccccagaggaccaccagcatcagccctgccctggccaggaagaacagccctggaaatggcagcgccctgggcccccggctgggcagccagcccatccgggccagcaacccagacctgcggaggacagagcccatcctggagagccccctgcagaggaccagcagcggcagcagcagcagcagcagcacccccagcagccagcccagcagccagggcggcagccagcccggcagccaggccggcagcagcgagaggaccagggtgcgggccaacagcaagtctgagggcagccctgtgctgccccatgagcccgccaaggtgaagccagaggagagccgggacatcacccggcccagcaggcctgctgtgtctgccttcctgagcaagagctttgagctgctgatctaccaggacctgacagccctggccaaggagctgcgggagctgcgcatcgaggagaccaaccggcccatgaagaaggtgacagactacagcagcagcagcgaggagagcgagagcagcgaggaggaggaggaggatggagagagcgagacccatgatggcaccgtggccgtgtctgacatccccaggctcatccccaccggggcccctggcagcaatgagcagtacaacgtgggcatggtgggcacccacggcctggagaccagccacgccgacagcttcagcggcagcatcagccgggagggcaccctgatgatccgggagaccagcggggagaagaagaggagcggccacagcgacagcaatggatttgctggccacatcaacctgcctgacctggtgcagcagagccacagccctgctggcacccccacagagggcctgggccgggtgtccacccacagccaggagatggattctggaacagaatatggcatgggcagcagcaccaaggccagcttcaccccatttgtggacccccgggtgtaccagaccagccccacagatgaagatgaggaggatgaggagagcagcgctgctgccctcttcaccagcgagctgctgcggcaggagcaggccaagctgaatgaggccaggaagatctctgtggtgaatgtgaaccccaccaacatccggccccacagcgacaccccagagatcaggaagtacaagaagcgcttcaacagcgagatcctgtgtgccgccctgtggggcgtgaacctgctggtgggcacagaaaatggcctgatgctgctggacaggagcggccagggcaaggtgtacaacctgatcaacagaagacgcttccagcagatggatgtgctggagggcctgaatgtgctggtgaccatcagcggcaagaagaacaagctgcgggtgtactacctgtcctggctgaggaaccgcatcctgcacaatgaccctgaggtggagaagaagcagggctggatcaccgtgggggacctggagggctgcatccactacaaggtggtgaagtatgaaagaatcaagttcctggtgattgccctgaagaatgctgtggagatctatgcctgggcccccaagccctaccacaagttcatggccttcaagagctttgctgacctgcagcacaagcccctgctggtggacctgactgtggaggagggccagaggctgaaggtgatcttcggcagccacacaggcttccacgtgattgatgtggacagcggcaacagctatgacatctacatccccagccacatccagggcaacatcacccctcatgccatcgtcatcctgcccaagacagatggcatggagatgctggtgtgctatgaagatgagggcgtgtatgtgaacacctacggccgcatcaccaaggatgtggtgctgcagtggggcgagatgcccacctctgtggcctacatccacagcaaccagatcatgggctggggcgagaaggccatcgagatccgctctgtggagaccggccacctggatggagtcttcatgcacaagagggcccagaggctgaagttcctgtgtgaaagaaatgacaaggtgttctttgcctctgtgcgcagcggcggcagcagccaggtgttcttcatgaccctgaacagaaacagcatgatgaactggtag

SEQ ID NO: 173472 - DNA, 1725 bp, Artificial Sequence
  Description of Artificial Sequence: Synthetic coding sequence
atgccaccccagctgcaggagaccaggatgaacagaagcatccctgtggaggtggatgaaagtgagccctaccccagccagctgctgaagcccatccctgagtacagccctgaggaggagagcgagcccccagcccccaacatccggaacatggcccccaacagcctgagcgcccccaccatgctgcacaacagcagcggggacttcagccaggcccacagcaccctgaagctggccaaccaccagaggcctgtgtcccggcaggtgacctgcctgcggacccaggtgctggaggacagtgaagattccttctgccgccgccaccctggcctgggcaaggccttccccagcggctgcagcgctgtgtctgagcccgccagcgagagcgtggtgggcgccctgcctgctgagcaccagttctccttcatggagaagaggaaccagtggctggtgtcccagctgtctgctgccagcccagacaccggccatgacagcgacaagagtgaccagagcctgcccaatgccagcgctgacagcctgggcggcagccaggagatggtgcagaggccccagccccacaggaacagagctggcctggacctgcccaccatcgacaccggctatgacagccagccccaggatgtgctgggcatccggcagctggagcggcccctgcccctgacctctgtgtgctacccccaggacctgccccggcccctgcggagccgggagttcccccagtttgagccccagcgctacccagcctgtgcccagatgctgccccccaacctgagcccccacgccccctggaactaccactaccactgccccggcagcccagaccaccaggtgccctacggccatgactaccccagggctgcctaccagcaggtgatccagcctgccctgcccggccagcccctgcccggggcctctgtgcggggcctgcaccctgtgcagaaggtgatcctgaactaccccagcccctgggaccacgaggagaggcctgcccagagggactgcagcttccctggcctgcccaggcaccaggaccagccccaccaccagccccccaacagagctggggcccctggagagagcctggagtgcccagctgagctgcggccccaggtgccccagccccccagccctgctgctgtgccccggccccccagcaaccccccagcccggggcaccctgaagaccagcaacctgcctgaggagctgaggaaggtgttcatcacctacagcatggacacagccatggaggtggtgaagtttgtgaacttcctgctggtgaatggcttccagacagccatcgacatctttgaggaccgcatccggggcatcgacatcatcaagtggatggagcgctacctgcgggacaagacagtgatgatcatcgtggccatcagccccaagtacaagcaggatgtggagggcgctgagagccagctggatgaagatgaacatggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173473 - DNA, 1695 bp, Artificial Sequence
  Description of Artificial Sequence: Synthetic coding sequence
atgaacagaagcatccctgtggaggtggatgagagcgagccctaccccagccagctgctgaagcccatccctgagtacagccctgaggaggagagcgagcccccagcccccaacatccggaacatggcccccaacagcctgagcgcccccaccatgctgcacaacagcagcggggacttcagccaggcccacagcaccctgaagctggccaaccaccagaggcctgtgtcccggcaggtgacctgcctgcggacccaggtgctggaggacagcgaggacagcttctgcagaagacaccctggcctgggcaaggccttccccagcggctgcagcgctgtgtctgagcccgccagcgagagcgtggtgggcgccctgcctgctgagcaccagttctccttcatggagaagaggaaccagtggctggtgtcccagctgtctgctgccagcccagacaccggccatgacagcgacaagagtgaccagagcctgcccaatgccagcgctgacagcctgggcggcagccaggagatggtgcagaggccccagccccacaggaacagagctggcctggacctgcccaccatcgacaccggctatgacagccagccccaggatgtgctgggcatccggcagctggagcggcccctgcccctgacctctgtgtgctacccccaggacctgccccggcccctgcggagccgggagttcccccagtttgagccccagcgctacccagcctgtgcccagatgctgccccccaacctgagcccccacgccccctggaactaccactaccactgccccggcagcccagaccaccaggtgccctacggccatgactacccccgggccgcctaccagcaggtgatccagcctgccctgcccggccagcccctgcccggggcctctgtgcggggcctgcaccctgtgcagaaggtgatcctgaactaccccagcccctgggaccacgaggagaggcctgcccagagggactgcagcttccctggcctgcccaggcaccaggaccagccccaccaccagccccccaacagagctggggcccctggagagagcctggagtgcccagctgagctgcggccccaggtgccccagccccccagccctgctgctgtgcccaggcctcccagcaaccccccagcccggggcaccctgaagaccagcaacctgcctgaggagctgaggaaggtgttcatcacctacagcatggacacagccatggaggtggtgaagtttgtgaacttcctgctggtgaatggcttccagacagccatcgacatctttgaagatcgcatccggggcatcgacatcatcaagtggatggagcgctacctgcgggacacagtgatgatcatcgtggccatcagccccaagtacaagcaggatgtggagggcgctgagagccagctggatgaagatgaacatggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173474 - DNA, 1698 bp, Artificial Sequence
  Description of Artificial Sequence: Synthetic coding sequence
atgaacagaagcatccctgtggaggtggatgagagcgagccctaccccagccagctgctgaagcccatccctgagtacagccctgaggaggagagcgagcccccagcccccaacatccggaacatggcccccaacagcctgagcgcccccaccatgctgcacaacagcagcggggacttcagccaggcccacagcaccctgaagctggccaaccaccagaggcctgtgtcccggcaggtgacctgcctgcggacccaggtgctggaggacagcgaggacagcttctgcagaagacaccctggcctgggcaaggccttccccagcggctgcagcgctgtgtctgagcccgccagcgagagcgtggtgggcgccctgcctgctgagcaccagttctccttcatggagaagaggaaccagtggctggtgtcccagctgtctgctgccagcccagacaccggccatgacagcgacaagagtgaccagagcctgcccaatgccagcgctgacagcctgggcggcagccaggagatggtgcagaggccccagccccacaggaacagagctggcctggacctgcccaccatcgacaccggctatgacagccagccccaggatgtgctgggcatccggcagctggagcggcccctgcccctgacctctgtgtgctacccccaggacctgccccggcccctgcggagccgggagttcccccagtttgagccccagcgctacccagcctgtgcccagatgctgccccccaacctgagcccccacgccccctggaactaccactaccactgccccggcagcccagaccaccaggtgccctacggccatgactacccccgggccgcctaccagcaggtgatccagcctgccctgcccggccagcccctgcccggggcctctgtgcggggcctgcaccctgtgcagaaggtgatcctgaactaccccagcccctgggaccacgaggagaggcctgcccagagggactgcagcttccctggcctgcccaggcaccaggaccagccccaccaccagccccccaacagagctggggcccctggagagagcctggagtgcccagctgagctgcggccccaggtgccccagccccccagccctgctgctgtgcccaggcctcccagcaaccccccagcccggggcaccctgaagaccagcaacctgcctgaggagctgaggaaggtgttcatcacctacagcatggacacagccatggaggtggtgaagtttgtgaacttcctgctggtgaatggcttccagacagccatcgacatctttgaagatcgcatccggggcatcgacatcatcaagtggatggagcgctacctgcgggacaagacagtgatgatcatcgtggccatcagccccaagtacaagcaggatgtggagggcgctgagagccagctggatgaagatgagcacggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173475 - DNA, 1725 bp, Artificial Sequence
  Description of Artificial Sequence: Synthetic coding sequence
atggccccccagctggaggagaccaggatgaacagaagcatccctgtggaggtggatgaaagtgagccctaccccagccagctgctgaagcccatccctgagtacagccctgaggaggagagcgagcccccagcccccaacatccggaacatggcccccaacagcctgagcgcccccaccatgctgcacaacagcagcggggacttcagccaggcccacagcaccctgaagctggccaaccaccagaggcctgtgtcccggcaggtgacctgcctgcggacccaggtgctggaggacagtgaagattccttctgccgccgccaccctggcctgggcaaggccttccccagcggctgcagcgctgtgtctgagcccgccagcgagagcgtggtgggcgccctgcctgctgagcaccagttctccttcatggagaagaggaaccagtggctggtgtcccagctgtctgctgccagcccagacaccggccatgacagcgacaagagtgaccagagcctgcccaatgccagcgctgacagcctgggcggcagccaggagatggtgcagaggccccagccccacaggaacagagctggcctggacctgcccaccatcgacaccggctatgacagccagccccaggatgtgctgggcatccggcagctggagcggcccctgcccctgacctctgtgtgctacccccaggacctgccccggcccctgcggagccgggagttcccccagtttgagccccagcgctacccagcctgtgcccagatgctgccccccaacctgagcccccacgccccctggaactaccactaccactgccccggcagcccagaccaccaggtgccctacggccatgactaccccagggctgcctaccagcaggtgatccagcctgccctgcccggccagcccctgcccggggcctctgtgcggggcctgcaccctgtgcagaaggtgatcctgaactaccccagcccctgggaccacgaggagaggcctgcccagagggactgcagcttccctggcctgcccaggcaccaggaccagccccaccaccagccccccaacagagctggggcccctggagagagcctggagtgcccagctgagctgcggccccaggtgccccagccccccagccctgctgctgtgccccggccccccagcaaccccccagcccggggcaccctgaagaccagcaacctgcctgaggagctgaggaaggtgttcatcacctacagcatggacacagccatggaggtggtgaagtttgtgaacttcctgctggtgaatggcttccagacagccatcgacatctttgaggaccgcatccggggcatcgacatcatcaagtggatggagcgctacctgcgggacaagacagtgatgatcatcgtggccatcagccccaagtacaagcaggatgtggagggcgctgagagccagctggatgaagatgaacatggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173476 - DNA, 462 bp, Artificial Sequence
  Description of Artificial Sequence: Synthetic coding sequence
atggaggtggtgaagtttgtgaacttcctgctggtgaatggcttccagacagccatcgacatctttgaagatcgcatccggggcatcgacatcatcaagtggatggagcgctacctgcgggacaagacagtgatgatcatcgtggccatcagccccaagtacaagcaggatgtggagggcgctgagagccagctggatgaagatgagcacggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173477 - DNA, 330 bp, Artificial Sequence
  Description of Artificial Sequence: Synthetic coding sequence
atgatcatcgtggccatcagccccaagtacaagcaggatgtggagggcgctgagagccagctggatgaagatgagcacggcctgcacaccaagtacatccacaggatgatgcagatcgagttcatcaagcagggctccatgaacttccgcttcatccctgtgctcttccccaatgccaagaaggagcacgtgcccacctggctgcagaacacccacgtgtacagctggcccaagaacaagaagaacatcctgctgcggctgctgcgggaggaggagtatgtggccccaccccggggccccctgcccaccctgcaggtggtgcccctgtag

SEQ ID NO: 173478 - DNA, 1596 bp, Artificial Sequence
  Description of Artificial Sequence: Synthetic coding sequence
atgatcagcccagacccccggcccagccctggcctggcccgctgggccgagagctatgaggccaagtgtgaaagacggcaggagatccgggagagccgccgctgccggcccaacgtgaccacctgccggcaggtgggcaagaccctgcgcatccagcagcgggagcagctgcagagggcccggctgcagcagttcttcagaagaagaaacctggagctggaggagaagggcaaggcccagcacccccaggcccgggagcagggccccagcagaagacctggccaggtgacaggcaccagcagcgaggtgtttcctgcccagcaccccccacccagcggcatctgccgggacctgagtgaccacctgagcagccaggccggcggcctgcccccccaggacacccccatcaagaagccacccaagcaccaccggggcacccagaccaaggccgagggccccaccatcaagaatgatgccagccagcagaccaactatggagtggccgtgctggacaaggagatcatccagctgagtgactacctgaaggaggccctgcagcgggagctggtgctgaagcagaagatggtgatcctgcaggacctgctgagcaccctcatccaggccagtgacagctcctggaagggccagctgaatgaagacaagctgaagggcaagctgcggagcctggagaaccagctgtacacctgcacccagaagtacagcccctggggcatgaagaaggtgctgctggagatggaggaccagaagaacagctatgagcagaaggccaaggagagcctgcagaaggtgctggaggagaagatgaatgctgagcagcagctgcagagcacccagaggagcctggccctggccgagcagaagtgtgaggagtggaggagccagtatgaggccctgaaggaggactggaggaccctgggcacccagcaccgggagctggagagccagctgcacgtgctgcagagcaagctgcagggcgctgacagccgggacctgcagatgaaccaggccctgcgcttcctggagaatgagcaccagcagctgcaggccaagattgaatgtctgcagggcgaccgggacctgtgcagcctggacacccaggacctgcaggaccagctgaagaggtctgaggccgagaagctgaccctggtgaccagggtgcagcagctgcagggcctgctgcagaaccagagcctgcagctgcaggagcaggagaagctgctgaccaagaaggaccaggccctgcctgtgtggagccccaagagcttccccaatgaggtggagcctgagggcaccgggaaggagaaggactgggacctgcgggaccagctgcagaagaagaccctgcagctgcaggccaaggagaaggaatgtcgggagctgcacagcgagctggacaacctgagtgatgagtacctgagctgcctgaggaagctgcagcactgccgggaggagctgaaccagagccagcagctgcccccccggcggcagtgtggccgctggctgcctgtgctgatggtggtgattgctgctgccctggccgtgttcctggccaacaaggacaacctgatgatctag

SEQ ID NO: 173479 - DNA, 549 bp, Artificial Sequence
  Description of Artificial Sequence: Synthetic coding sequence
atgaagaaggtgctgctggagatggaggaccagaagaacagctatgagcagaaggccaaggagagcctgcagaaggtgctggaggagaagatgaatgctgagcagcagctgcagagcacccagaggagcctggccctggccgagcagaagtgtgaggagtggaggagccagtatgaggccctgaaggaggactggaggaccctgggcacccagcaccgggagctggagagccagctgcacgtgctgcagagcaagctgcagggcgctgacagccgggacctgcagatgaaccaggccctgcgcttcctggagaatgagcaccagcagctgcaggccaagattgaatgtctgcagggcgaccgggacctgtgcagcctggacacccaggacctgcaggaccagctgaagaggtctgaggccgagaagctgaccctggtgaccagggtgcagcagctgcagggcctgctgcagaaccagagcctgcagctgcaggagcaggagaagctgctgaccaagaagggccagcagatctactaccacaagttctag

SEQ ID NO: 173480 - DNA, 1656 bp, Artificial Sequence
  Description of Artificial Sequence: Synthetic coding sequence
atgatcagcccagacccccggcccagccctggcctggcccgctgggccgagagctatgaggccaagtgtgaaagacggcaggagatccgggagagccgccgctgccggcccaacgtgaccacctgccggcaggtgggcaagaccctgcgcatccagcagcgggagcagctgcagagggcccggctgcagcagttcttcagaagaagaaacctggagctggaggagaagggcaaggcccagcacccccaggcccgggagcagggccccagcagaagacctggccaggtgacagtgctgaaggagcccctgagctgtgcccggcgcatcagcagcccccgggagcaggtgacaggcaccagcagcgaggtgtttcctgcccagcaccccccacccagcggcatctgccgggacctgagtgaccacctgagcagccaggccggcggcctgcccccccaggacacccccatcaagaagccacccaagcaccaccggggcacccagaccaaggccgagggccccaccatcaagaatgatgccagccagcagaccaactatggagtggccgtgctggacaaggagatcatccagctgagtgactacctgaaggaggccctgcagcgggagctggtgctgaagcagaagatggtgatcctgcaggacctgctgagcaccctcatccaggccagtgacagctcctggaagggccagctgaatgaagacaagctgaagggcaagctgcggagcctggagaaccagctgtacacctgcacccagaagtacagcccctggggcatgaagaaggtgctgctggagatggaggaccagaagaacagctatgagcagaaggccaaggagagcctgcagaaggtgctggaggagaagatgaatgctgagcagcagctgcagagcacccagaggagcctggccctggccgagcagaagtgtgaggagtggaggagccagtatgaggccctgaaggaggactggaggaccctgggcacccagcaccgggagctggagagccagctgcacgtgctgcagagcaagctgcagggcgctgacagccgggacctgcagatgaaccaggccctgcgcttcctggagaatgagcaccagcagctgcaggccaagattgaatgtctgcagggcgaccgggacctgtgcagcctggacacccaggacctgcaggaccagctgaagaggtctgaggccgagaagctgaccctggtgaccagggtgcagcagctgcagggcctgctgcagaaccagagcctgcagctgcaggagcaggagaagctgctgaccaagaaggaccaggccctgcctgtgtggagccccaagagcttccccaatgaggtggagcctgagggcaccgggaaggagaaggactgggacctgcgggaccagctgcagaagaagaccctgcagctgcaggccaaggagaaggaatgtcgggagctgcacagcgagctggacaacctgagtgatgagtacctgagctgcctgaggaagctgcagcactgccgggaggagctgaaccagagccagcagctgcccccccggcggcagtgtggccgctggctgcctgtgctgatggtggtgattgctgctgccctggccgtgttcctggccaacaaggacaacctgatgatctag

SEQ ID NO: 173481 - DNA, 1656 bp, Artificial Sequence; identical to SEQ ID NO: 173480
  Description of Artificial Sequence: Synthetic coding sequence

SEQ ID NO: 173482 - DNA, 1596 bp, Artificial Sequence; identical to SEQ ID NO: 173478
  Description of Artificial Sequence: Synthetic coding sequence

SEQ ID NO: 173483 - DNA, 1215 bp, Artificial Sequence
  Description of Artificial Sequence: Synthetic coding sequence
atgatcagcccagacccccggcccagccctggcctggcccgctgggccgagagctatgaggccaagtgtgaaagacggcaggagatccgggagagccgccgctgccggcccaacgtgaccacctgccggcaggtgggcaagaccctgcgcatccagcagcgggagcagctgcagagggcccggctgcagcagttcttcagaagaagaaacctggagctggaggagaagggcaaggcccagcacccccaggcccgggagcagggccccagcagaagacctggccaggtgacaggcaccagcagcgaggtgtttcctgcccagcaccccccacccagcggcatctgccgggacctgagtgaccacctgagcagccaggccggcggcctgcccccccaggacacccccatcaagaagccacccaagcaccaccggggcacccagaccaaggccgagggccccaccatcaagaatgatgccagccagcagaccaactatggagtggccgtgctggacaaggagatcatccagctgagtgactacctgaaggaggccctgcagcgggagctggtgctgaagcagaagatggtgatcctgcaggacctgctgagcaccctcatccaggccagtgacagctcctggaagggccagctgaatgaagacaagctgaagggcaagctgcggagcctggagaaccagctgtacacctgcacccagaagtacagcccctggggcatgaagaaggtgctgctggagatggaggaccagaagaacagctatgagcagaaggccaaggagagcctgcagaaggtgctggaggagaagatgaatgctgagcagcagctgcagagcacccagaggagcctggccctggccgagcagaagtgtgaggagtggaggagccagtatgaggccctgaaggaggactggaggaccctgggcacccagcaccgggagctggagagccagctgcacgtgctgcagagcaagctgcagggcgctgacagccgggacctgcagatgaaccaggccctgcgcttcctggagaatgagcaccagcagctgcaggccaagattgaatgtctgcagggcgaccgggacctgtgcagcctggacacccaggacctgcaggaccagctgaagaggtctgaggccgagaagctgaccctggtgaccagggtgcagcagctgcaggaggccgccggctggaccacctag

SEQ ID NO: 173484 - DNA, 963 bp, Artificial Sequence
  Description of Artificial Sequence: Synthetic coding sequence
atgatcagcccagacccccggcccagccctggcctggcccgctgggccgagagctatgaggccaagtgtgaaagacggcaggagatccgggagagccgccgctgccggcccaacgtgaccacctgccggcaggtgggcaagaccctgcgcatccagcagcgggagctggaggagaagggcaaggcccagcacccccaggcccgggagcagggccccagccggcggcccggccaggtgacagtgctgaaggagcccctgagctgtgcccggcgcatcagcagcccccgggagcaggtgacaggcaccagcagcgaggtgtttcctgcccagcaccccccaccttctggcatctgccgggacctgagtgaccacctgagcagccaggccggcggcctgcccccccaggacacccccatcaagaagccacccaagcaccaccggggcacccagaccaaggccgagggccccaccatcaagaatgatgccagccagcagaccaactacggcgtggccgtgctggacaaggagatcatccagctgagtgactacctgaaggaggccctgcagcgggagctggtgctgaagcagaagatggtgatcctgcaggacctgctgagcaccctcatccaggccagtgacagctcctggaagggccagctgaatgaagacaagctgaagggcaagctgcggagcctggagaaccagctgtacacctgcacccagaagtacagcccctggggcatgaagaaggtgctgctggagatggaggaccagaagaacagctatgagcagaaggccaaggagagcctgcagaaggtgctggaggagaagatgaatgctgagcagcagctgcagagcacccaggtgtggggctgccacatcgacatgggcctgggcaccccaggcagcctgggcaacaagggcagccagctgcacaacagcctggagcccagccccctgtag

SEQ ID NO: 173485 - DNA, 81 bp, Artificial Sequence
  Description of Artificial Sequence: Synthetic coding sequence
atgatcagcccagacccccggcccagccctggcctggcccgctgggccgagagctatgaggccaagtgtgaaagaagatag

SEQ ID NO: 173486 - DNA, 1671 bp, Artificial Sequence
  Description of Artificial Sequence: Synthetic coding sequence
atgcagaagttcattgaagctgactactatgagctggactggtactatgaggagtgcagtgatgtgctgtgtgccgagcgggtgggccagatgaccaagacctacaatgacattgatgctgtgacccggctgctggaggagaaggagcgggacctggagctggccgcccgcatcggccagagcctgctgaagaagaacaagaccctgacagaaagaaatgagctgctggaggagcaggtggagcacatccgggaggaggtgtcccagctgcggcatgagctgtccatgaaggatgagctgctgcagttctacaccagcgctgctgaggagagcgagcctgagagcgtgtgcagcacccccctgaagagaaatgaaagcagcagctctgtgcagaactacttccacctggacagcctgcagaagaagctgaaggacctggaggaggagaatgtggtgctgcggtctgaggccagccagctgaagacagagaccatcacctatgaggagaaggagcagcagctggtgaatgactgtgtgaaggagctgagagatgccaacgtgcagatcgccagcatcagcgaggagctggccaagaagacagaagatgctgcccggcagcaggaggagatcacccacctgctgagccagatcgtggacctgcagaagaaggccaaggcctgtgctgtggagaatgaggagctggtgcagcacctgggcgccgccaaggatgcccagaggcagctgacagctgagctgcgggagctggaggacaagtatgcagagtgcatggagatgctgcacgaggcccaggaggagctgaagaacctgaggaacaagaccatgcccaacaccaccagccgccgctaccacagcctgggcctcttccccatggacagcctggccgctgagattgagggcaccatgaggaaggagctgcagctggaggaggccgagagcccagacatcacccaccagaagagggtgtttgaaacagtgaggaacatcaaccaggtggtgaagcagaggagcctgacccccagccccatgaacatccctggcagcaaccagagcagcgccatgaacagcctgctgagcagctgtgtgtccacccccaggagcagcttctacggcagtgacattggaaatgtggtgctggacaacaagaccaacagcatcatcctggagacagaggccgctgacctgggcaatgatgagaggagcaagaagccaggcaccccaggcaccccaggcagccatgacctggagacagccctgcggcggctgagcctgcggcgggagaactacctgtctgaaagacgcttctttgaggaggagcaggagaggaagctgcaggagctggccgagaagggggagctgcggagcggcagcctgacccccacagagagcatcatgagcctgggcacccacagccgcttcagcgagttcaccggcttcagcggcatgtccttcagcagccgcagctacctgcctgagaagctgcagatcgtgaagcccctggagggggaccatgctggcccccggcccctgtctgtgctgctgggggacagcctgtggagcctcatccacctgaggaaggccggccacctgtgccacgcctacagcttcttcttccgggacagccacccccgctgctggtttgagttcctgtag

SEQ ID NO: 173487 - DNA, 438 bp, Artificial Sequence
  Description of Artificial Sequence: Synthetic coding sequence
atgacagtgcacaacctgtacctgtttgacagaaatggagtgtgcctgcactacagcgagtggcacaggaagaagcaggccggcatccccaaggaggaggagtacaagctgatgtatggcatgctgttcagcatccgcagctttgtgtccaagatgagccccctggacatgaaggatggcttcctggccttccagaccagccgctacaagctgcactactatgagacccccaccggcatcaaggtggtgatgaacacagacctgggcgtgggccccatcagagatgtgctgcaccacatctacagcgccctgtatgtggagctggtggtgaagaaccccctgtgccccctgggccagacagtgcagagcgagctgttccgcagccggctggacagctatgtgcgcagcctgcccttcttcagcgcccgggccggctag

SEQ ID NO: 173488 - DNA, 438 bp, Artificial Sequence; identical to SEQ ID NO: 173487
  Description of Artificial Sequence: Synthetic coding sequence

SEQ ID NO: 173489 - DNA, 3402 bp, Artificial Sequence
  Description of Artificial Sequence: Synthetic coding sequence
atgagccccacccagtgggacttccctgtggagctgtgctgccggcccatggcctttgtgaccctgaccggcctggatgtggtgtacaatgctgtgcacagagctgtgtgggatgccttctgtgccaacagaagagctgacagagtgcccatctccttcaaggtgctgcccggggaccacgagtaccccaagtgccggcccaagaggaccagctatgagtggtacatccccaagggcatcctgaagacaggctggatgaacaagcacctgaacctggtgcctgccctggtggtggtgttctatgagctggactgggatgagccccagtggaaggagaagcagagtgaatgtgccaccagggtggagatcgtgcggcagagcctgcagggcaggaacaccaaggtggccgtggtgctgatccagaagaagacccccctgcccccaggagaagatgtgattgccagcgagagagctgctgccctgtgcaatgcctgtgagctgagcggcaagagcctgtttgtgctgccccacacagaccacctggtgggctacatcatccggctggagaatgccttctatgaacatgcccagacctactactacacagagatcagaagagtgaagagccacaaggagttcctgaacaagaccacccaccagctgctgtttgtgcgccaccagttcaagatcgccttcttcagcgagctgaagcaggacacccagaatgccctgaagaactacagaacagcctacaacctggtgcatgagctgcgggcccacgagaccaacatcctggagatcaagaccatggccggcttcatcaactacaagatctgccgcctgtgcttccagcacaacacccccctggatgccatcgcccagttcaggaagcacatcgacctgtgcaagaagaagattggcagcgctgagctgagctttgaacatgatgcctggatgagcaagcagttccaggccttcggggacctgtttgatgaggccatcaagctgggcctgacagccatccagacccagaaccctggcttctactaccagcaggccgcctactatgcccaggagaggaagcagctggccaagaccctgtgcaaccacgaggcctctgtgatgtaccccaacccagaccccctggagacccagacaggagtgctggacttctacggccagaggtcctggaggcagggcatcctgagctttgacctgagtgaccctgagaaggagaaggtgggcatcctggccatccagctgaaggagagaaatgtggtgcacagcgagatcatcatcaccctgctgagcaatgctgtggcccagttcaagaagtacaagtgccccaggatgaagagccacctgatggtgcagatgggagaggagtactactatgccaaggactacaccaaggccctgaagctgctggactatgtgatgtgtgactacagaagtgagggctggtggaccctgctgacctctgtgctgaccacagccctgaagtgcagctacctgatggcccagctgaaggactacatcacctacagcctggagctgctgggccgggccagcaccctgaaggatgaccagaagagccgcatcgagaagaacctgatcaacgtgctgatgaatgaatctccagaccctgagccagactgtgacatcctggccgtgaagacagcccagaagctgtgggccgaccgcatcagcctggccggcagcaacatcttcaccatcggcgtgcaggactttgtgccctttgtgcagtgcaaggccaagttccacgcccccagcttccacgtggatgtgcctgtgcagtttgacatctacctgaaggctgactgcccccaccccatccgcttcagcaagctgtgtgtgtccttcaacaaccaggagtacaaccagttctgtgtgattgaggaggccagcaaggccaatgaggtgctggagaacctgacccagggcaagatgtgcctggtgcctgggaagaccaggaagctgctcttcaagtttgtggccaagacagaagatgtgggcaagaagattgagatcacctctgtggacctggccctgggcaatgaaacaggccgctgtgtggtgctgaactggcagggcggcggcggagatgctgccagcagccaggaggccctgcaggccgcccggagcttcaagagaagacccaagctgcctgacaatgaggtgcactgggacagcatcatcatccaggccagcaccatgatcatcagccgggtgcccaacatctctgtgcacctgctgcacgagcccccagccctgaccaatgagatgtactgcctggtggtgacagtgcagagccatgagaagacccagatcagagatgtgaagctgacagctggcctgaagccaggccaggatgccaacctgacccagaagacccacgtgaccctgcacggcacagagctgtgtgatgagagctacccagccctgctgacagacatccctgtgggggacctgcaccctggagagcagctggagaagatgctgtatgtgcgctgtggcaccgtgggcagcaggatgttcctggtgtatgtgtcctacctgatcaacaccaccgtggaggagaaggagatcgtgtgcaagtgccacaaggatgaaacagtgaccatcgagaccgtcttcccctttgatgtggccgtgaagtttgtgtccaccaagtttgagcacctggagcgggtgtatgctgacatccccttcctgctgatgacagacctgctgagcgccagcccctgggccctgaccatcgtgagcagcgagctgcagctggcccccagcatgaccaccgtggaccagctggagagccaggtggacaacgtcatcctgcagacaggagagagcgccagcgagtgcttctgcctgcagtgccccagcctgggcaacattgaaggaggagtggccaccggccactacatcatctcctggaagaggaccagcgccatggagaacatccccatcatcaccaccgtcatcaccctgccccacgtgattgtggagaacatccccctgcacgtgaatgctgacctgcccagctttggccgggtgcgggagagcctgcctgtgaagtaccacctgcagaacaagacagacctggtgcaggatgtggagatctctgtggagcccagtgatgccttcatgttttctggcctgaagcagatccggctgcgcatcctgcccggcacagagcaggagatgctgtacaacttctaccccctgatggccggctaccagcagctgcccagcctgaacatcaacctgctgcgcttccccaacttcaccaaccagctgctgcggcgcttcatccccaccagcatctttgtgaagccccagggccgcctgatggatgacaccagcattgctgctgcctag

SEQ ID NO: 173490 - DNA, 3261 bp, Artificial Sequence
  Description of Artificial Sequence: Synthetic coding sequence
atgagccccacccagtgggacttccctgtggagctgtgctgccggcccatggcctttgtgaccctgaccggcctggatgtggtgtacaatgctgtgcacagagctgtgtgggatgccttctgtgccaacagaagagctgacagagtgcccatctccttcaaggtgctgcccggggaccacgagtaccccaagtgccggcccaagaggaccagctatgagtggtacatccccaagggcatcctgaagacaggctggatgaacaagcacctgaacctggtgcctgccctggtggtggtgttctatgagctggactgggatgagccccagtggaaggagaagcagagtgaatgtgccaccagggtggagatcgtgcggcagagcctgcagggcaggaacaccaaggtggccgtggtgctgatccagaagaagacccccctgcccccaggagaagatgtgattgccagcgagagagctgctgccctgtgcaatgcctgtgagctgagcggcaagagcctgtttgtgctgccccacacagaccacctggtgggctacatcatccggctggagaatgccttctatgaacatgcccagacctactactacacagagatcagaagagtgaagagccacaaggagttcctgaacaagaccacccaccagctgctgtttgtgcgccaccagttcaagatcgccttcttcagcgagctgaagcaggacacccagaatgccctgaagaactacagaacagcctacaacctggtgcatgagctgcgggcccacgagaccaacatcctggagatcaagaccatggccggcttcatcaactacaagatctgccgcctgtgcttccagcacaacacccccctggatgccatcgcccagttcaggaagcacatcgacctgtgcaagaagaagattggcagcgctgagctgagctttgaacatgatgcctggatgagcaagcagttccaggccttcggggacctgtttgatgaggccatcaagctgggcctgacagccatccagacccagaaccctggcttctactaccagcaggccgcctactatgcccaggagaggaagcagctggccaagaccctgtgcaaccacgaggcctctgtgatgtaccccaacccagaccccctggagacccagacaggagtgctggacttctacggccagaggtcctggaggcagggcatcctgagctttgacctgagtgaccctgagaaggagaaggtgggcatcctggccatccagctgaaggagagaaatgtggtgcacagcgagatcatcatcaccctgctgagcaatgctgtggcccagttcaagaagtacaagtgccccaggatgaagagccacctgatggtgcagatgggagaggagtactactatgccaaggactacaccaaggccctgaagctgctggactatgtgatgtgtgactacagaagtgagggctggtggaccctgctgacctctgtgctgaccacagccctgaagtgcagctacctgatggcccagctgaaggactacatcacctacagcctggagctgctgggccgggccagcaccctgaaggatgaccagaagagccgcatcgagaagaacctgatcaacgtgctgatgaatgaatctccagaccctgagccagactgtgacatcctggccgtgaagacagcccagaagctgtgggccgaccgcatcagcctggccggcagcaacatcttcaccatcggcgtgcaggactttgtgccctttgtgcagtgcaaggccaagttccacgcccccagcttccacgtggatgtgcctgtgcagtttgacatctacctgaaggctgactgcccccaccccatccgcttcagcaagctgtgtgtgtccttcaacaaccaggagtacaaccagttctgtgtgattgaggaggccagcaaggccaatgaggtgctggagaacctgacccagggcaagatgtgcctggtgcctgggaagaccaggaagctgctcttcaagtttgtggccaagacagaagatgtgggcaagaagattgagatcacctctgtggacctggccctgggcaatgaaacaggccgctgtgtggtgctgaactggcagggcggcggcggagatgctgccagcagccaggaggccctgcaggccgcccggagcttcaagagaagacccaagctgcctgacaatgaggtgcactgggacagcatcatcatccaggccagcaccatgatcatcagccgggtgcccaacatctctgtgcacctgctgcacgagcccccagccctgaccaatgagatgtactgcctggtggtgacagtgcagagccatgagaagacccagatcagagatgtgaagctgacagctggcctgaagccaggccaggatgccaacctgacccagaagacccacgtgaccctgcacggcacagagctgtgtgatgagagctacccagccctgctgacagacatccctgtgggggacctgcaccctggagagcagctggagaagatgctgtatgtgcgctgtggcaccgtgggcagcaggatgttcctggtgtatgtgtcctacctgatcaacaccaccgtggaggagaaggagatcgtgtgcaagtgccacaaggatgaaacagtgaccatcgagaccgtcttcccctttgatgtggccgtgaagtttgtgtccaccaagtttgagcacctggagcgggtgtatgctgacatccccttcctgctgatgacagacctgctgagcgccagcccctgggccctgaccatcgtgagcagcgagctgcagctggcccccagcatgaccaccgtggaccagctggagagccaggtggacaacgtcatcctgcagacaggagagagcgccagcgagtgcttctgcctgcagtgccccagcctgggcaacattgaaggaggagtggccaccggccactacatcatctcctggaagaggaccagcgccatggagaacatccccatcatcaccaccgtcatcaccctgccccacgtgattgtggagaacatccccctgcacgtgaatgctgacctgcccagctttggccgggtgcgggagagcctgcctgtgaagtaccacctgcagaacaagacagacctggtgcaggatgtggagatctctgtggagcccagtgatgccttcatgttttctggcctgaagcagatccggctgcctgcccaggccttctacacctaccagtacttctgccaggccaccggcagcacccatggatag

SEQ ID NO: 173491 - DNA, 3057 bp, Artificial Sequence
  Description of Artificial Sequence: Synthetic coding sequence
atgagccccacccagtgggacttccctgtggagctgtgctgccggcccatggcctttgtgaccctgaccggcctggatgtggtgtacaatgctgtgcacagagctgtgtgggatgccttctgtgccaacagaagagctgacagagtgcccatctccttcaaggtgctgcccggggaccacgagtaccccaagtgccggcccaagaggaccagctatgagtggtacatccccaagggcatcctgaagacaggctggatgaacaagcacctgaacctggtgcctgccctggtggtggtgttctatgagctggactgggatgagccccagtggaaggagaagcagagtgaatgtgccaccagggtggagatcgtgcggcagagcctgcagggcaggaacaccaaggtggccgtggtgctgatccagaagaagacccccctgcccccaggagaagatgtgattgccagcgagagagctgctgccctgtgcaatgcctgtgagctgagcggcaagagcctgtttgtgctgccccacacagaccacctggtgggctacatcatccggctggagaatgccttctatgaacatgcccagacctactactacacagagatcagaagagtgaagagccacaaggagttcctgaacaagaccacccaccagctgctgtttgtgcgccaccagttcaagatcgccttcttcagcgagctgaagcaggacacccagaatgccctgaagaactacagaacagcctacaacctggtgcatgagctgcgggcccacgagaccaacatcctggagatcaagaccatggccggcttcatcaactacaagatctgccgcctgtgcttccagcacaacacccccctggatgccatcgcccagttcaggaagcacatcgacctgtgcaagaagaagattggcagcgctgagctgagctttgaacatgatgcctggatgagcaagcagttccaggccttcggggacctgtttgatgaggccatcaagctgggcctgacagccatccagacccagaaccctggcttctactaccagcaggccgcctactatgcccaggagaggaagcagctggccaagaccctgtgcaaccacgaggcctctgtgatgtaccccaacccagaccccctggagacccagacaggagtgctggacttctacggccagaggtcctggaggcagggcatcctgagctttgacctgagtgaccctgagaaggagaaggtgggcatcctggccatccagctgaaggagagaaatgtggtgcacagcgagatcatcatcaccctgctgagcaatgctgtggcccagttcaagaagtacaagtgccccaggatgaagagccacctgatggtgcagatgggagaggagtactactatgccaaggactacaccaaggccctgaagctgctggactatgtgatgtgtgactacagaagtgagggctggtggaccctgctgacctctgtgctgaccacagccctgaagtgcagctacctgatggcccagctgaaggactacatcacctacagcctggagctgctgggccgggccagcaccctgaaggatgaccagaagagccgcatcgagaagaacctgatcaacgtgctgatgaatgaatctccagaccctgagccagactgtgacatcctggccgtgaagacagcccagaagctgtgggccgaccgcatcagcctggccggcagcaacatcttcaccatcggcgtgcaggactttgtgccctttgtgcagtgcaaggccaagttccacgcccccagcttccacgtggatgtgcctgtgcagtttgacatctacctgaaggctgactgcccccaccccatccgcttcagcaagctgtgtgtgtccttcaacaaccaggagtacaaccagttctgtgtgattgaggaggccagcaaggccaatgaggtgctggagaacctgacccagggcaagatgtgcctggtgcctgggaagaccaggaagctgctcttcaagtttgtggccaagacagaagatgtgggcaagaagattgagatcacctctgtggacctggccctgggcaatgaaacaggccgctgtgtggtgctgaactggcagggcggcggcggagatgctgccagcagccaggaggccctgcaggccgcccggagcttcaagagaagacccaagctgcctgacaatgaggtgcactgggacagcatcatcatccaggccagcaccatgatcatcagccgggtgcccaacatctctgtgcacctgctgcacgagcccccagccctgaccaatgagatgtactgcctggtggtgacagtgcagagccatgagaagacccagatcagagatgtgaagctgacagctggcctgaagccaggccaggatgccaacctgacccagaagacccacgtgaccctgcacggcacagagctgtgtgatgagagctacccagccctgctgacagacatccctgtgggggacctgcaccctggagagcagctggagaagatgctgtatgtgcgctgtggcaccgtgggcagcaggatgttcctggtgtatgtgtcctacctgatcaacaccaccgtggaggagaaggagatcgtgtgcaagtgccacaaggatgaaacagtgaccatcgagaccgtcttcccctttgatgtggccgtgaagtttgtgtccaccaagtttgagcacctggagcgggtgtatgctgacatccccttcctgctgatgacagacctgctgagcgccagcccctgggccctgaccatcgtgagcagcgagctgcagctggcccccagcatgaccaccgtggaccagctggagagccaggtggacaacgtcatcctgcagacaggagagagcgccagcgccctgtactacctgctggagaaggacctgagcaatggagagtacccccaccaccacaactgccaccacagcgctgcccgggactgtggggagtaccccagcccctgtgaatgtagatctgctgtgatctgggcctgccagagggtggtgacctgccaggtgagccccacagaatag

SEQ ID NO: 173492 - DNA, 2091 bp, Artificial Sequence
  Description of Artificial Sequence: Synthetic coding sequence
atggaggatgctgggggcggggaggagcagggcctgctcttccaggaggagaccatcgacctgggcggagatgaatttggcagcgaggagaatgaaacagccagcgagggcagcagccccctggccgacaagctgaatgagcacatgatggagagcgtgctgatcagtgacagccccaacagtgaaggagatgctggggacctgggccgggtgagagatgaagctgagcctggaggagagggggaccccggccctgagcccgccggcacccccagccccagcggggaggctgatggagactgtgccccagaagatgctgcccccagcagcggcggggccccccggcaggatgctgcccgggaggtgcccggcagcgaggccgcccggcctgagcaggagccccctgtggccgagcctgtgcctgtgtgcaccatcttcagccagagggcccccccagccagcggagatggctttgagccccagatggtgaagagccccagctttggaggagccagcgaggccagcgcccggaccccaccccaggtggtgcagcccagccccagcctgagcaccttctttggagacacagctgccagccacagcctggccagtgacttctttgacagcttcaccaccagcgccttcatctctgtgagcaaccctggagctggcagccctgccccagccagccccccacccctggccgtgcctggaacagagggccggcctgagcctgtggccatgaggggcccccaggccgccgcccccccagccagccctgagccctttgcccacatccaggccgtgtttgctggcagtgatgacccctttgccacagccctgtccatgtctgagatggacagaagaaatgatgcctggctgcctggagaggccacccggggcgtgctgcgggctgtggccacccagcagagaggagctgtgtttgtggacaaggagaacctgaccatgcctggcctgcgctttgacaacatccagggagatgctgtgaaggacctgatgctgcgcttcctgggggagaaggctgctgccaagaggcaggtgctgaatgctgacagcgtggagcagagctttgtgggcctgaagcagctgatcagctgcaggaactggagggctgctgtggacctgtgtggccgcctgctgacagcccacggccagggctacggcaagagcggcctgctgaccagccacaccacagacagcctgcagctgtggtttgtgcggctggccctgctggtgaagctgggcctcttccagaatgctgagatggagtttgagcccttcggcaacctggaccagcctgacctgtactatgagtactacccccacgtgtacccaggccggcggggctccatggtgcccttctccatgaggatcctgcacgccgagctgcagcagtacctgggcaacccccaggagagcctggaccggctgcacaaggtgaagacagtgtgcagcaagatcctggccaacctggagcagggcctggccgaggatggcggcatgagctctgtgacccaggagggccggcagggctgcagctacctggtggccagcatccggctgtggaggagccggctgggccgggtgatgtacagcatggccaactgcctgctgctgatgaaggactatgtgctggccgtggaggcctaccacagcgtcatcaagtactacccagagcaggagccccagctgctgtctggaattggccgcatcagcctgcagatcggggacatcaagacagctgagaagtacttccaggatgtggagaaggtgacccagaagctggatggcctgcagggcaagatcatggtgctgatgaacagcgccttcctgcacctgggccagaacaactttgctgaggcccaccgcttcttcacagagatcctgaggatggaccccagaaatgctgtgcagatgctgagcgccagccaccccaccgggaaggagcccagccccaaggatgctgaggagcaccctgagggccaccgggacagcgctgagcccggccctgcccggcccatggtgccccagagggcccctcctggccctgccctgtgtgcccagccctag

SEQ ID NO: 173493 - DNA, 2208 bp, Artificial Sequence
  Description of Artificial Sequence: Synthetic coding sequence
atggaggatgctgggggcggggaggagaccccagcccctgaggccccccaccccccccagctggcccctcctgaggagcagggcctgctcttccaggaggagaccatcgacctgggcggagatgaatttggaagtgaagaaaatgaaacagccagcgagggcagcagccccctggccgacaagctgaatgagcacatgatggagagcgtgctgatcagtgacagccccaacagtgaaggagatgctggggacctgggccgggtgagagatgaggccgagcccggcggggagggggaccccggccctgagcctgctggcacccccagccccagcggggaggctgatggagactgtgccccagaagatgctgcccccagcagtggaggagccccccggcaggatgctgcccgggaggtgcccggcagcgaggccgcccggcctgagcaggagccccctgtggccgagcctgtgcctgtgtgcaccatcttcagccagagggcccccccagccagcggagatggctttgagccccagatggtgaagagccccagctttggaggagccagcgaggccagcgcccggaccccaccccaggtggtgcagcccagccccagcctgagcaccttcttcggggacacagctgccagccacagcctggccagtgacttctttgacagcttcaccaccagcgccttcatctctgtgagcaaccctggggccggcagccctgccccagccagccccccacccctggccgtgcccggcacagagggccggcctgagcctgtggccatgaggggcccccaggccgccgcccccccagccagccctgagccctttgcccacatccaggccgtgtttgctggcagtgatgacccctttgccacagccctgtccatgtctgagatggacagaagaaatgatgcctggctgcccggggaggccacccggggcgtgctgcgggctgtggccacccagcagagaggagctgtgtttgtggacaaggagaacctgaccatgcctggcctgcgctttgacaacatccagggagatgctgtgaaggacctgatgctgcgcttcctgggggagaaggccgccgccaagaggcaggtgctgaatgctgacagcgtggagcagagctttgtgggcctgaagcagctgatcagctgcaggaactggagggctgctgtggacctgtgtggccgcctgctgacagcccacggccagggctacggcaagagcggcctgctgaccagccacaccacagacagcctgcagctgtggtttgtgcggctggccctgctggtgaagctgggcctcttccagaatgctgagatggagtttgagccctttggaaacctggaccagcctgacctgtactatgagtactacccccacgtgtacccaggaagaagaggctccatggtgcccttctccatgaggatcctgcatgctgagctgcagcagtacctgggcaacccccaggagagcctggaccggctgcacaaggtgaagacagtgtgcagcaagatcctggccaacctggagcagggcctggctgaagatggcggcatgagctctgtgacccaggagggccggcaggccagcatccggctgtggaggagccggctgggccgggtgatgtacagcatggccaactgcctgctgctgatgaaggactatgtgctggccgtggaggcctaccacagcgtcatcaagtactacccagagcaggagccccagctgctgagcggcatcggccgcatcagcctgcagattggagacatcaagacagctgagaagtacttccaggatgtggagaaggtgacccagaagctggatggcctgcagggcaagatcatggtgctgatgaacagcgccttcctgcacctgggccagaacaactttgctgaggcccaccgcttcttcacagagatcctgaggatggaccccagaaatgctgtggccaacaacaatgctgctgtgtgcctgctgtacctgggcaagctgaaggacagcctgcggcagctggaggccatggtgcagcaggaccccaggcactacctgcacgagagcgtgctcttcaacctgaccaccatgtatgagctggagagcagccgctccatgcagaagaagcaggccctgctggaggccgtggccggcaaggagggggacagcttcaacacccagtgcctgaagctggcctag

SEQ ID NO: 173494 - DNA, 2208 bp, Artificial Sequence; identical to SEQ ID NO: 173493
  Description of Artificial Sequence: Synthetic coding sequence

SEQ ID NO: 173495 - DNA, 423 bp, Artificial Sequence
  Description of Artificial Sequence: Synthetic coding sequence
atgagcggcagcttctactttgtgattgtgggccaccacgacaaccctgtgtttgagatggagttcctgcctgctgggaaggccgagagcaaggatgaccaccgccacctgaaccagttcatcgcccacgccgccctggacctggtggatgagaacatgtggctgagcaacaacatgtacctgaagacagtggacaagttcaatgagtggtttgtgtctgcctttgtgacagctggccacatgaggttcatcatgctgcatgacatccggcaggaggatggcatcaagaacttcttcacagatgtgtatgacctgtacatcaagttctccatgaaccccttctatgagcccaacagccccatccgcagcagcgcctttgacaggaaggtgcagttcctgggcaagaagcacctgctgtcctag

SEQ ID NO: 173496 - DNA, 423 bp, Artificial Sequence; identical to SEQ ID NO: 173495
  Description of Artificial Sequence: Synthetic coding sequence

SEQ ID NO: 173497 - DNA, 423 bp, Artificial Sequence; identical to SEQ ID NO: 173495
  Description of Artificial Sequence: Synthetic coding sequence

SEQ ID NO: 173498 - DNA, 423 bp, Artificial Sequence; identical to SEQ ID NO: 173495
  Description of Artificial Sequence: Synthetic coding sequence

SEQ ID NO: 173499 - DNA, 444 bp, Artificial Sequence
  Description of Artificial Sequence: Synthetic coding sequence
atgagcggcagcttctactttgtgattgtgggccaccacgacaaccctgtgtttgagatggagttcctgcctgctgggaaggccgagagcaaggatgaccaccgccacctgaaccagttcatcgcccacgccgccctggacctggtggatgagaacatgtggctgagcaacaacatgtacctgaagacagtggacaagttcaatgagtggtttgtgtctgcctttgtgacagctggccacatcctgaccttcctggtgaagatgaggttcatcatgctgcatgacatccggcaggaggatggcatcaagaacttcttcacagatgtgtatgacctgtacatcaagttctccatgaaccccttctatgagcccaacagccccatccgcagcagcgcctttgacaggaaggtgcagttcctgggcaagaagcacctgctgtcctag

SEQ ID NO: 173500 - DNA, 525 bp, Artificial Sequence
  Description of Artificial Sequence: Synthetic coding sequence
atgagctcctggaagcaggacagaagtggcctgcggagcacagagctgaatgtgctggagtaccagcccctgtgtgctgtgcgcagccacatcctgaagaccatgagcggcagcttctactttgtgattgtgggccaccacgacaaccctgtgtttgagatggagttcctgcctgctgggaaggccgagagcaaggatgaccaccgccacctgaaccagttcatcgcccacgccgccctggacctggtggatgagaacatgtggctgagcaacaacatgtacctgaagacagtggacaagttcaatgagtggtttgtgtctgcctttgtgacagctggccacatgaggttcatcatgctgcatgacatccggcaggaggatggcatcaagaacttcttcacagatgtgtatgacctgtacatcaagttctccatgaaccccttctatgagcccaacagccccatccgcagcagcgcctttgacaggaaggtgcagttcctgggcaagaagcacctgctgtcctag

SEQ ID NO: 173501 - DNA, 225 bp, Artificial Sequence
  Description of Artificial Sequence: Synthetic coding sequence
atgagcggcagcttctactttgtgattgtgggccaccacgacaaccctgtgtttgagatggagttcctgcctgctgggaaggccgagagcaaggatgaccaccgccacctgaaccagttcatcgcccacgccgccctggacctggtggatgagaacatgtggctgagcaacaacatgtacctgaagacagtggacaagttcaatgagtggtttgtgtctgcctag

SEQ ID NO: 173502 - DNA, 423 bp, Artificial Sequence
  Description of Artificial Sequence: Synthetic coding sequence
atggctgtgtgcatcgccgtcatcgccaaggagaactaccccctgtacatccgcagcacccccacagaaaatgagctgaagttccactacatggtgcacaccagcctggatgtggtggatgagaagatcagcgccatgggcaaggccctggtggaccagcgggagctgtacctgggcctgctgtaccccacagaggactacaaggtgtatggctacgtgaccaacagcaaggtgaagtttgtgatggtggtggacagcagcaacacagccctgcgggacaatgagatccgctccatgttcaggaagctgcacaacagctacacagatgtgatgtgcaaccccttctacaaccctggggaccgcatccagagcagccgggcctttgacaacatggtgacctccatgatgatccaggtgtgctag

SEQ ID NO: 173503 - DNA, 357 bp, Artificial Sequence
  Description of Artificial Sequence: Synthetic coding sequence
atgagccggcaggccaacagaggaacagagagcaagaagatgagcagcgagctgttcaccctgacctatggagccctggtgacccagctgtgcaaggactatgaaaatgatgaagatgtgaacaagcagctggacaagatgggcttcaacattggagtgcggctgattgaggacttcctggcccggagcaatgtgggccgctgccacgacttccgggagacagcagatgtgattgccaaggagaggaagatgttcctgggcaagcagaacaagaccaagaggcaggccaagctgtatgatgctgtgaaggagagaggagctgccagctgcacagatgccagccccctgctgtcctag

SEQ ID NO: 173504 - DNA, 405 bp, Artificial Sequence
  Description of Artificial Sequence: Synthetic coding sequence
atgggcttcaacattggagtgcggctgattgaggacttcctggcccggagcaatgtgggccgctgccacgacttccgggagacagcagatgtgattgccaaggtggccttcaagatgtacctgggcatcacccccagcatcaccaactggagccctgctggagatgagttcagcctcatcctggagaacaaccccctggtggactttgtggagctgcctgacaaccacagcagcctcatctacagcaacctgctgtgtggggtgctgcggggggccctggagatggtgcagatggctgtggaggccaagtttgtgcaggacaccctgaagggagatggagtgacagagatccgcatgaggttcatcagaagaattgaggacaacctgcctgctggggaggagtag

SEQ ID NO: 173505 - DNA, 405 bp, Artificial Sequence; identical to SEQ ID NO: 173504
  Description of Artificial Sequence: Synthetic coding sequence

SEQ ID NO: 173506 - DNA, 543 bp, Artificial Sequence
  Description of Artificial Sequence: Synthetic coding sequence
atgagccggcaggccaacagaggaacagagagcaagaagatgagcagcgagctgttcaccctgacctatggagccctggtgacccagctgtgcaaggactatgaaaatgatgaagatgtgaacaagcagctggacaagatgggcttcaacattggagtgcggctgattgaggacttcctggcccggagcaatgtgggccgctgccacgacttccgggagacagcagatgtgattgccaaggtggccttcaagatgtacctgggcatcacccccagcatcaccaactggagccctgctggagatgagttcagcctcatcctggagaacaaccccctggtggactttgtggagctgcctgacaaccacagcagcctcatctacagcaacctgctgtgtggggtgctgcggggggccctggagatggtgcagatggctgtggaggccaagtttgtgcaggacaccctgaagggagatggagtgacagagatccgcatgaggttcatcagaagaattgaggacaacctgcctgctggggaggagtag

SEQ ID NO: 173507 - DNA, 498 bp, Artificial Sequence
  Description of Artificial Sequence: Synthetic coding sequence
atggccatcttctctgtgtatgtggtgaacaaggccggcggcctcatctaccagctggacagctatgcccccagggctgaggccgagaagaccttctcctaccccctggacctgctgctgaagctgcatgatgagcgggtgctggtggccttcggccagagagatggcatccgggtgggccatgctgtgctggccatcaatggcatggatgtgaatggccgctacacagcagatggcaaggagatgctggagacagacaccttcaagctgcactgctaccagaccctgaccggcatcaagtttgtggtgctggccgacccccggcaggccggcatcgacagcctgctgaggaagatctatgagatctacagcgactttgccctgaagaaccccttctacagcctggagatgcccatccgctgtgagctgtttgaccagaacctgaagctggccctggaggtggccgagaaggccggcacctttggacctggcagctag

SEQ ID NO: 173508 - DNA, 660 bp, Artificial Sequence
  Description of Artificial Sequence: Synthetic coding sequence
atggccatcttctctgtgtatgtggtgaacaaggccggcggcctcatctaccagctggacagctatgcccccagggctgaggccgagaagaccttctcctaccccctggacctgctgctgaagctgcatgatgagcgggtgctggtggccttcggccagagagatggcatccgggtgggccatgctgtgctggccatcaatggcatggatgtgaatggccgctacacagcagatggcaaggaggtgctggagtacctgggcaacccagccaactaccctgtgtccatccgcttcggccggccccggctgaccagcaatgagaagctgatgctggcctccatgttccacagcctgtttgccatcggcagccagctgagccctgagcagggcagcagcggcatcgagatgctggagacagacaccttcaagctgcactgctaccagaccctgaccggcatcaagtttgtggtgctggccgacccccggcaggccggcatcgacagcctgctgaggaagatctatgagatctacagcgactttgccctgaagaaccccttctacagcctggagatgcccatccgctgtgagctgtttgaccagaacctgaagctggccctggaggtggccgagaaggccggcacctttggacctggcagctag

SEQ ID NO: 173509 - DNA, 4308 bp, Artificial Sequence
  Description of Artificial Sequence: Synthetic coding sequence
atggcccagtgtgtgcagagcgtgcaggagctgatcccagacagctttgtgccctgtgtggccgccctgtgcagtgatgaggccgagcggctgacccggctgaaccacctgagctttgctgagctgctgaagcccttcagccggctgaccagcgaggtgcacatgagggaccccaacaaccagctgcacgtgatcaagaacctgaagattgctgtgagcaacatcgtgacccagcccccccagcccggggccatcaggaagctgctgaatgatgtggtgtctggcagccagcctgctgagggcctggtggccaacgtcatcacagctggggactatgacctgaacatcagcgccaccaccccctggtttgagagctaccgggagaccttcctgcagagcatgcctgccctggaccacgagttcctgaaccactacctggcctgcatgctggtggccagcagcagcgaggccgagcctgtggagcagttcagcaagctgagccaggagcagcaccgcatccagcacaacagcgactacagctaccccaagtggttcatccccaacaccctgaagtactacgtgctgctgcatgatgtgtctgctggagatgagcagagagctgagagcatctatgaggagatgaagcagaagtatggcacccagggctgctacctgctgaagatcaacagcaggaccagcaacagagccagtgatgagcagatcccagacccctggagccagtacctgcagaagaacagcatccagaaccaggagagctatgaagatggcccctgcaccatcaccagcaacaagaacagcgacaacaacctgctgagcctggatggcctggacaatgaggtgaaggatggcctgcccaacaacttccgggcccaccccctgcagctggagcagagcagtgaccccagcaacagcattgatggccctgaccacctgcggagcgccagcagcctgcacgagaccaagaagggcaacacaggcatcatccacggggcctgcctgaccctgacagaccatgaccgcatccggcagttcatccaggagttcaccttccggggcctgctgccccacatcgagaagaccatccggcagctgaatgaccagctgatcagcaggaagggcctgagccgcagcctcttcagcgccaccaagaagtggttcagcggcagcaaggtgcctgagaagagcatcaatgacctgaagaacaccagcggcctgctgtacccacctgaggcccctgagctgcagatcaggaagatggctgacctgtgcttcctggtgcagcactatgacctggcctacagctgctaccacacagccaagaaggacttcctgaatgaccaggccatgctgtatgctgctggggccctggagatggctgctgtgtctgccttcctgcagcccggggccccccggccctacccagcccactacatggacacagccatccagacctacagagacatctgcaagaacatggtgctggccgagcgctgtgtgctgctgtctgctgagctgctgaagagccagagcaagtacagcgaggccgccgccctgctgatccggctgaccagcgaggacagcgacctgcggagcgccctgctgctggagcaggccgcccactgcttcatcaacatgaagagccccatggtgaggaaatatgccttccacatgatcctggccggccaccgcttcagcaaggccggccagaagaagcacgccctgcgctgctactgccaggccatgcaggtgtacaagggcaagggctggagcctggccgaggaccacatcaacttcaccatcggccggcagagctacaccctgcggcagctggacaatgctgtgtctgccttccgccacatcctgatcaatgaaagcaagcagagcgctgcccagcagggcgccttcctgcgggagtacctgtatgtgtacaagaatgtgtcccagctgagcccagatggccccctgccccagctgcccctgccctacatcaacagcagcgccaccagggtcttctttggacatgacagaagaccagcagatggagagaagcaggccgccacccacgtgtccctggaccaggagtatgacagcgagagcagccagcagtggagggagctggaggagcaggtggtgtctgtggtgaacaagggcgtcatccccagcaacttccaccccacccagtactgcctgaacagctacagcgacaacagccgcttccccctggccgtggtggaggagcccatcaccgtggaggtggccttcaggaaccccctgaaggtgctgctgctgctgacagacctgagcctgctgtggaagttccaccccaaggacttcagcggcaaggacaatgaggaggtgaagcagctggtgaccagcgagcctgagatgattggagctgaggtgatcagcgagttcctgatcaatggagaggagagcaaggtggcccggctgaagctgttcccccaccacatcggggagctgcacatcctgggcgtggtgtacaacctgggcaccatccagggctccatgacagtggatggcattggagccctgcccggctgccacacaggcaagtacagcctgtccatgtctgtgcggggcaagcaggacctggagatccagggcccccggctgaacaacaccaaggaggagaagacctctgtgaagtatggccctgaccggcggctggaccccatcatcacagaggagatgcccctgctggaggtgttcttcatccacttccccaccggcctgctgtgtggggagatcaggaaggcctacgtggagtttgtgaatgtgtccaagtgccccctgaccggcctgaaggtggtgtccaagaggcctgagttcttcaccttcggcggcaacacagctgtgctgacccccctgagccccagcgccagcgagaactgcagcgcctacaagacagtggtgacagatgccacctctgtgtgcacagccctgatcagcagcgccagctctgtggactttggcatcggcaccggcagccagcctgaggtgattcctgtgcccctgcctgacacagtgctgctgcccggggcctctgtgcagctgcccatgtggctgcggggcccagatgaggagggcgtgcatgagatcaacttcctgttctactatgaatctgtgaagaagcagcccaagatccgccaccgcatcctgcggcacacagccatcatctgcaccagccgcagcctgaatgtgcgggccaccgtgtgccgcagcaacagcctggagaatgaggagggccggggcggcaacatgctggtgtttgtggatgtggagaacaccaacaccagcgaggccggcgtgaaggagttccacatcgtgcaggtgagcagcagcagcaagcactggaagctgcagaagtctgtgaacctgtctgagaacaaggacaccaagctggccagccgggagaagggcaagttctgcttcaaggccatccgctgtgagaaggaggaggccgccacccagagcagcgagaagtacacctttgctgacatcatctttggaaatgagcagatcatcagcagcgccagcccctgtgccgacttcttctaccgcagcctgagcagcgagctgaagaagccccaggcccacctgcctgtgcacacagagaagcagagcacagaagatgctgtgcggctcatccagaagtgcagcgaggtggacctgaacatcgtcatcctgtggaaggcctacgtggtggaggacagcaagcagctgatcctggagggccagcaccacgtgatcctgcggaccatcggcaaggaggccttctcctacccccagaagcaggagcccccagagatggagctgctgaagttcttccggcctgagaacatcaccgtgagcagccggcccagcgtggagcagctgagcagcctcatcaagaccagcctgcactacccagagagcttcaaccaccccttccaccagaagagcctgtgcctggtgcctgtgaccctgctgctgagcaactgcagcaaggcagatgtggatgtgattgtggacctgcggcacaagaccaccagccctgaggccctggagatccacggcagcttcacctggctgggccagacccagtacaagctgcagctgaagagccaggagatccacagcctgcagctgaaggcctgctttgtgcacactggagtgtacaacctgggcaccccccgggtgtttgccaagctgagtgaccaggtgacagtgtttgagaccagccagcagaacagcatgcctgccctgatcatcatcagcaatgtgtag

SEQ ID NO: 173510 - DNA, 3420 bp, Artificial Sequence
  Description of Artificial Sequence: Synthetic coding sequence
atgtctgtgcctgactacatgcagtgtgccgaggaccaccagaccctgctggtggtggtgcagcctgtgggcatcgtgtctgaggagaacttcttccgcatctacaagaggatctgcagcgtgtcccagatctctgtgcgggacagccagagggtgctgtacatccgctaccgccaccactacccacctgagaacaatgagtggggagacttccagacccacaggaaggtggtgggcctcatcaccatcacagactgcttcagcgccaaggactggccccagacctttgagaagttccacgtgcagaaggagatctacggcagcaccctgtatgacagccggctgtttgtgtttggcctgcagggcgagatcgtggagcagcccaggacagatgtggccttctaccccaactatgaggactgccagacagtggagaagagaattgaggacttcatcgagagcctcttcatcgtgctggagagcaagaggctggaccgggccacagacaagagcggggacaagatccccctgctgtgtgtgccctttgagaagaaggactttgtgggcctggacacagacagccgccactacaagaagcgctgccagggccgcatgaggaagcacgtgggggacctgtgcctgcaggccggcatgctgcaggacagcctggtgcactaccacatgtctgtggagctgctgcggtctgtgaatgacttcctgtggctgggcgccgccctggagggcctgtgcagcgccagcgtcatctaccactacccaggcggcaccggcggcaagagcggggcccggcgcttccagggcagcaccctgcctgctgaggccgccaacagacacaggcctggggccctgaccaccaacggcatcaacccagacaccagcacagagatcggccgggccaagaactgcctgagccctgaggacatcatcgacaagtacaaggaggccatctcctactacagcaagtacaagaatgctggggtcatcgagctggaggcctgcatcaaggctgtgcgggtgctggccatccagaagaggtccatggaggccagcgagttcctgcagaatgctgtgtacatcaacctgcggcagctgtctgaggaggagaagatccagcgctacagcatcctgtctgagctgtatgagctgattggcttccacaggaagagcgccttcttcaagagggtggccgccatgcagtgtgtggcccccagcattgctgagcccggctggagggcctgctacaagctgctgctggagaccctgcccggctacagcctgagcctggaccccaaggacttcagccggggcacccaccggggctgggccgctgtgcagatgaggctgctgcacgagctggtgtatgccagcaggaggatgggcaacccagccctgtctgtgcgccacctgtccttcctgctgcagaccatgctggacttcctgagtgaccaggagaagaaggatgtggcccagagcctggagaactacaccagcaagtgccccggcaccatggagcccatcgccctgcccggcggcctgaccctgccccctgtgcccttcaccaagctgcccatcgtgagacatgtgaagctgctgaacctgcctgccagcctgcggccccacaagatgaagagcctgctgggccagaatgtgtccaccaagagccccttcatctacagccccatcatcgcccacaacagaggagaggagaggaacaagaagattgacttccagtgggtgcagggagatgtgtgtgaggtgcagctgatggtgtacaaccccatgccctttgagctgcgggtggagaacatgggcctgctgaccagcggcgtggagtttgagagcctgcctgctgccctgagcctgcctgctgagagcggcctgtaccctgtgaccctggtgggcgtgccccagaccaccggcaccatcaccgtgaatggctaccacaccaccgtgtttggagtcttcagtgactgcctgctggacaacctgcccggcatcaagaccagcggcagcacagtggaggtgatcccagccctgccccggctgcagatcagcaccagcctgcccaggtctgcccacagcctgcagcccagcagtggagatgagatcagcaccaacgtgtctgtgcagctgtacaatggagagagccagcagctgatcatcaagctggagaacatcggcatggagcccctggagaagctggaggtgaccagcaaggtgctgaccaccaaggagaagctgtatggagacttcctgtcctggaagctggaggagaccctggcccagttccccctgcagcccgggaaggtggccaccttcaccatcaacatcaaggtgaagctggacttcagctgccaggagaacctgctgcaggacctgagtgatgatggcatctctgtgtctggcttccccctgagcagccccttccggcaggtggtgcggccccgggtggagggcaagcctgtgaaccccccagagagcaacaaggccggggactacagccacgtgaagaccctggaggccgtgctgaacttcaagtacagcggcggccctggccacacagagggctactacagaaacctgagcctgggcctgcacgtggaggtggagcccagcgtcttcttcaccagggtgtccaccctgcctgccaccagcacccggcagtgccacctgctgctggatgtgttcaacagcacagaacatgagctgactgtgtccaccaggagcagcgaggccctgatcctgcatgctggggagtgccagaggatggccatccaggtggacaagttcaactttgagagcttccctgagagccctggagagaagggccagtttgccaaccccaagcagctggaggaggagcggcgggaggcccggggcctggagatccacagcaagctgggcatctgctggaggatccccagcctgaagaggtctggagaggcctctgtggagggcctgctgaaccagctggtgctggagcacctgcagctggcccccctgcagtgggatgtgctggtggatggccagccctgtgaccgggaggccgtggccgcctgccaggtgggggaccctgtgcggctggaggtgcggctgaccaacagaagccccaggtctgtgggcccctttgccctgactgtggtgcccttccaggaccaccagaatggagtgcacaactatgacctgcatgacacagtgtcctttgtgggcagcagcaccttctacctggatgctgtgcagcccagcggccagagcgcctgcctgggcgccctgctcttcctgtacaccggggacttcttcctgcacatccgcttccacgaggacagcaccagcaaggagctgcccccatcctggttctgcctgcccagcgtgcacgtgtgtgccctggaggcccaggcctag

SEQ ID NO: 173511 - DNA, 3741 bp, Artificial Sequence
  Description of Artificial Sequence: Synthetic coding sequence
atggtgcctgctggggaccaggaccgggccccccaccggggcaagccagcccaggccggggcccggaccagccgggccagccgggccctgcgctcctggaggaggagccaggccgcccgggccaccgtgacccacccccggggcggccatgaccggggcagccatggaggctaccgggagggccaccggggctgccggcgggacccccagtgggccagcgctggccccccacccctgtccttcacagaggaggtgaagtttgagctgcgggccctgaaggactgggacttcaagatgtctgtgcctgactacatgcagtgtgccgaggaccaccagaccctgctggtggtggtgcagcctgtgggcatcgtgtctgaggagaacttcttccgcatctacaagaggatctgcagcgtgtcccagatctctgtgcgggacagccagagggtgctgtacatccgctaccgccaccactacccacctgagaacaatgagtggggagacttccagacccacaggaaggtggtgggcctcatcaccatcacagactgcttcagcgccaaggactggccccagacctttgagaagttccacgtgcagaaggagatctacggcagcaccctgtatgacagccggctgtttgtgtttggcctgcagggcgagatcgtggagcagcccaggacagatgtggccttctaccccaactatgaggactgccagacagtggagaagagaattgaggacttcatcgagagcctcttcatcgtgctggagagcaagaggctggaccgggccacagacaagagcggggacaagatccccctgctgtgtgtgccctttgagaagaaggactttgtgggcctggacacagacagccgccactacaagaagcgctgccagggccgcatgaggaagcacgtgggggacctgtgcctgcaggccggcatgctgcaggacagcctggtgcactaccacatgtctgtggagctgctgcggtctgtgaatgacttcctgtggctgggcgccgccctggagggcctgtgcagcgccagcgtcatctaccactacccaggcggcaccggcggcaagagcggggcccggcgcttccagggcagcaccctgcctgctgaggccgccaacagacacaggcctggggcccaggaggtgctgattgatcctggggccctgaccaccaacggcatcaacccagacaccagcacagaaattggccgggccaagaactgcctgagccctgaggacatcatcgacaagtacaaggaggccatctcctactacagcaagtacaagaatgctggggtgattgagctggaggcctgcatcaaggctgtgcgggtgctggccatccagaagaggtccatggaggccagcgagttcctgcagaatgctgtgtacatcaacctgcggcagctgtctgaggaggagaagatccagcgctacagcatcctgtctgagctgtatgagctgattggcttccacaggaagagcgccttcttcaagagggtggccgccatgcagtgtgtggcccccagcattgctgagcccggctggagggcctgctacaagctgctgctggagaccctgcccggctacagcctgagcctggaccccaaggacttcagccggggcacccaccggggctgggccgctgtgcagatgaggctgctgcacgagctggtgtatgccagcaggaggatgggcaacccagccctgtctgtgcgccacctgtccttcctgctgcagaccatgctggacttcctgagtgaccaggagaagaaggatgtggcccagagcctggagaactacaccagcaaatgtcctggcaccatggagcccatcgccctgcccggcggcctgaccctgccccctgtgcccttcaccaagctgcccatcgtgcgccacgtgaagctgctgaacctgcctgccagcctgcggccccacaagatgaagagcctgctgggccagaatgtgtccaccaagagccccttcatctacagccccatcatcgcccacaacagaggagaggagaggaacaagaagattgacttccagtgggtgcagggagatgtgtgtgaggtgcagctgatggtgtacaaccccatgccctttgagctgcgggtggagaacatgggcctgctgaccagcggcgtggagtttgagagcctgcctgctgccctgagcctgcctgctgagagcggcctgtaccctgtgaccctggtgggcgtgccccagaccaccggcaccatcaccgtgaatggctaccacaccaccgtgtttggagtcttcagtgactgcctgctggacaacctgcccggcatcaagaccagcggcagcacagtggaggtgatcccagccctgccccggctgcagatcagcaccagcctgcccaggtctgcccacagcctgcagcccagcagtggagatgagatcagcaccaacgtgtctgtgcagctgtacaacggggagagccagcagctgatcatcaagctggagaacatcggcatggagcccctggagaagctggaggtgaccagcaaggtgctgaccaccaaggagaagctgtatggagacttcctgtcctggaagctggaggagaccctggcccagttccccctgcagcccgggaaggtggccaccttcaccatcaacatcaaggtgaagctggacttcagctgccaggagaacctgctgcaggacctgagtgatgatggcatctctgtgtctggcttccccctgagcagccccttccggcaggtggtgcggccccgggtggagggcaagcctgtgaaccccccagagagcaacaaggccggggactacagccacgtgaagaccctggaggccgtgctgaacttcaagtacagcggcggccctggccacacagagggctactacagaaacctgagcctgggcctgcacgtggaggtggagcccagcgtcttcttcaccagggtgtccaccctgcctgccaccagcacccggcagtgccacctgctgctggatgtgttcaacagcacagagcacgagctgactgtgtccaccaggagcagcgaggccctgatcctgcacgccggggagtgccagaggatggccatccaggtggacaagttcaactttgagagcttccctgagagccctggagagaagggccagtttgccaaccccaagcagctggaggaggagcggcgggaggcccggggcctggagatccacagcaagctgggcatctgctggaggatccccagcctgaagaggtctggagaggcctctgtggagggcctgctgaaccagctggtgctggagcacctgcagctggcccccctgcagtgggatgtgctggtggatggccagccctgtgaccgggaggccgtggccgcctgccaggtgggggaccctgtgcggctggaggtgcggctgaccaacagaagccccaggtctgtgggcccctttgccctgactgtggtgcccttccaggaccaccagaatggagtgcacaactatgacctgcatgacacagtgtcctttgtgggcagcagcaccttctacctggatgctgtgcagcccagcggccagagcgcctgcctgggcgccctgctcttcctgtacacaggagacttcttcctgcacatccgcttccacgaggacagcaccagcaaggagctgccccccagctggttctgcctgcccagcgtgcacgtgtgtgccctggaggcccaggcctag

SEQ ID NO: 173512 - DNA, 3447 bp, Artificial Sequence
  Description of Artificial Sequence: Synthetic coding sequence
atgtctgtgcctgactacatgcagtgtgccgaggaccaccagaccctgctggtggtggtgcagcctgtgggcatcgtgtctgaggagaacttcttccgcatctacaagaggatctgcagcgtgtcccagatctctgtgcgggacagccagagggtgctgtacatccgctaccgccaccactacccacctgagaacaatgagtggggagacttccagacccacaggaaggtggtgggcctcatcaccatcacagactgcttcagcgccaaggactggccccagacctttgagaagttccacgtgcagaaggagatctacggcagcaccctgtatgacagccggctgtttgtgtttggcctgcagggcgagatcgtggagcagcccaggacagatgtggccttctaccccaactatgaggactgccagacagtggagaagagaattgaggacttcatcgagagcctcttcatcgtgctggagagcaagaggctggaccgggccacagacaagagcggggacaagatccccctgctgtgtgtgccctttgagaagaaggactttgtgggcctggacacagacagccgccactacaagaagcgctgccagggccgcatgaggaagcacgtgggggacctgtgcctgcaggccggcatgctgcaggacagcctggtgcactaccacatgtctgtggagctgctgcggtctgtgaatgacttcctgtggctgggcgccgccctggagggcctgtgcagcgccagcgtcatctaccactacccaggcggcaccggcggcaagagcggggcccggcgcttccagggcagcaccctgcctgctgaggccgccaacagacacaggcctggggcccaggaggtgctgattgatcctggggccctgaccaccaacggcatcaacccagacaccagcacagaaattggccgggccaagaactgcctgagccctgaggacatcatcgacaagtacaaggaggccatctcctactacagcaagtacaagaatgctggggtgattgagctggaggcctgcatcaaggctgtgcgggtgctggccatccagaagaggtccatggaggccagcgagttcctgcagaatgctgtgtacatcaacctgcggcagctgtctgaggaggagaagatccagcgctacagcatcctgtctgagctgtatgagctgattggcttccacaggaagagcgccttcttcaagagggtggccgccatgcagtgtgtggcccccagcattgctgagcccggctggagggcctgctacaagctgctgctggagaccctgcccggctacagcctgagcctggaccccaaggacttcagccggggcacccaccggggctgggccgctgtgcagatgaggctgctgcacgagctggtgtatgccagcaggaggatgggcaacccagccctgtctgtgcgccacctgtccttcctgctgcagaccatgctggacttcctgagtgaccaggagaagaaggatgtggcccagagcctggagaactacaccagcaaatgtcctggcaccatggagcccatcgccctgcccggcggcctgaccctgccccctgtgcccttcaccaagctgcccatcgtgcgccacgtgaagctgctgaacctgcctgccagcctgcggccccacaagatgaagagcctgctgggccagaatgtgtccaccaagagccccttcatctacagccccatcatcgcccacaacagaggagaggagaggaacaagaagattgacttccagtgggtgcagggagatgtgtgtgaggtgcagctgatggtgtacaaccccatgccctttgagctgcgggtggagaacatgggcctgctgaccagcggcgtggagtttgagagcctgcctgctgccctgagcctgcctgctgagagcggcctgtaccctgtgaccctggtgggcgtgccccagaccaccggcaccatcaccgtgaatggctaccacaccaccgtgtttggagtcttcagtgactgcctgctggacaacctgcccggcatcaagaccagcggcagcacagtggaggtgatcccagccctgccccggctgcagatcagcaccagcctgcccaggtctgcccacagcctgcagcccagcagtggagatgagatcagcaccaacgtgtctgtgcagctgtacaacggggagagccagcagctgatcatcaagctggagaacatcggcatggagcccctggagaagctggaggtgaccagcaaggtgctgaccaccaaggagaagctgtatggagacttcctgtcctggaagctggaggagaccctggcccagttccccctgcagcccgggaaggtggccaccttcaccatcaacatcaaggtgaagctggacttcagctgccaggagaacctgctgcaggacctgagtgatgatggcatctctgtgtctggcttccccctgagcagccccttccggcaggtggtgcggccccgggtggagggcaagcctgtgaaccccccagagagcaacaaggccggggactacagccacgtgaagaccctggaggccgtgctgaacttcaagtacagcggcggccctggccacacagagggctactacagaaacctgagcctgggcctgcacgtggaggtggagcccagcgtcttcttcaccagggtgtccaccctgcctgccaccagcacccggcagtgccacctgctgctggatgtgttcaacagcacagagcacgagctgactgtgtccaccaggagcagcgaggccctgatcctgcacgccggggagtgccagaggatggccatccaggtggacaagttcaactttgagagcttccctgagagccctggagagaagggccagtttgccaaccccaagcagctggaggaggagcggcgggaggcccggggcctggagatccacagcaagctgggcatctgctggaggatccccagcctgaagaggtctggagaggcctctgtggagggcctgctgaaccagctggtgctggagcacctgcagctggcccccctgcagtgggatgtgctggtggatggccagccctgtgaccgggaggccgtggccgcctgccaggtgggggaccctgtgcggctggaggtgcggctgaccaacagaagccccaggtctgtgggcccctttgccctgactgtggtgcccttccaggaccaccagaatggagtgcacaactatgacctgcatgacacagtgtcctttgtgggcagcagcaccttctacctggatgctgtgcagcccagcggccagagcgcctgcctgggcgccctgctcttcctgtacacaggagacttcttcctgcacatccgcttccacgaggacagcaccagcaaggagctgccccccagctggttctgcctgcccagcgtgcacgtgtgtgccctggaggcccaggcctag

SEQ ID NO: 173513 - DNA, 2862 bp, Artificial Sequence
  Description of Artificial Sequence: Synthetic coding sequence
atggccctggtgttccagtttggccagcctgtgcgggcccagcccctgcccggcctgtgccacggcaagctgatccgcaccaatgcctgtgatgtgtgcaacagcacagacctgcctgaggtggagatcatcagcctgctggaggagcagctgccccactacaagctgcgggctgacaccatctacggctatgaccatgatgactggctgcacacccccctcatcagcccagatgccaacatcgacctgaccacagagcagatcgaggagaccctgaagtacttcctgctgtgtgccgagcgggtgggccagatgaccaagacctacaatgacattgatgctgtgacccggctgctggaggagaaggagcgggacctggagctggccgcccgcatcggccagagcctgctgaagaagaacaagaccctgacagaaagaaatgagctgctggaggagcaggtggagcacatccgggaggaggtgtcccagctgcggcatgagctgtccatgaaggatgagctgctgcagttctacaccagcgctgctgaggagagcgagcctgagagcgtgtgcagcacccccctgaagagaaatgaaagcagcagctctgtgcagaactacttccacctggacagcctgcagaagaagctgaaggacctggaggaggagaatgtggtgctgcggtctgaggccagccagctgaagacagagaccatcacctatgaggagaaggagcagcagctggtgaatgactgtgtgaaggagctgagagatgccaacgtgcagatcgccagcatcagcgaggagctggccaagaagacagaagatgctgcccggcagcaggaggagatcacccacctgctgagccagatcgtggacctgcagaagaaggccaaggcctgtgctgtggagaatgaggagctggtgcagcacctgggcgccgccaaggatgcccagaggcagctgacagctgagctgcgggagctggaggacaagtatgcagagtgcatggagatgctgcacgaggcccaggaggagctgaagaacctgaggaacaagaccatgcccaacaccaccagccgccgctaccacagcctgggcctcttccccatggacagcctggccgctgagattgagggcaccatgaggaaggagctgcagctggaggaggccgagagcccagacatcacccaccagaagagggtgtttgaaacagtgaggaacatcaaccaggtggtgaagcagaggagcctgacccccagccccatgaacatccctggcagcaaccagagcagcgccatgaacagcctgctgagcagctgtgtgtccacccccaggagcagcttctacggcagtgacattggaaatgtggtgctggacaacaagaccaacagcatcatcctggagacagaggccgctgacctgggcaatgatgagaggagcaagaagccaggcaccccaggcaccccaggcagccatgacctggagacagccctgcggcggctgagcctgcggcgggagaactacctgtctgaaagacgcttctttgaggaggagcaggagaggaagctgcaggagctggccgagaagggggagctgcggagcggcagcctgacccccacagagagcatcatgagcctgggcacccacagccgcttcagcgagttcaccggcttcagcggcatgtccttcagcagccgcagctacctgcctgagaagctgcagatcgtgaagcccctggagggcagcgccaccctgcaccactggcagcagctggcccagccccacctgggcggcatcctggaccccaggcctggggtggtgaccaagggcttccgcaccctggatgtggacctggatgaggtgtactgcctgaatgactttgaggaggatgacacaggagaccacatcagcctgccccggctggccaccagcacccctgtgcagcaccctgagaccagcgcccaccaccctgggaagtgcatgagccagaccaacagcaccttcaccttcaccacctgccgcatcctgcaccccagtgatgagctgaccagggtgacccccagcctgaacagcgcccccaccccagcctgtggcagcaccagccacctgaagagcacccctgtggccaccccctgcaccccccggcggctgagcctggccgagagcttcaccaacacccgggagagcaccaccaccatgagcaccagcctgggcctggtgtggctgctgaaggagcggggcatctctgctgctgtgtatgacccccagagctgggaccgggccggccggggcagcctgctgcacagctacacccccaagatggccgtcatccccagcaccccacccaacagccccatgcagacccccaccagcagcccccccagctttgagttcaagtgcaccagccccccctatgacaacttcctggccagcaagccagccagcagcatcctgcgggaggtgcgggagaagaatgtgcgcagcagcgagagccagacagatgtgtctgtgagcaacctgaacctggtggacaaggtgcggcgcttcggcgtggccaaggtggtgaacagcggccgggcccacgtgcccaccctgacagaggagcagggccccctgctgtgtggccccccaggccctgccccagccctggtgccccggggcctggtgcctgagggcctgcccctgcgctgccccaccgtgaccagcgccatcggcggcctgcagctgaacagcggcatcagaagaaacagaagcttccccaccatggtgggcagctccatgcagatgaaggcccctgtgaccctgaccagcggcatcctgatgggcgccaagctgagcaagcagaccagcctgaggtag

SEQ ID NO: 173514 - DNA, 2061 bp, Artificial Sequence
  Description of Artificial Sequence: Synthetic coding sequence
atgagcctgcgggacaagggcggggaggaggagtgctttgaatatgactgccaggatgaggagaggaagcccacccaccggcagcacgacacccaggacctgctggaggaggtgctgtgtgccgagcgggtgggccagatgaccaagacctacaatgacattgatgctgtgacccggctgctggaggagaaggagcgggacctggagctggccgcccgcatcggccagagcctgctgaagaagaacaagaccctgacagaaagaaatgagctgctggaggagcaggtggagcacatccgggaggaggtgtcccagctgcggcatgagctgtccatgaaggatgagctgctgcagttctacaccagcgctgctgaggagagcgagcctgagagcgtgtgcagcacccccctgaagagaaatgaaagcagcagctctgtgcagaactacttccacctggacagcctgcagaagaagctgaaggacctggaggaggagaatgtggtgctgcggtctgaggccagccagctgaagacagagaccatcacctatgaggagaaggagcagcagctggtgaatgactgtgtgaaggagctgagagatgccaacgtgcagatcgccagcatcagcgaggagctggccaagaagacagaagatgctgcccggcagcaggaggagatcacccacctgctgagccagatcgtggacctgcagaagaaggccaaggcctgtgctgtggagaatgaggagctggtgcagcacctgggcgccgccaaggatgcccagaggcagctgacagctgagctgcgggagctggaggacaagtatgcagagtgcatggagatgctgcacgaggcccaggaggagctgaagaacctgaggaacaagaccatgcccaacaccaccagccgccgctaccacagcctgggcctcttccccatggacagcctggccgctgagattgagggcaccatgaggaaggagctgcagctggaggaggccgagagcccagacatcacccaccagaagagggtgtttgaaacagtgaggaacatcaaccaggtggtgaagcagaggagcctgacccccagccccatgaacatccctggcagcaaccagagcagcgccatgaacagcctgctgagcagctgtgtgtccacccccaggagcagcttctacggcagtgacattggaaatgtggtgctggacaacaagaccaacagcatcatcctggagacagaggccgctgacctgggcaatgatgagaggagcaagaagccaggcaccccaggcaccccaggcagccatgacctggagacagccctgcggcggctgagcctgcggcgggagaactacctgtctgaaagacgcttctttgaggaggagcaggagaggaagctgcaggagctggccgagaagggggagctgcggagcggcagcctgacccccacagagagcatcatgagcctgggcacccacagccgcttcagcgagttcaccggcttcagcggcatgtccttcagcagccgcagctacctgcctgagaagctgcagatcgtgaagcccctggagggcagcgccaccctgcaccactggcagcagctggcccagccccacctgggcggcatcctggaccccaggcctggggtggtgaccaagggcttccgcaccctggatgtggacctggatgaggtgtactgcctgaatgactttgaggaggatgacacaggagaccacatcagcctgccccggctggccaccagcacccctgtgcagcaccctgagaccagcggggagaggagccaggcccgggtgacagtgtctggcagccgcagctaccccagccggccccaggccagccctgaggagatgcaggagcccccagctgccacagaggaggaggaggaggaggaggaggaggagggcagcggggagggcaccaccatcagccctgtgaacctggcccccttccctgaggccgagttctgggccatcctgacctctgtgcccggcaccatccgcagcggcagcctgtctgtggccagcgcccggctgtgtggctag

SEQ ID NO: 173515 - DNA, 2688 bp, Artificial Sequence
  Description of Artificial Sequence: Synthetic coding sequence
atgagcctgcgggacaagggcggggaggaggagtgctttgaatatgactgccaggatgaggagaggaagcccacccaccggcagcacgacacccaggacctgctggaggaggtgctgtgtgccgagcgggtgggccagatgaccaagacctacaatgacattgatgctgtgacccggctgctggaggagaaggagcgggacctggagctggccgcccgcatcggccagagcctgctgaagaagaacaagaccctgacagaaagaaatgagctgctggaggagcaggtggagcacatccgggaggaggtgtcccagctgcggcatgagctgtccatgaaggatgagctgctgcagttctacaccagcgctgctgaggagagcgagcctgagagcgtgtgcagcacccccctgaagagaaatgaaagcagcagctctgtgcagaactacttccacctggacagcctgcagaagaagctgaaggacctggaggaggagaatgtggtgctgcggtctgaggccagccagctgaagacagagaccatcacctatgaggagaaggagcagcagctggtgaatgactgtgtgaaggagctgagagatgccaacgtgcagatcgccagcatcagcgaggagctggccaagaagacagaagatgctgcccggcagcaggaggagatcacccacctgctgagccagatcgtggacctgcagaagaaggccaaggcctgtgctgtggagaatgaggagctggtgcagcacctgggcgccgccaaggatgcccagaggcagctgacagctgagctgcgggagctggaggacaagtatgcagagtgcatggagatgctgcacgaggcccaggaggagctgaagaacctgaggaacaagaccatgcccaacaccaccagccgccgctaccacagcctgggcctcttccccatggacagcctggccgctgagattgagggcaccatgaggaaggagctgcagctggaggaggccgagagcccagacatcacccaccagaagagggtgtttgaaacagtgaggaacatcaaccaggtggtgaagcagaggagcctgacccccagccccatgaacatccctggcagcaaccagagcagcgccatgaacagcctgctgagcagctgtgtgtccacccccaggagcagcttctacggcagtgacattggaaatgtggtgctggacaacaagaccaacagcatcatcctggagacagaggccgctgacctgggcaatgatgagaggagcaagaagccaggcaccccaggcaccccaggcagccatgacctggagacagccctgcggcggctgagcctgcggcgggagaactacctgtctgaaagacgcttctttgaggaggagcaggagaggaagctgcaggagctggccgagaagggggagctgcggagcggcagcctgacccccacagagagcatcatgagcctgggcacccacagccgcttcagcgagttcaccggcttcagcggcatgtccttcagcagccgcagctacctgcctgagaagctgcagatcgtgaagcccctggagggcagcgccaccctgcaccactggcagcagctggcccagccccacctgggcggcatcctggaccccaggcctggggtggtgaccaagggcttccgcaccctggatgtggacctggatgaggtgtactgcctgaatgactttgaggaggatgacacaggagaccacatcagcctgccccggctggccaccagcacccctgtgcagcaccctgagaccagcgcccaccaccctgggaagtgcatgagccagaccaacagcaccttcaccttcaccacctgccgcatcctgcaccccagtgatgagctgaccagggtgacccccagcctgaacagcgcccccaccccagcctgtggcagcaccagccacctgaagagcacccctgtggccaccccctgcaccccccggcggctgagcctggccgagagcttcaccaacacccgggagagcaccaccaccatgagcaccagcctgggcctggtgtggctgctgaaggagcggggcatctctgctgctgtgtatgacccccagagctgggaccgggccggccggggcagcctgctgcacagctacacccccaagatggccgtcatccccagcaccccacccaacagccccatgcagacccccaccagcagcccccccagctttgagttcaagtgcaccagccccccctatgacaacttcctggccagcaagccagccagcagcatcctgcgggaggtgcgggagaagaatgtgcgcagcagcgagagccagacagatgtgtctgtgagcaacctgaacctggtggacaaggtgcggcgcttcggcgtggccaaggtggtgaacagcggccgggcccacgtgcccaccctgacagaggagcagggccccctgctgtgtggccccccaggccctgccccagccctggtgccccggggcctggtgcctgagggcctgcccctgcgctgccccaccgtgaccagcgccatcggcggcctgcagctgaacagcggcatcagaagaaacagaagcttccccaccatggtgggcagctccatgcagatgaaggcccctgtgaccctgaccagcggcatcctgatgggcgccaagctgagcaagcagaccagcctgaggtag

SEQ ID NO: 173516 - DNA, 2361 bp, Artificial Sequence
  Description of Artificial Sequence: Synthetic coding sequence
atggccctggtgttccagtttggccagcctgtgcgggcccagcccctgcccggcctgtgccacggcaagctgatccgcaccaatgcctgtgatgtgtgcaacagcacagacctgcctgaggtggagatcatcagcctgctggaggagcagctgccccactacaagctgcgggctgacaccatctacggctatgaccatgatgactggctgcacacccccctcatcagcccagatgccaacatcgacctgaccacagagcagatcgaggagaccctgaagtacttcctgctgtgtgccgagcgggtgggccagatgaccaagacctacaatgacattgatgctgtgacccggctgctggaggagaaggagcgggacctggagctggccgcccgcatcggccagagcctgctgaagaagaacaagaccctgacagaaagaaatgagctgctggaggagcaggtggagcacatccgggaggaggtgtcccagctgcggcatgagctgtccatgaaggatgagctgctgcagttctacaccagcgctgctgaggagagcgagcctgagagcgtgtgcagcacccccctgaagagaaatgaaagcagcagctctgtgcagaactacttccacctggacagcctgcagaagaagctgaaggacctggaggaggagaatgtggtgctgcggtctgaggccagccagctgaagacagagaccatcacctatgaggagaaggagcagcagctggtgaatgactgtgtgaaggagctgagagatgccaacgtgcagatcgccagcatcagcgaggagctggccaagaagacagaagatgctgcccggcagcaggaggagatcacccacctgctgagccagatcgtggacctgcagaagaaggccaaggcctgtgctgtggagaatgaggagctggtgcagcacctgggcgccgccaaggatgcccagaggcagctgacagctgagctgcgggagctggaggacaagtatgcagagtgcatggagatgctgcacgaggcccaggaggagctgaagaacctgaggaacaagaccatgcccaacaccaccagccgccgctaccacagcctgggcctcttccccatggacagcctggccgctgagattgagggcaccatgaggaaggagctgcagctggaggaggccgagagcccagacatcacccaccagaagagggtgtttgaaacagtgaggaacatcaaccaggtggtgaagcagaggagcctgacccccagccccatgaacatccctggcagcaaccagagcagcgccatgaacagcctgctgagcagctgtgtgtccacccccaggagcagcttctacggcagtgacattggaaatgtggtgctggacaacaagaccaacagcatcatcctggagacagaggccgctgacctgggcaatgatgagaggagcaagaagccaggcaccccaggcaccccaggcagccatgacctggagacagccctgcggcggctgagcctgcggcgggagaactacctgtctgaaagacgcttctttgaggaggagcaggagaggaagctgcaggagctggccgagaagggggagctgcggagcggcagcctgacccccacagagagcatcatgagcctgggcacccacagccgcttcagcgagttcaccggcttcagcggcatgtccttcagcagccgcagctacctgcctgagaagctgcagatcgtgaagcccctggagggcagcgccaccctgcaccactggcagcagctggcccagccccacctgggcggcatcctggaccccaggcctggggtggtgaccaagggcttccgcaccctggatgtggacctggatgaggtgtactgcctgaatgactttgaggaggatgacacagcccaccaccctgggaagtgcatgagccagaccaacagcaccttcaccttcaccacctgccgcatcctgcaccccagtgatgagctgaccagggtgacccccagcctgaacagcgcccccaccccagcctgtggcagcaccagccacctgaagagcacccctgtggccaccccctgcaccccccggcggctgagcctggccgagagcttcaccaacacccgggagagcaccaccaccatgagcaccagcctgggcctggtgtggctgctgaaggagcggggcatctctgctgctgtgtatgacccccagagctgggacagagctggccggggcagcctgctgcacagccatgaagatgtgacctgtgccaacctgggggagggcggcgtgctgagcagcttcctgctgcggagcacagagacccccaagtgtgtgctgatcccctggattggcaaccagtag

SEQ ID NO: 173517 - DNA, 2745 bp, Artificial Sequence
  Description of Artificial Sequence: Synthetic coding sequence
atgagccagagccagaatgccatcttcaccagccccactggagaggagaacctgatgaacagcaaccaccgggacagcgagagcatcacagatgtgtgcagcaatgaagacctgcctgaggtggagctggtgtccctgctggaggagcagctgccccagtaccgcctgaaggtggacaccctcttcctgtatgagaaccaggactggacccagagcccccaccagaggcagcacgccagtgatgccctgagccctgtgctggccgaggagaccttccgctacatgatcctgggcacagacagagtggagcagatgaccaagacctacaatgacatcgacatggtgacccacctgctggccgagcgggaccgggacctggagctggccgcccgcatcggccaggccctgctgaagagaaatcatgtgctgtctgagcagaatgaaagcctggaggagcagctgggccaggcctttgaccaggtgaaccagctgcagcacgagctgtgcaagaaggatgagctgctgagaattgtgtccatcgccagcgaggagagcgagacagacagcagctgcagcacccccctgcgcttcaatgaaagcttcagcctgagccagggcctgctgcagctggagatgctgcaggagaagctgaaggagctggaggaggagaacatggccctgcggagcaaggcctgccacatcaagacagagaccgtgacctatgaggagaaggagcagcagctggtgtctgactgtgtgaaggagctgcgggagaccaatgcccagatgagcaggatgacagaggagctgagcggcaagagtgatgagctgatccgctaccaggaggagctgagcagcctgctgagccagatcgtggacctgcagcacaagctgaaggagcacgtgattgagaaggaggagctgaagctgcacctgcaggccagcaaggatgcccagaggcagctgaccatggagctgcacgagctgcaggacaggaacatggagtgcctgggcatgctgcacgagagccaggaggagatcaaggagctgcggagccgcagcggccccacagcccacctgtacttcagccagagctatggagccttcaccggggagagcctggccgctgagattgagggcaccatgaggaagaagctgagcctggatgaggagagcagcctcttcaagcagaaggcccagcagaagagggtgtttgacacagtgcgcatcgccaatgacacccggggccgcagcatctccttccctgccctgctgcccatccctggcagcaacagaagcagcgtcatcatgacagccaagccctttgagagcggcctgcagcagacagaggacaagagcctgctgaaccagggcagcagcagcgaggaggtggccggcagcagccagaagatgggccagcccggccccagcggggacagcgacctggccacagccctgcaccggctgagcctgcggcggcagaactacctgtctgagaagcagttctttgctgaggagtggcagaggaagatccaggtgctggccgaccagaaggagggcgtgtctggctgtgtgacccccacagagagcctggccagcctgtgcaccacccagagcgagatcacagacctgagcagcgccagctgcctgcggggcttcatgcctgagaagctgcagatcgtgaagcccctggagggcagccagaccctgtaccactggcagcagctggcccagcccaacctgggcaccatcctggaccccaggcctggggtcatcaccaagggcttcacccagctgcctggagatgccatctaccacatcagtgacctggaggaggatgaggaggagggcatcaccttccaggtgcagcagcccctggaggtggaggagaagctgagcaccagcaagcctgtgacaggcatcttcctgccccccatcaccagcgctgggggccctgtgacagtggccacagccaaccctgggaagtgcctgagctgcaccaacagcaccttcaccttcaccacctgccgcatcctgcaccccagcgacatcacccaggtgacccccagcagcggcttccccagcctgagctgtggcagcagcggcagcagcagcagcaacacagctgtgaacagccctgccctgagctaccgcctgagcattggagagagcatcaccaacagaagagacagcaccaccaccttcagcagcaccatgagcctggccaagctgctgcaggagcggggcatcagcgccaaggtgtaccacagccccatcagcgagaaccccctgcagcccctgcccaagagcctggccatccccagcaccccacccaacagccccagccacagcccctgccccagccccctgccctttgagccccgggtgcacctgtctgagaacttcctggccagcaggcctgctgagaccttcctgcaggagatgtatggcctgcggcccagcaggaaccccccagatgtgggccagctgaagatgaacctggtggaccggctgaagaggctgggcatcgcccgggtggtgaagaaccctggggcccaggagaatggccgctgccaggaggccgagatcggcccccagaagccagacagcgctgtgtacctgaacagcggcagcagcctgctgggcggcctgcggaggaaccagagcctgcctgtgatcatgggcagctttgctgcccctgtgtgcaccagcagccccaagatgggcgtgctgaaggaggactag

SEQ ID NO: 173518 - DNA, 936 bp, Artificial Sequence
  Description of Artificial Sequence: Synthetic coding sequence
atgagccagagccagaatgccatcttcaccagccccactggagaggagaacctgatgaacagcaaccaccgggacagcgagagcatcacagatgtgtgcagcaatgaagacctgcctgaggtggagctggtgtccctgctggaggagcagctgccccagtaccgcctgaaggtggacaccctcttcctgtatgagaaccaggactggacccagagcccccaccagaggcagcacgccagtgatgccctgagccctgtgctggccgaggagaccttccgctacatgatcctgggcacagacagagtggagcagatgaccaagacctacaatgacatcgacatggtgacccacctgctggccgagcgggaccgggacctggagctggccgcccgcatcggccaggccctgctgaagagaaatcatgtgctgtctgagcagaatgaaagcctggaggagcagctgggccaggcctttgaccaggtgaaccagctgcagcacgagctgtgcaagaaggatgagctgctgagaattgtgtccatcgccagcgaggagagcgagacagacagcagctgcagcacccccctgcgcttcaatgaaagcttcagcctgagccagggcctgctgcagctggagatgctgcaggagaagctgaaggagctggaggaggagaacatggccctgcggagcaaggcctgccacatcaagacagagaccgtgacctatgaggagaaggagcagcagctggtgtctgactgtgtgaaggagctgcgggagaccaatgcccagatgagcaggatgacagaggagctgagcggcaagagtgatgagctgatccgctaccaggaggagctgagcagcctgctgagccagatcgtggacctgcagcacaagctgaaggaggtgggcctcttcatccacagcacagacatctgctag

SEQ ID NO: 173519 - DNA, 93 bp, Artificial Sequence
  Description of Artificial Sequence: Synthetic coding sequence
atgagccagagccagaatgccatcttcaccagccccactggagaggagaacctgatgaacagcaaccaccgggacagcgagagcatcacctag

SEQ ID NO: 173520 - DNA, 2340 bp, Artificial Sequence
  Description of Artificial Sequence: Synthetic coding sequence
atgatcctgggcacagacagagtggagcagatgaccaagacctacaatgacatcgacatggtgacccacctgctggccgagcgggaccgggacctggagctggccgcccgcatcggccaggccctgctgaagagaaatcatgtgctgtctgagcagaatgaaagcctggaggagcagctgggccaggcctttgaccaggtgaaccagctgcagcacgagctgtgcaagaaggatgagctgctgagaattgtgtccatcgccagcgaggagagcgagacagacagcagctgcagcacccccctgcgcttcaatgaaagcttcagcctgagccagggcctgctgcagctggagatgctgcaggagaagctgaaggagctggaggaggagaacatggccctgcggagcaaggcctgccacatcaagacagagaccgtgacctatgaggagaaggagcagcagctggtgtctgactgtgtgaaggagctgcgggagaccaatgcccagatgagcaggatgacagaggagctgagcggcaagagtgatgagctgatccgctaccaggaggagctgagcagcctgctgagccagatcgtggacctgcagcacaagctgaaggagcacgtgattgagaaggaggagctgaagctgcacctgcaggccagcaaggatgcccagaggcagctgaccatggagctgcacgagctgcaggacaggaacatggagtgcctgggcatgctgcacgagagccaggaggagatcaaggagctgcggagccgcagcggccccacagcccacctgtacttcagccagagctatggagccttcaccggggagagcctggccgctgagattgagggcaccatgaggaagaagctgagcctggatgaggagagcagcctcttcaagcagaaggcccagcagaagagggtgtttgacacagtgcgcatcgccaatgacacccggggccgcagcatctccttccctgccctgctgcccatccctggcagcaacagaagcagcgtcatcatgacagccaagccctttgagagcggcctgcagcagacagaggacaagagcctgctgaaccagggcagcagcagcgaggaggtggccggcagcagccagaagatgggccagcccggccccagcggggacagcgacctggccacagccctgcaccggctgagcctgcggcggcagaactacctgtctgagaagcagttctttgctgaggagtggcagaggaagatccaggtgctggccgaccagaaggagggcgtgtctggctgtgtgacccccacagagagcctggccagcctgtgcaccacccagagcgagatcacagacctgagcagcgccagctgcctgcggggcttcatgcctgagaagctgcagatcgtgaagcccctggagggcagccagaccctgtaccactggcagcagctggcccagcccaacctgggcaccatcctggaccccaggcctggggtcatcaccaagggcttcacccagctgcctggagatgccatctaccacatcagtgacctggaggaggatgaggaggagggcatcaccttccaggtgcagcagcccctggaggtggaggagaagctgagcaccagcaagcctgtgacaggcatcttcctgccccccatcaccagcgctgggggccctgtgacagtggccacagccaaccctgggaagtgcctgagctgcaccaacagcaccttcaccttcaccacctgccgcatcctgcaccccagcgacatcacccaggtgacccccagcagcggcttccccagcctgagctgtggcagcagcggcagcagcagcagcaacacagctgtgaacagccctgccctgagctaccgcctgagcattggagagagcatcaccaacagaagagacagcaccaccaccttcagcagcaccatgagcctggccaagctgctgcaggagcggggcatcagcgccaaggtgtaccacagccccatcagcgagaaccccctgcagcccctgcccaagagcctggccatccccagcaccccacccaacagccccagccacagcccctgccccagccccctgccctttgagccccgggtgcacctgtctgagaacttcctggccagcaggcctgctgagaccttcctgcaggagatgtatggcctgcggcccagcaggaaccccccagatgtgggccagctgaagatgaacctggtggaccggctgaagaggctgggcatcgcccgggtggtgaagaaccctgtgcccaagaggatggaggatgcccggcggcagaagctggtgctgaagaaccagatcctgctcttcatctag

SEQ ID NO: 173521 - DNA, 486 bp, Artificial Sequence
  Description of Artificial Sequence: Synthetic coding sequence
atggagaagcccctgactgtgctgcgggtgtccctgtaccaccccaccctgggccccagcgcctttgccaacgtgcccccccggctgcagcacgacaccagccccctgctgctgggccggggccaggatgcccacctgcagctgcagctgccccggctgagcagaagacacctgagcctggagccctacctggagaagggcagcgccctgctggccttctgcctgaaggccctgagcaggaagggctgtgtgtgggtgaatggcctgaccctgcgctacctggagcaggtgcccctgagcacagtgaacagagtgtccttcagcggcatccagatgctggtgcgggtggaggagggcaccagcctggaggcctttgtgtgctacttccacgtgagccccagccccctcatctacagacctgaggccgaggagacagatgagtgggagggcatcagccagggccagcccccacctggcagcggctag

SEQ ID NO: 173522 - DNA, 1749 bp, Artificial Sequence
  Description of Artificial Sequence: Synthetic coding sequence
atggccgagttcctggatgaccaggagacccggctgtgtgacaactgcaagaaggagatccctgtgttcaacttcaccatccacgagatccactgccagaggaacatcggcatgtgccccacctgcaaggagcccttccccaagagtgacatggagacccacatggctgctgagcactgccaggtgacctgcaagtgcaacaagaagctggagaagaggctgctgaagaagcatgaggagacagagtgccccctgcggctggccgtgtgccagcactgtgacctggagctgagcatcctgaagctgaaggagcacgaggactactgtggggccaggacagagctgtgtggcaactgtggcagaaatgtgctggtgaaggacctgaagacccaccctgaggtgtgtggccgggagggggaggagaagagaaatgaggtggccatccccccaaatgcctatgatgagagctggggccaggacggcatctggatcgccagccagctgctgcggcagatcgaggccctggacccccccatgaggctgccccggcggcccctgcgggcctttgaaagtgatgtgttccacaacagaaccaccaaccagaggaacatcacagcccaggtgtccatccagaacaacctgtttgaggagcaggagcggcaggagaggaacagaggccagcagccccccaaggagggcggggaggagagcgccaacctggacttcatgctggccctgagcctgcagaatgaaggccaggccagctctgtggccgagcaggacttctggagggctgtgtgtgaggccgaccagagccatggaggccccaggagcctgagtgacatcaagggagctgctgatgagatcatgctgccctgtgagttctgtgaggagctgtacccagaggagctgctgattgaccaccagaccagctgcaaccccagccgggccctgcccagcctgaacacaggcagcagcagcccccggggcgtggaggagccagatgtgatcttccagaacttcctgcagcaggccgccagcaaccagctggacagcctgatgggcctgagcaacagccaccctgtggaggagagcatcatcatcccctgtgagttctgtggggtgcagctggaggaggaggtgctcttccaccaccaggaccagtgtgaccagaggcctgccacagccaccaaccacgtgacagagggcatcccccggctggacagccagccccaggagaccagccctgagctgcccaggagaagagtgcgccaccagggcgacctgagcagcggctacctggatgacaccaagcaggagacagccaacggccccaccagctgcctgccccccagccggcccatcaacaacatgacagccacctacaaccagctgagccgcagcaccagcggcccccggcccggctgccagcccagcagcccctgtgtgcccaagctgagcaacagcgacagccaggacatccagggcaggaacagagacagccagaatggagccatcgcccctggccacgtgtctgtcatccggcccccccagaacctgtacccagaaaatattgtgcccagcttcagccctggccccagcggccgctatggagccagcggccgctctgagggcggcaggaacagccgggtgaccccagctgctgccaactaccgcagcaggacagccaaggccaagcccagcaagcagcagggcgctggagatgctgaggaggaggaggaggagtag

SEQ ID NO: 173523 - DNA, 1749 bp, Artificial Sequence; identical to SEQ ID NO: 173522
  Description of Artificial Sequence: Synthetic coding sequence

SEQ ID NO: 173524 - DNA, 408 bp, Artificial Sequence
  Description of Artificial Sequence: Synthetic coding sequence
atggccgagttcctggatgaccaggagacccggctgtgtgacaactgcaagaaggagatccctgtgttcaacttcaccatccacgagatccactgccagaggaacatcggcatgtgccccacctgcaaggagcccttccccaagagtgacatggagacccacatggctgctgagcactgccaggtgacctgcaagtgcaacaagaagctggagaagaggctgctgaagaagcatgaggagacagagtgccccctgcggctggccgtgtgccagcactgtgacctggagctgagcatcctgaagctgaaggagcacgaggactactgtggggccaggacagagctgtgtggcaactgtggcagaaatgtgctggtgaaggacctgaagacccaccctgaggtgtgctag

SEQ ID NO: 173525 - DNA, 495 bp, Artificial Sequence
  Description of Artificial Sequence: Synthetic coding sequence
atggccgagttcctggatgaccaggagacccggctgtgtgacaactgcaagaaggagatccctgtgttcaacttcaccatccacgagatccactgccagaggaacatcggcatgtgccccacctgcaaggagcccttccccaagagtgacatggagacccacatggctgctgagcactgccaggtgacctgcaagtgcaacaagaagctggagaagaggctgctgaagaagcatgaggagacagagtgccccctgcggctggccgtgtgccagcactgtgacctggagctgagcatcctgaagctgaaggagcacgaggactactgtggggccaggacagagctgtgtggcaactgtggcagaaatgtgctggtgaaggacctgaagacccaccctgagctgaagaacaagaggggcaggaaaggaattgaggccaacagcccccccaagagggtggtgaagagggtgcagacctggaccagctgctggccctag

SEQ ID NO: 173526 - DNA, 852 bp, Artificial Sequence
  Description of Artificial Sequence: Synthetic coding sequence
atggccgagttcctggatgaccaggagacccggctgtgtgacaactgcaagaaggagatccctgtgttcaacttcaccatccacgagatccactgccagaggaacatcggcatgtgccccacctgcaaggagcccttccccaagagtgacatggagacccacatggctgctgagcactgccaggtgacctgcaagtgcaacaagaagctggagaagaggctgctgaagaagcatgaggagacagagtgccccctgcggctggccgtgtgccagcactgtgacctggagctgagcatcctgaagctgaaggagcacgaggactactgtggggccaggacagagctgtgtggcaactgtggcagaaatgtgctggtgaaggacctgaagacccaccctgaggtgtgtggccgggagggggaggagaagagaaatgaggtggccatccccccaaatgcctatgatgagagctggggccaggacggcatctggatcgccagccagctgctgcggcagatcgaggccctggacccccccatgaggctgccccggcggcccctgcgggcctttgaaagtgatgtgttccacaacagaaccaccaaccagaggaacatcacagcccaggtgtccatccagaacaacctgtttgaggagcaggagcggcaggagaggaacagaggccagcagccccccaaggagggcggggaggagagcgccaacctggacttcatgctggccctgagcctgcagaatgaaggccaggccagctctgtggccgagcaggacttctggagggctgtgtgtgaggccgaccagagccatggaggccccaggagcctgagtgacatcaagtag

SEQ ID NO: 173527 - DNA, 414 bp, Artificial Sequence
  Description of Artificial Sequence: Synthetic coding sequence
atgggcgcccacctggtgcggcgctacctgggagatgcctctgtggagccagaccccctgcagatgcccaccttccccccagactatggcttccctgagaggaaggagcgggagatggtggccacccagcaggagatgatggatgcccagctgcggctgcagctgcgggactactgtgcccaccacctgatccggctgctgaagtgcaagagggacagcttccccaacttcctggcctgcaagcaggagagacatgactgggactactgtgagcaccgggactatgtgatgaggatgaaggagtttgagcgggagcggcggctgctgcagaggaagaagaggcgggagaagaaggctgctgagctggccaagggccagggccctggagaggtggaccccaaggtggccctgtag

SEQ ID NO: 173528 - DNA, 972 bp, Artificial Sequence
  Description of Artificial Sequence: Synthetic coding sequence
atgatcctgcaggagaccaaggccgcctgtggcatcccagccatcccccactgcagccgggtggagatcctggatgccaagacccgggagaagctgtgcttcctggacaaggtggagccccacgccaccatcgccgagatcaagaacctcttcaccaagacccacccccagtggtacccagcccggcagagcctgcggctggaccccaagggcaagagcctgaaggatgaagatgtgctgcagaagctgcctgtgggcaccacagccaccctgtacttccgggacctgggcgcccagatctcctgggtgaccgtcttcctgacagaatatgccggccccctcttcatctacctgctcttctacttccgggtgcccttcatctacggccacaagtatgacttcaccagcagccgccacacagtggtgcacctggcctgcatctgccacagcttccactacatcaagaggctgctggagaccctgtttgtgcaccgcttcagccacggcaccatgcccctgaggaacatcttcaagaactgcacctactactggggctttgctgcctggatggcctactacatcaaccaccccctgtacaccccacccacctacggggcccagcaggtgaagctggccctggccatcttcgtcatctgccagctgggcaacttcagcatccacatggccctgcgggacctgcggcctgctggcagcaagaccaggaagatcccctaccccaccaagaaccccttcacctggctgttcctgctggtgtcctgccccaactacacctatgaggtgggctcctggattggatttgccatcatgacccagtgcctgcctgtggccctcttcagcctggtgggcttcacccagatgaccatctgggccaagggcaagcacaggagctacctgaaggagttccgggactacccacccctgaggatgcccatcatccccttcctgctgtag

SEQ ID NO: 173529 - DNA, 1014 bp, Artificial Sequence
  Description of Artificial Sequence: Synthetic coding sequence
atgagcagcagccctgtgaagaggcagaggatggagagcgccctggaccagctgaagcagttcaccaccgtggtggccgacaccggggacttccacgccattgatgagtacaagccccaggatgccaccaccaaccccagcctcatcctggccgccgcccagatgcctgcctaccaggagctggtggaggaggccatcgcctacggcaggaagctgggcggcagccaggaggaccagatcaagaatgccatcgacaagctgtttgtgctgtttggagctgagatcctgaagaagatccctggccgggtgtccacagaggtggatgcccggctgagctttgacaaggatgccatggtggcccgggcccggcggctcatcgagctgtacaaggaggccggcatcagcaaggaccgcatcctgatcaagctgagcagcacctgggagggcatccaggccggcaaggagctggaggagcagcacggcatccactgcaacatgaccctgctcttctcctttgcccaggccgtggcctgtgccgaggccggcgtgaccctcatcagcccctttgtgggccgcatcctggactggcacgtggccaacacagacaagaagagctatgagcccctggaggaccccggggtgaagtctgtgaccaagatctacaactactacaagaagttctcctacaagaccatcgtgatgggcgccagcttcagaaatactggagagatcaaggccctggccggctgtgacttcctgaccatcagccccaagctgctgggggagctgctgcaggacaatgccaagctggtgcctgtgctgagcgccaaggccgcccaggccagtgacctggagaagatccacctggatgagaagagcttccgctggctgcacaatgaagaccagatggctgtggagaagctgagtgatggcatcaggaagtttgctgctgatgctgtgaagctggagaggatgctgacagagaggatgtttaatgcagaaaatggcaagtag

SEQ ID NO: 173530 - DNA, 957 bp, Artificial Sequence
  Description of Artificial Sequence: Synthetic coding sequence
atgagcagcagccctgtgaagaggcagaggatggagagcgccctggaccagctgaagcagttcaccaccgtggtggccgacaccggggacttccacgccattgatgagtacaagccccaggatgccaccaccaaccccagcctcatcctggccgccgcccagatgcctgcctaccaggagctggtggaggaggccatcgcctacggcaggaagctgggcggcagccaggaggaccagatcaagaatgccatcgacaagctgtttgtgctgtttggagctgagatcctgaagaagatccctggccgggtgtccacagaggtggatgcccggctgagctttgacaaggatgccatggtggcccgggcccggcggctcatcgagctgtacaaggaggccggcatcagcaaggaccgcatcctgatcaagctgagcagcacctgggagggcatccaggccggcaaggagctggaggagcagcacggcatccactgcaacatgaccctgctcttctcctttgcccaggccgtggcctgtgccgaggccggcgtgaccctcatcagcccctttgtgggccgcatcctggactggcacgtggccaacacagacaagaagagctatgagcccctggaggaccccggggtgaagtctgtgaccaagatctacaactactacaagaagttctcctacaagaccatcgtgatgggcgccagcttcagaaatactggagagatcaaggccctggccggctgtgacttcctgaccatcagccccaagctgctgggggagctgctgcaggacaatgccaagctggtgcctgtgctgagcgccaagcccaagcctgtgacctggaagaagagcacctggatgaggagcctgtctgtgggctgcaccaccaggacccgctggctgtggaggagcagcctgactggaagtgccagcctgcccctgatgcagtag

SEQ ID NO: 173531 - DNA, 1302 bp, Artificial Sequence
  Description of Artificial Sequence: Synthetic coding sequence
atgaggcagagccaccagctgcccctggtgggcctgctgctcttctccttcatccccagccagctgtgtgagatctgtgaggtgtctgaggagaactacatccggctgaagcccctgctgaacaccatgatccagagcaactacaacagaggcaccagcgctgtgaatgtggtgctgagcctgaagctggtgggcatccagatccagaccctgatgcagaagatgatccagcagatcaagtacaacgtgaagagccggctgagtgatgtgagcagcggggagctggccctgatcatcctggccctgggcgtgtgcagaaatgctgaggagaacctgatctatgactaccacctgattgacaagctggagaacaagttccaggccgagattgagaacatggaggcccacaacggcacccccctgaccaactactaccagctgagcctggatgtgctggccctgtgcctcttcaacggcaactacagcacagctgaggtggtgaaccacttcaccccagagaacaagaactactacttcggcagccagttctctgtggacacaggagccatggctgtgctggccctgacctgtgtgaagaagagcctcatcaatggccagatcaaggcagatgagggcagcctgaagaacatcagcatctacaccaagagcctggtggagaagatcctgtctgagaagaaggaaaatggcctcatcggcaacaccttcagcactggagaggccatgcaggccctgtttgtgtccagtgactactacaatgaaaatgactggaactgccagcagaccctgaacacagtgctgacagagatcagccagggcgccttcagcaaccccaatgctgctgcccaggtgctgcctgccctgatgggcaagaccttcctggacatcaacaaggacagcagctgtgtgtctgccagcggcaacttcaacatctctgcagatgagcccatcaccgtgaccccaccagacagccagagctacatctctgtgaactacagcgtgcgcatcaatgagacctacttcaccaacgtgacagtgctgaatggcagcgtcttcctgtctgtgatggagaaggcccagaagatgaatgacaccatcttcggcttcaccatggaggagaggtcctggggcccctacatcacctgcatccagggcctgtgtgccaacaacaatgacaggacctactgggagctgctgagcggcggggagcccctgagccagggcgccggcagctatgtggtgagaaatggagagaacctggaggtgcgctggagcaagtactag

SEQ ID NO: 173532 - DNA, 1083 bp, Artificial Sequence
  Description of Artificial Sequence: Synthetic coding sequence
atggctgctgctgctgctgctggagctggccctgagatggtgcggggccaggtgtttgatgtgggcccccgctacaccaacctgagctacatcggggagggcgcctacggcatggtgtgcagcgcctatgacaacgtgaacaaggtgcgggtggccatcaagaagatcagcccctttgagcaccagacctactgccagaggaccctgcgggagatcaagatcctgctgcgcttcagacatgagaacatcatcggcatcaatgacatcatccgggcccccaccatcgagcagatgaaggatgtgtacatcgtgcaggacctgatggagacagacctgtacaagctgctgaagacccagcacctgagcaatgaccacatctgctacttcctgtaccagatcctgcggggcctgaagtacatccacagcgccaacgtgctgcaccgggacctgaagcccagcaacctgctgctgaacaccacctgtgacctgaagatctgtgactttggcctggcccgggtggccgaccctgaccatgaccacacaggcttcctgacagaatatgtggccacccgctggtaccgggcccctgagatcatgctgaacagcaagggctacaccaagagcattgacatctggagcgtgggctgcatcctggccgagatgctgagcaaccggcccatcttccctgggaagcactacctggaccagctgaaccacatcctgggcatcctgggcagccccagccaggaggacctgaactgcatcatcaacctgaaggccaggaactacctgctgagcctgccccacaagaacaaggtgccctggaacagactcttccccaatgctgacagcaaggccctggacctgctggacaagatgctgaccttcaacccccacaagagaattgaggtggagcaggccctggcccacccctacctggagcagtactatgaccccagtgatgagcccatcgccgaggcccccttcaagtttgacatggagctggatgacctgcccaaggagaagctgaaggagctgatctttgaggagacagcccgcttccagcccggctaccgctcctag

SEQ ID NO: 173533 - DNA, 1203 bp, Artificial Sequence
  Description of Artificial Sequence: Synthetic coding sequence
atgaggcacctgggcgccttcctgttcctgctgggcgtgctgggcgccctgacagagatgtgtgagatccctgagatggacagccacctggtggagaagctgggccagcacctgctgccctggatggaccggctgagcctggagcacctgaaccccagcatctacgtgggcctgcggctgagcagcctgcaggccggcaccaaggaggacctgtacctgcacagcctgaagctgggctaccagcagtgcctgctgggcagcgccttctctgaagatgatggagactgccagggcaagcccagcatgggccagctggccctgtacctgctggccctgcgggccaactggcatgaccacaagggccacccccacaccagctactaccagtatggcctgggcatcctggccctgtgcctgcaccagaagagggtgcatgattctgtggtggacaagctgctgtatgctgtggagcccttccaccagggccaccacagcgtggacacagctgccatggccggcctggccttcacctgcctgaagaggagcaacttcaaccctggccggcggcagaggatcaccatggccatcagaacagtgcgggaggagatcctgaaggcccagaccccagagggccactttggaaatgtgtacagcacccccctggccctgcagttcctgatgaccagccccatgagaggagctgagctgggcacagcctgcctgaaggcccgggtggccctgctggccagcctgcaggatggagccttccagaatgccctgatgatcagccagctgctgcctgtgctgaaccacaagacctacatcgacctgatcttcccagactgcctggccccccgggtgatgctggagcctgctgctgagaccatcccccagacccaggagatcatctctgtgaccctgcaggtgctgagcctgctgcccccctaccggcagagcatctctgtgctggccggcagcacagtggaggatgtgctgaagaaggcccacgagctgggcggcttcacctatgagacccaggccagcctgagcggcccctacctgacctctgtgatgggcaaggccgccggggagcgggagttctggcagctgctgcgggaccccaacacccccctgctgcagggcattgctgactaccggcccaaggatggagagaccatcgagctgcggctggtgtcctggtag

SEQ ID NO: 173534 - DNA, 843 bp, Artificial Sequence
  Description of Artificial Sequence: Synthetic coding sequence
atggaggatgaggtggtgcgctttgccaagaagatggacaagatggtgcagaagaagaatgccagcaccagaattggcatgtctgtgaatgccatcaggaagcagagcacagatgaggaggtgaccagcctggccaagagcctcatcaagtcctggaagaagctgctggatggccccagcacagagaaggacctggatgagaagaagaaggagcccgccatcaccagccagaacagccctgaggcccgggaggagagcaccagcagtggaaatgtgagcaacaggaaggatgagaccaatgcccgggacacctacgtgagcagcttcccccgggcccccagcaccagtgacagcgtgcggctgaagtgccgggagatgctggccgccgccctgaggactggagatgactacatcgccatcggggctgatgaggaggagctgggcagccagatcgaggaggccatctaccaggagatccggaacacagacatgaagtacaagaacagagtgcgcagccgcatcagcaacctgaaggatgccaagaaccccaacctgaggaagaatgtgctgtgtggcaacatccccccagacctgtttgccaggatgacagctgaggagatggccagtgatgagctgaaggagatgaggaagaacctgaccaaggaggccatccgggagcaccagatggccaagacaggaggcacccagacagacctcttcacctgtgggaagtgcaagaagaagaactgcacctacacccaggtgcagaccaggtctgcagatgagcccatgaccacctttgtggtgtgcaatgaatgtggcaaccgctggaagttctgctag

SEQ ID NO: 173535 - DNA, 906 bp, Artificial Sequence
  Description of Artificial Sequence: Synthetic coding sequence
atggaggatgaggtggtgcgctttgccaagaagatggacaagatggtgcagaagaagaatgctgctggggccctggacctgctgaaggagctgaagaacatccccatgaccctggagctgctgcagagcacccgcatcggcatgtctgtgaatgccatcaggaagcagagcacagatgaggaggtgaccagcctggccaagagcctcatcaagtcctggaagaagctgctggatggccccagcacagagaaggacctggatgagaagaagaaggagcccgccatcaccagccagaacagccctgaggcccgggaggagagcaccagcagtggaaatgtgagcaacaggaaggatgagaccaatgcccgggacacctacgtgtcctccttcccccgggcccccagcaccagtgacagcgtgcggctgaagtgccgggagatgctggccgccgccctgaggactggagatgactacatcgccatcggggctgatgaggaggagctgggcagccagatcgaggaggccatctaccaggagatccggaacacagacatgaagtacaagaacagagtgcgcagccgcatcagcaacctgaaggatgccaagaaccccaacctgaggaagaatgtgctgtgtggcaacatccccccagacctgtttgccaggatgacagctgaggagatggccagtgatgagctgaaggagatgaggaagaacctgaccaaggaggccatccgggagcaccagatggccaagacaggaggcacccagacagacctcttcacctgtgggaagtgcaagaagaagaactgcacctacacccaggtgcagaccaggtctgcagatgagcccatgaccacctttgtggtgtgcaatgaatgtggcaaccgctggaagttctgctag

SEQ ID NO: 173536 - DNA, 354 bp, Artificial Sequence
  Description of Artificial Sequence: Synthetic coding sequence
atggaggatgaggtggtgcgctttgccaagaagatggacaagatggtgcagaagaagaatgctgctggggccctggacctgctgaaggagctgaagaacatccccatgaccctggagctgctgcaggagatggccagtgatgagctgaaggagatgaggaagaacctgaccaaggaggccatccgggagcaccagatggccaagacaggaggcacccagacagacctcttcacctgtgggaagtgcaagaagaagaactgcacctacacccaggtgcagaccaggtctgcagatgagcccatgaccacctttgtggtgtgcaatgaatgtggcaaccgctggaagttctgctag

SEQ ID NO: 173537 - DNA, 480 bp, Artificial Sequence
  Description of Artificial Sequence: Synthetic coding sequence
atggacaagcccaggaaagaaaatgaggaggagccccagagcgcccccaagacagatgaggagaggcctcctgtggagcacagccctgagaagcagagccctgaggagcagagcagcgaggagcagagcagcgaggaggagttcttccctgaggagctgctgcctgagctgctgcctgagatgctgctgtctgaggagcggcccccccaggagggcctgagcaggaaggacctgtttgagggccggccccccatggagcagcccccctgtggggtgggcaagcacaagctggaggagggcagcttcaaggagcggctggcccggagccggccccagttccggggggacatccacggcaggaacctgagcaatgaggagatgatccaggccgcagatgagctggaggagatgaagagggtgaggaacaagctgatgatcatgcactggaaggccaagaggagccggccctaccccatctag

SEQ ID NO: 173538 - DNA, 480 bp, Artificial Sequence; identical to SEQ ID NO: 173537
  Description of Artificial Sequence: Synthetic coding sequence

SEQ ID NO: 173539 - DNA, 480 bp, Artificial Sequence; identical to SEQ ID NO: 173537
  Description of Artificial Sequence: Synthetic coding sequence

SEQ ID NO: 173540 - DNA, 471 bp, Artificial Sequence
  Description of Artificial Sequence: Synthetic coding sequence
atggacaagcccaggaaagaaaatgaggaggagccccagaggccccggcccatgagaagaggcctgcgctggagcaccctgcccaagagcagcccccccaggagcagcctgcggcgcagcagcccccggcggcgcagcagcttcctgcggagcagctgcctgagcagctgcctgcgctgcagcagcagaagaagcccccaggagggcctgagcaggaaggacctgtttgagggccggccccccatggagcagcccccctgtggggtgggcaagcacaagctggaggagggcagcttcaaggagcggctggcccggagccggccccagttccggggggacatccatggaagaaacctgagcaatgaggagatgatccaggccgcagatgagctggaggagatgaagagggtgaggaacaagctgatgatcatgcactggaaggccaagaggagccggccctaccccatctag

SEQ ID NO: 173541 - DNA, 303 bp, Artificial Sequence
  Description of Artificial Sequence: Synthetic coding sequence
atgcagaagccctgcaaggaaaatgaaggcaagcccaagtgcagcgtgcccaagcgggaggagaagaggccctatggagaatttgagcggcagcagacagagggcaacttccggcagaggctgctgcagagcctggaggagttcaaggaggacatcgactaccgccacttcaaggatgaggagatgacccgggagggagatgagatggagcgctgcctggaggagatccggggcctgaggaagaagttccgggccctgcacagcaaccaccgccacagccgggaccggccctaccccatctag

SEQ ID NO: 173542 - DNA, 303 bp, Artificial Sequence; identical to SEQ ID NO: 173541
  Description of Artificial Sequence: Synthetic coding sequence

SEQ ID NO: 173543 - DNA, 291 bp, Artificial Sequence
  Description of Artificial Sequence: Synthetic coding sequence
atgtatgtgaagctgatcagcagtgatggccacgagttcatcgtgaagcgggagcacgccctgaccagcggcaccatcaaggccatgctgagcggccctggccagtttgctgaaaatgagaccaatgaggtgaacttccgggagatccccagccacgtgctgagcaaggtgtgcatgtacttcacctacaaggtgcgctacaccaacagcagcacagagatccctgagttccccatcgcccctgagatcgccctggagctgctgatggccgccaacttcctggactgctag

SEQ ID NO: 173544 - DNA, 339 bp, Artificial Sequence
  Description of Artificial Sequence: Synthetic coding sequence
atggatggagaggagaagacctacggcggctgtgagggcccagatgccatgtatgtgaagctgatcagcagtgatggccacgagttcatcgtgaagcgggagcacgccctgaccagcggcaccatcaaggccatgctgagcggccctggccagtttgctgaaaatgagaccaatgaggtgaacttccgggagatccccagccacgtgctgagcaaggtgtgcatgtacttcacctacaaggtgcgctacaccaacagcagcacagagatccctgagttccccatcgcccctgagatcgccctggagctgctgatggccgccaacttcctggactgctag

SEQ ID NO: 173545 - DNA, 339 bp, Artificial Sequence; identical to SEQ ID NO: 173544
  Description of Artificial Sequence: Synthetic coding sequence

SEQ ID NO: 173546 - DNA, 339 bp, Artificial Sequence; identical to SEQ ID NO: 173544
  Description of Artificial Sequence: Synthetic coding sequence

SEQ ID NO: 173547 - DNA, 339 bp, Artificial Sequence; identical to SEQ ID NO: 173544
  Description of Artificial Sequence: Synthetic coding sequence

SEQ ID NO: 173548 - DNA, 339 bp, Artificial Sequence; identical to SEQ ID NO: 173544
  Description of Artificial Sequence: Synthetic coding sequence

SEQ ID NO: 173549 - DNA, 339 bp, Artificial Sequence; identical to SEQ ID NO: 173544
  Description of Artificial Sequence: Synthetic coding sequence

SEQ ID NO: 173550 - DNA, 2397 bp, Artificial Sequence
  Description of Artificial Sequence: Synthetic coding sequence
atgcacggcggccgcagctgtggccccaggacccggcgggagcccagcagtggagaggaggccgcccctgtgacagccatggctgctgagagcgccctgcaggtggtggagaagctgcaggcccggctggccgccaacccagaccccaagaagctgctgaagtacctgaagaagctgagcaccctgcccatcaccgtggacatcctggccgagaccggggtgggcaagacagtgaacagcctgaggaagcatgagcacgtgggcagctttgcccgggacctggtggcccagtggaagaagctggtgcctgtggagagaaatgctgagccagatgagcaggactttgagaagagcaacagcaggaagaggcccagagatgccctgcagaaggaggaggagatggagggggactaccaggagacctggaaggccaccggcagccgcagctacagcccagaccaccggcagaagaagcacaggaagctgtctgagctggagcggccccacaaggtgagccacggccatgaaagaagagatgagaggaagcgctgccacaggatgagccccacctacagcagtgaccctgagagcagtgactatggccacgtgcagagcccccccagctgcaccagcccccaccagatgtatgtggaccactaccgcagcctggaggaggaccaggagcccatcgtgagccaccagaagccaggcaagggccacagcaatgccttccaggaccggctgggcgccagccaggagcggcacctgggggagccccacggcaagggcgtggtgtcccagaacaaggagcacaagagcagccacaaggacaagaggcctgtggatgccaagagtgatgagaaggcctctgtggtgtcccgggagaagagccacaaggccctgagcaaggaggagaacagaagacctccttctggggacaatgcccgggagaagccacccagcagcggcgtgaagaaggagaaggaccgggagggcagcagcctgaagaagaagtgcctgcccccatctgaggccgccagtgacaaccacctgaagaagcccaagcaccgggaccctgagaaggccaagctggacaagagcaagcagggcctggacagctttgacaccgggaagggggccggggacctgctgcccaaggtgaaggagaagggcagcaacaacctgaagaccccagagggcaaggtgaagaccaacctggacaggaagagcctgggcagcctgcccaaggtggaggagacagacatggaggatgaatttgagcagcccaccatgagctttgagagctacctgtcctatgaccagcccaggaagaagaagaagaagatcgtgaagaccagcgccacagccctgggggacaagggcctgaagaagaatgacagcaagagcacaggcaagaacctggacagcgtgcagaagctgcccaaggtgaacaagaccaagtctgagaagccagctggagctgacctggccaagctgaggaaggtgcctgatgtgctgcctgtgctgcctgacctgcccctgcctgccatccaggccaactaccggcccctgcccagcctggagctgatcagcagcttccagcccaagaggaaggccttcagcagcccccaggaggaggaggaggccggcttcaccggccgcaggatgaacagcaagatgcaggtgtacagcggcagcaaatgtgcctacctgcccaagatgatgaccctgcaccagcagtgcatccgggtgctgaagaacaacatcgacagcatctttgaggtgggcggcgtgccctacagcgtgctggagcctgtgctggagcgctgcaccccagaccagctgtaccgcatcgaggagtacaaccacgtgctgattgaggagacagaccagctgtggaaggtgcactgccaccgggacttcaaggaggagaggcctgaggagtatgaatcctggagggagatgtacctgcggctgcaggatgcccgggagcagaggctgcgggtgctgaccaagaacatccagtttgcccacgccaacaagcccaagggccggcaggccaagatggcctttgtgaacagcgtggccaagcccccaagagatgtgagaagacggcaggagaagtttggaactggaggagctgctgtgcctgagaagatcaagatcaagccagccccctaccccatgggcagcagccacgccagcgccagcagcatctccttcaaccccagccctgaggagcccgcctatgatggccccagcaccagcagcgcccacctggcccctgtggtgagcagcacagtgtcctatgaccccaggaagcccaccgtgaagaagatcgcccccatgatggccaagaccatcaaggccttcaagaaccgcttcagcagaagatag

SEQ ID NO: 173551 - DNA, 3297 bp, Artificial Sequence
  Description of Artificial Sequence: Synthetic coding sequence
atggccgagagaggaggagatggaggagagagcgagcgcttcaaccctggagagctgaggatggcccagcagcaggccctgcgcttccggggccctgcccctcctccaaatgctgtgatgaggggccccccacccctgatgaggcctcctcctccatttggcatgatgaggggccccccacctccaccccggcccccatttggccggcccccatttgaccccaacatgccacccatgcctcctcctgggggcatccccccacccatgggccccccccacctgcagaggcctcccttcatgcccccacccatgagctccatgcctcctcctcctggcatgatgttccccccaggcatgcctcctgtgacagcccctggcaccccagccctgcccccaacagaggagatctgggtggagaacaagaccccagatggcaaggtgtactactacaatgcccggacccgggagagcgcctggaccaagccagatggagtgaaggtgatccagcagagcgagctgacccccatgctggccgcccaggcccaggtgcaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggtgcaggcccaggtgcaggcccaggtgcaggcccaggccgtgggcgccagcacccccaccaccagcagccctgccccagctgtgtccaccagcaccagcagcagcacccccagcagcaccaccagcaccaccaccacagccacctctgtggcccagacagtgtccacccccaccacccaggaccagacccccagcagcgctgtgtctgtggccacccccaccgtgtctgtgtccaccccagcccccacagccacccctgtgcagacagtgccccagccccacccccagaccctgcccccagctgtgccccacagcgtgccccagcccaccacagccatcccagccttcccccctgtgatggtgccccccttccgggtgcccctgcccggcatgcccatccccctgcccggggtggccatgatgcagatcgtgtcctgcccctacgtgaagacagtggccaccaccaagacaggagtgctgcccggcatggccccacccatcgtgcccatgatccacccccaggtggccatcgccgccagccctgccaccctggccggggccacagctgtgtctgagtggacagagtacaagacagcagatggcaagacctactactacaacaacagaaccctggagagcacctgggagaagccccaggagctgaaggagaaggagaagctggaggagaagatcaaggagcccatcaaggagcccagcgaggagcccctgcccatggagacagaggaggaggaccccaaggaggagcccatcaaggagatcaaggaggagcccaaggaggaggagatgacagaggaggagaaggccgcccagaaggccaagcctgtggccacagcccccatccctggcaccccctggtgtgtggtgtggacaggagatgagagggtcttcttctacaaccccaccacccggctgtccatgtgggacagaccagatgacctgattggccgggcagatgtggacaagatcatccaggagcccccccacaagaagggcatggaggagctgaagaagctgcggcaccccacccccaccatgctgagcatccagaagtggcagttctccatgtctgccatcaaggaggagcaggagctgatggaggagatcaatgaagatgagcctgtgaaggccaagaagaggaagagagatgacaacaaggacatcgacagcgagaaggaggccgccatggaggccgagatcaaggccgcccgggagcgggccatcgtgcccctggaggccaggatgaagcagttcaaggacatgctgctggagcggggcgtgtctgccttcagcacctgggagaaggagctgcacaagatcgtgtttgacccccgctacctgctgctgaaccccaaggagaggaagcaggtgtttgaccagtatgtgaagaccagggctgaggaggagcggcgggagaagaagaacaagatcatgcaggccaaggaggacttcaagaagatgatggaggaggccaagttcaacccccgggccaccttcagcgagtttgctgccaagcacgccaaggacagccgcttcaaggccatcgagaagatgaaggaccgggaggccctcttcaatgaatttgtggccgccgccaggaagaaggagaaggaggacagcaagaccagaggagagaagatcaagagtgacttctttgagctgctgagcaaccaccacctggacagccagagccgctggagcaaggtgaaggacaaggtggagagtgacccccgctacaaggctgtggacagcagctccatgagagaagatctcttcaagcagtacatcgagaagatcgccaagaacctggacagcgagaaggagaaggagctggagcggcaggccagaattgaggccagcctgcgggagcgggagcgggaggtgcagaaggcccggtctgagcagaccaaggagattgaccgggagcgggagcagcacaagcgggaggaggccatccagaacttcaaggccctgctgagtgacatggtgcgcagcagtgatgtgtcctggagcgacaccaggaggaccctgaggaaggaccaccgctgggagagcggcagcctgctggagcgggaggagaaggagaagctgttcaatgagcacatcgaggccctgaccaagaagaagcgggagcacttccggcagctgctggatgagaccagcgccatcaccctgaccagcacctggaaggaggtgaagaagatcatcaaggaggacccccgctgcatcaagttcagcagcagtgacaggaagaagcagcgggagtttgaggagtacatccgggacaagtacatcacagccaaggctgacttccgcaccctgctgaaggagaccaagttcatcacctaccgcagcaagaagctgatccaggagagtgaccagcacctgaaggatgtggagaagatcctgcagaatgacaagcgctacctggtgctggactgtgtgcctgaggagaggaggaagctgattgtggcctacgtggatgacctggaccggcggggccccccacctccacccacagccagcgagcccacccggcgcagcaccaagtag

SEQ ID NO: 173552 - DNA, 3234 bp, Artificial Sequence
  Description of Artificial Sequence: Synthetic coding sequence
atggccgagagaggaggagatggaggagagagcgagcgcttcaaccctggagagctgaggatggcccagcagcaggccctgcgcttccggggccctgcccctcctccaaatgctgtgatgaggggccccccacccctgatgaggcctcctcctccatttggcatgatgaggggccccccacctccaccccggcccccatttggccggcccccatttgaccccaacatgccacccatgcctcctcctgggggcatccccccacccatgggccccccccacctgcagaggcctcccttcatgcccccacccatgagctccatgcctcctcctcctggcatgatgttccccccaggcatgcctcctgtgacagcccctggcaccccagccctgcccccaacagaggagatctgggtggagaacaagaccccagatggcaaggtgtactactacaatgcccggacccgggagagcgcctggaccaagccagatggagtgaaggtgatccagcagagcgagctgacccccatgctggccgcccaggcccaggtgcaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggcccaggtgcaggcccaggtgcaggcccaggtgcaggcccaggccgtgggcgccagcacccccaccaccagcagccctgccccagctgtgtccaccagcaccagcagcagcacccccagcagcaccaccagcaccaccaccacagccacctctgtggcccagacagtgtccacccccaccacccaggaccagacccccagcagcgctgtgtctgtggccacccccaccgtgtctgtgtccaccccagcccccacagccacccctgtgcagacagtgccccagccccacccccagaccctgcccccagctgtgccccacagcgtgccccagcccaccacagccatcccagccttcccccctgtgatggtgccccccttccgggtgcccctgcccggcatgcccatccccctgcccggggtgctgcccggcatggccccacccatcgtgcccatgatccacccccaggtggccatcgccgccagccctgccaccctggccggggccacagctgtgtctgagtggacagagtacaagacagcagatggcaagacctactactacaacaacagaaccctggagagcacctgggagaagccccaggagctgaaggagaaggagaagctggaggagaagatcaaggagcccatcaaggagcccagcgaggagcccctgcccatggagacagaggaggaggaccccaaggaggagcccatcaaggagatcaaggaggagcccaaggaggaggagatgacagaggaggagaaggccgcccagaaggccaagcctgtggccacagcccccatccctggcaccccctggtgtgtggtgtggacaggagatgagagggtcttcttctacaaccccaccacccggctgtccatgtgggacagaccagatgacctgattggccgggcagatgtggacaagatcatccaggagcccccccacaagaagggcatggaggagctgaagaagctgcggcaccccacccccaccatgctgagcatccagaagtggcagttctccatgtctgccatcaaggaggagcaggagctgatggaggagatcaatgaagatgagcctgtgaaggccaagaagaggaagagagatgacaacaaggacattgattctgagaaggaggccgccatggaggccgagatcaaggccgcccgggagcgggccatcgtgcccctggaggccaggatgaagcagttcaaggacatgctgctggagcggggcgtgtctgccttcagcacctgggagaaggagctgcacaagatcgtgtttgacccccgctacctgctgctgaaccccaaggagaggaagcaggtgtttgaccagtatgtgaagaccagggctgaggaggagcggcgggagaagaagaacaagatcatgcaggccaaggaggacttcaagaagatgatggaggaggccaagttcaacccccgggccaccttcagcgagtttgctgccaagcacgccaaggacagccgcttcaaggccatcgagaagatgaaggaccgggaggccctcttcaatgaatttgtggccgccgccaggaagaaggagaaggaggacagcaagaccagaggagagaagatcaagagtgacttctttgagctgctgagcaaccaccacctggacagccagagccgctggagcaaggtgaaggacaaggtggagagtgacccccgctacaaggctgtggacagcagctccatgagggaggacctcttcaagcagtacatcgagaagatcgccaagaacctggacagcgagaaggagaaggagctggagcggcaggcccgcatcgaggccagcctgcgggagcgggagcgggaggtgcagaaggcccggtctgagcagaccaaggagattgaccgggagcgggagcagcacaagcgggaggaggccatccagaacttcaaggccctgctgagtgacatggtgcgcagcagtgatgtgtcctggagcgacaccaggaggaccctgaggaaggaccaccgctgggagagcggcagcctgctggagcgggaggagaaggagaagctgttcaatgagcacatcgaggccctgaccaagaagaagcgggagcacttccggcagctgctggatgagaccagcgccatcaccctgaccagcacctggaaggaggtgaagaagatcatcaaggaggacccccgctgcatcaagttcagcagcagtgacaggaagaagcagcgggagtttgaggagtacatccgggacaagtacatcacagccaaggctgacttccgcaccctgctgaaggagaccaagttcatcacctaccgcagcaagaagctgatccaggagagtgaccagcacctgaaggatgtggagaagatcctgcagaatgacaagcgctacctggtgctggactgtgtgcctgaggagaggaggaagctgattgtggcctacgtggatgacctggacagaagaggccccccacctccacccacagccagcgagcccaccaggaggagcaccaagtag

SEQ ID NO: 173553 - DNA, 2049 bp, Artificial Sequence
  Description of Artificial Sequence: Synthetic coding sequence
atgaacccccagcagcagaggatggccgccatcggcacagacaaggagctgagtgacctgctggacttcagcgccatgttcagcccccctgtgaacagcggcaagacccggcccaccaccctgggcagcagccagttcagcggcagcggcattgatgagcggggcggcaccacctcctggggcaccagcggccagcccagccccagctatgacagcagccggggcttcacagacagcccccactacagcgaccacctgaatgacagccggctgggcgcccacgagggcctgagccccacccccttcatgaacagcaacctgatgggcaagaccagcgagcggggcagcttcagcctgtacagccgggacaccggcctgcccggctgccagagcagcctgctgcggcaggacctgggcctgggcagccctgcccagctgagcagcagcggcaagccaggcacagcctactacagcttcagcgccaccagcagcagaagaagacccctgcatgacagcgctgccctggaccccctgcaggccaagaaggtgaggaaggtgcccccaggcctgcccagctctgtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173554 - DNA, 2121 bp, Artificial Sequence
  Description of Artificial Sequence: Synthetic coding sequence
atgaacccccagcagcagaggatggccgccatcggcacagacaaggagctgagtgacctgctggacttcagcgccatgttcagcccccctgtgaacagcggcaagacccggcccaccaccctgggcagcagccagttcagcggcagcggcattgatgagcggggcggcaccacctcctggggcaccagcggccagcccagccccagctatgacagcagccggggcttcacagacagcccccactacagcgaccacctgaatgacagccggctgggcgcccacgagggcctgagccccacccccttcatgaacagcaacctgatgggcaagaccagcgagcggggcagcttcagcctgtacagccgggacaccggcctgcccggctgccagagcagcctgctgcggcaggacctgggcctgggcagccctgcccagctgagcagcagcggcaagccaggcacagcctactacagcttcagcgccaccagcagcagaagaagacccctgcatgacagcgctgccctggaccccctgcaggccaagaaggtgaggaaggtgcccccaggcctgcccagctctgtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgaagaacagagtggagcagcagctgcacgagcacctgcaggatgccatgtccttcctgaaggatgtgtgtgagcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173555 - DNA, 2109 bp, Artificial Sequence
  Description of Artificial Sequence: Synthetic coding sequence
atgaacccccagcagcagaggatggccgccatcggcacagacaaggagctgagtgacctgctggacttcagcgccatgttcagcccccctgtgaacagcggcaagacccggcccaccaccctgggcagcagccagttcagcggcagcggcaccatccacgagatgaagcagctgaacagcaaggcccggcagaagggccagaggatcaagggcttcacagacagcccccactacagcgaccacctgaatgacagccggctgggcgcccacgagggcctgagccccacccccttcatgaacagcaacctgatgggcaagaccagcgagcggggcagcttcagcctgtacagccgggacaccggcctgcccggctgccagagcagcctgctgcggcaggacctgggcctgggcagccctgcccagctgagcagcagcggcaagccaggcacagcctactacagcttcagcgccaccagcagcagaagaagacccctgcatgacagcgctgccctggaccccctgcaggccaagaaggtgaggaaggtgcccccaggcctgcccagctctgtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgaagaacagagtggagcagcagctgcacgagcacctgcaggatgccatgtccttcctgaaggatgtgtgtgagcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173556 - DNA, 1341 bp, Artificial Sequence
  Description of Artificial Sequence: Synthetic coding sequence
atgggcaagcgctacatgcaccacccccagatccagatgatcagcacagtgaacctgctggtgatccacctgctgagccaccagcctgtgtgcagcctggccctgagcctgtgcaagagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173557 - DNA, 2046 bp, Artificial Sequence
  Description of Artificial Sequence: Synthetic coding sequence
atggccgccttctctgtgctgcggccccgggtgcccggcagcagcggcacctgggccgctgaccctgatgccagcacagctgtgagccccagcctgcgctttggaggccgggagcccgcccggcccacccggggcggggccaccaagtggcccaagatgaacccccagcagcagaggatggccgccatcggcacagacaaggagctgagtgacctgctggacttcagcgccatgttcagcccccctgtgaacagcggcaagacccggcccaccaccctgggcagcagccagttcagcggcagcggcattgatgagcggggcggcaccacctcctggggcaccagcggccagcccagccccagctatgacagcagccggggcttcacagacagcccccactacagcgaccacctgaatgacagccggctgggcgcccacgagggcctgagccccacccccttcatgaacagcaacctgatgggcaagaccagcgagcggggcagcttcagcctgtacagccgggacaccggcctgcccggctgccagagcagcctgctgcggcaggacctgggcctgggcagccctgcccagctgagcagcagcggcaagccaggcacagcctactacagcttcagcgccaccagcagcagaagaagacccctgcatgacagcgctgccctggaccccctgcaggccaagaaggtgaggaaggtgcccccaggcctgcccagctctgtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtgaccaccatcggcccctag

SEQ ID NO: 173558 - DNA, 885 bp, Artificial Sequence
  Description of Artificial Sequence: Synthetic coding sequence
atgtccttcctgaaggatgtgtgtgagcagagcaggatggaggaccggctggaccggctggatgatgccatccacgtgctgaggaaccacgctgtgggccccagcaccagcctgcctgctggccacagcgacatccacagcctgctgggccccagccacaatgcccccatcggcagcctgaacagcaactacggcggcagcagcctggtggccagcagccgcagcgcctccatggtgggcacccaccgggaggacagcgtgtccctgaatggaaaccacagcgtgctgagcagcacagtgaccaccagcagcacagacctgaaccacaagacccaggagaactacagaggaggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173559 - DNA, 1611 bp, Artificial Sequence
  Description of Artificial Sequence: Synthetic coding sequence
atgtactgtgcctaccctgtgcccggcatgggcagcaacagcctgatgtactactacaacgggaagacagtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgaagaacagagtggagcagcagctgcacgagcacctgcaggatgccatgtccttcctgaaggatgtgtgtgagcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173560 - DNA, 2049 bp, Artificial Sequence; identical to SEQ ID NO: 173553
  Description of Artificial Sequence: Synthetic coding sequence

SEQ ID NO: 173561 - DNA, 1020 bp, Artificial Sequence
  Description of Artificial Sequence: Synthetic coding sequence
atgagcagcaacagcagcaccagccagtggcccaggcctgggggccaggcccccagcagccccagctatgagaacagcctgcacagcctgaagaacagagtggagcagcagctgcacgagcacctgcaggatgccatgtccttcctgaaggatgtgtgtgagcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcaccaatgaagatgaggacctgaaccctgagcagaagattgagcgggagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagagaagagaggaggagaaggtgtctgctgtgtctgctgagccccccaccaccctgcccggcacccaccctggcctgtctgagaccaccaaccccatgggccacatgtag

SEQ ID NO: 173562 - DNA, 1341 bp, Artificial Sequence; identical to SEQ ID NO: 173556
  Description of Artificial Sequence: Synthetic coding sequence

SEQ ID NO: 173563 - DNA, 1539 bp, Artificial Sequence
  Description of Artificial Sequence: Synthetic coding sequence
atgtactgtgcctaccctgtgcccggcatgggcagcaacagcctgatgtactactacaacgggaagacagtgtatgcccccagccccaacagtgatgacttcaaccgggagagccccagctaccccagccccaagccacccacctccatgtttgccagcaccttcttcatgcaggacggcacccacaacagcagtgacctgtggagcagcagcaatggcatgagccagcccggctttggaggcatcctgggcaccagcaccagccacatgagccagagcagcagctatggcaacctgcacagccatgaccggctgagctacccaccccacagcgtgagccccacagacatcaacaccagcctgccccccatgagcagcttccaccggggcagcaccagcagcagcccctacgtggccgccagccacaccccacccatcaatggaagtgacagcatcctgggcaccagaggaaatgctgctggcagcagccagacaggagatgccctgggcaaggccctggccagcatctacagcccagaccacaccagcagcagcttccccagcaaccccagcacccctgtgggcagccccagccccctgaccggcaccagccagtggcccaggcctgggggccaggcccccagcagccccagctatgagaacagcctgcacagcctgcagagcaggatggaggaccggctggaccggctggatgatgccatccacgtgctgagaaatcatgctgtgggccccagcaccagcctgcctgctggccacagcgacatccacagcctgctgggccccagccacaatgcccccatcggcagcctgaacagcaactatggaggcagcagcctggtggccagcagccgcagcgcctccatggtgggcacccacagagaagattctgtgtccctgaatggaaaccacagcgtgctgagcagcacagtgaccaccagcagcacagacctgaaccacaagacccaggagaactaccggggcggcctgcagagccagagcggcaccgtggtgaccacagagatcaagacagagaacaaggagaaggatgagaacctgcacgagccccccagcagtgatgacatgaagagtgatgatgagagcagccagaaggacatcaaggtgagcagccggggccgcaccagcagcaccaatgaagatgaggacctgaaccctgagcagaagattgaaagagagaaggagaggaggatggccaacaatgcccgggagcggctgcgggtgcgggacatcaatgaggccttcaaggagctgggccgcatgtgccagctgcacctgaagtctgagaagccccagaccaagctgctgatcctgcaccaggccgtggccgtcatcctgagcctggagcagcaggtgcgggagaggaacctgaaccccaaggccgcctgcctgaagaggcgggaggaggagaaggtgtctgctgtgtctgctgagccccccaccaccctgcccggcacccaccctggcctgtctgagaccaccaaccccatgggccacatgtag

SEQ ID NO: 173564 - DNA, 600 bp, Artificial Sequence
  Description of Artificial Sequence: Synthetic coding sequence
atggcctttgccctgctgcggcctgtgggcgcccacgtgctgtacccagatgtgcggctgctgtctgaagatgaggagaacagaagtgaaagtgatgccagtgaccagagctttggctgctgtgagggccctgaggccgcccggcggggccctggccctgggggcggcagaagagctgggggcggcggcggggccggccctgtggtggtggtgcggcagaggcaggccgccaatgcccgggagcgggacaggacccagagcgtgaacacagccttcaccgccctgcggaccctcatccccacagagcctgtggacaggaagctgagcaagattgaaacagtgcggctggccagcagctacatcgcccacctggccaacgtgctgctgctgggggacagcgcagatgatggccagccctgcttccgggccgccggcagcgccaagggagctgtgcctgctgctgctgatggcggccggcagcccaggagcatctgcaccttctgcctgagcaaccagaggaagggcggcggccggcgggacctgggcggcagctgcctgaaggtgcggggcgtggcccccctgcggggccccaggaggtag

SEQ ID NO: 173565 - DNA, 1038 bp, Artificial Sequence
  Description of Artificial Sequence: Synthetic coding sequence
atgctgccctgcttccagctgctgcgcatcggcggcggccggggcggggacctgtacaccttccaccccccagctggagctggctgcacctaccgcctgggccacagagctgacctgtgtgatgtggccctgcggccccagcaggagcccggcctcatcagcggcatccacgccgagctgcacgccgagcccagaggagatgactggagggtgtccctggaggaccacagcagccagggcaccctggtgaacaacgtgcggctgccccggggccaccggctggagctgagtgatggagacctgctgaccttcggccctgagggccccccaggcaccagccccagcgagttctacttcatgttccagcaggtgcgggtgaagccccaggactttgctgccatcaccatccccaggagcagaggagaggcccgggtgggcgccggcttccggcccatgctgcccagccagggcgccccccagaggcccctgagcaccttcagccctgcccccaaggccaccctcatcctgaacagcatcggcagcctgagcaagctgcggccccagcccctgaccttcagccccagctggggcggccccaagagcctgcctgtgcctgcccctcctggagagatgggcaccacccccagcgccccaccccagaggaacagaaggaagtctgtgcaccgggtgctggccgagctggatgatgagagcgagcccccagagaaccccccacctgtgctgatggagcccaggaagaagctgcgggtggacaaggcccccctgacccccactggaaacagaagaggccggcccaggaagtaccctgtgtctgcccccatggcccctcctgctgtgggcggcggggagccctgtgccgccccctgctgctgcctgccccaggaggagaccgtggcctgggtgcagtgtgatggctgtgatgtgtggttccacgtggcctgtgtgggctgcagcatccaggccgcccgggaggccgacttccgctgccccggctgcagagctggcatccagacctag

SEQ ID NO: 173566 - DNA, 1038 bp, Artificial Sequence; identical to SEQ ID NO: 173565
  Description of Artificial Sequence: Synthetic coding sequence

SEQ ID NO: 173567 - DNA, 1038 bp, Artificial Sequence
  Description of Artificial Sequence: Synthetic coding sequence
atgctgccctgcttccagctgctgcgcatcggcggcggccggggcggggacctgtacaccttccaccccccagctggagctggctgcacctaccgcctgggccacagagctgacctgtgtgatgtggccctgcggccccagcaggagcccggcctcatcagcggcatccacgccgagctgcacgccgagcccagaggagatgactggagggtgtccctggaggaccacagcagccagggcaccctggtgaacaacgtgcggctgccccggggccaccggctggagctgagtgatggagacctgctgaccttcggccctgagggccccccaggcaccagccccagcgagttctacttcatgttccagcaggtgcgggtgaagccccaggactttgctgccatcaccatccccaggagcagaggagaggcccgggtgggcgccggcttccggcccatgctgcccagccagggcgccccccagaggcccctgagcaccttcagccctgcccccaaggccaccctcatcctgaacagcatcggcagcctgagcaagctgcggccccagcccctgaccttcagccccagctggggcggccccaagagcctgcctgtgcctgcccctcctggagaggtgggcaccacccccagcgccccaccccagaggaacagaaggaagtctgtgcaccgggtgctggccgagctggatgatgagagcgagcccccagagaaccccccacctgtgctgatggagcccaggaagaagctgcgggtggacaaggcccccctgacccccactggaaacagaagaggccggcccaggaagtaccctgtgtctgcccccatggcccctcctgctgtgggcggcggggagccctgtgccgccccctgctgctgcctgccccaggaggagaccgtggcctgggtgcagtgtgatggctgtgatgtgtggttccacgtggcctgtgtgggctgcagcatccaggccgcccgggaggccgacttccgctgccccggctgcagagctggcatccagacctag

SEQ ID NO: 173568 - DNA, 1038 bp, Artificial Sequence; identical to SEQ ID NO: 173567
  Description of Artificial Sequence: Synthetic coding sequence

SEQ ID NO: 173569 - DNA, 1038 bp, Artificial Sequence; identical to SEQ ID NO: 173567
  Description of Artificial Sequence: Synthetic coding sequence

SEQ ID NO: 173570 - DNA, 1038 bp, Artificial Sequence; identical to SEQ ID NO: 173567
  Description of Artificial Sequence: Synthetic coding sequence

SEQ ID NO: 173571 - DNA, 1038 bp, Artificial Sequence; identical to SEQ ID NO: 173567
  Description of Artificial Sequence: Synthetic coding sequence

SEQ ID NO: 173572 - DNA, 1038 bp, Artificial Sequence
  Description of Artificial Sequence: Synthetic coding sequence
atgctgccctgcttccagctgctgcgcatcggcggcggccggggcggggacctgtacaccttccaccccccagctggagctggctgcacctaccgcctgggccacagagctgacctgtgtgatgtggccctgcggccccagcaggagcccggcctcatcagcggcatccacgccgagctgcacgccgagcccagaggagatgactggagggtgtccctggaggaccacagcagccagggcaccctggtgaacaacgtgcggctgccccggggccaccggctggagctgagtgatggagacctgctgaccttcggccctgagggcagccctggcaccagccccagcgagttctacttcatgttccagcaggtgcgggtgaagccccaggactttgctgccatcaccatccccaggagcagaggagaggcccgggtgggcgccggcttccggcccatgctgcccagccagggcgccccccagaggcccctgagcaccttcagccctgcccccaaggccaccctcatcctgaacagcatcggcagcctgagcaagctgcggccccagcccctgaccttcagccccagctggggcggccccaagagcctgcctgtgcctgcccctcctggagaggtgggcaccacccccagcgccccaccccagaggaacagaaggaagtctgtgcaccgggtgctggccgagctggatgatgagagcgagcccccagagaaccccccacctgtgctgatggagcccaggaagaagctgcgggtggacaaggcccccctgacccccactggaaacagaagaggccggcccaggaagtaccctgtgtctgcccccatggcccctcctgctgtgggcggcggggagccctgtgccgccccctgctgctgcctgccccaggaggagaccgtggcctgggtgcagtgtgatggctgtgatgtgtggttccacgtggcctgtgtgggctgcagcatccaggccgcccgggaggccgacttccgctgccccggctgcagagctggcatccagacctag

SEQ ID NO: 173573 - DNA, 1038 bp, Artificial Sequence; identical to SEQ ID NO: 173567
  Description of Artificial Sequence: Synthetic coding sequence

SEQ ID NO: 173574 - DNA, 1038 bp, Artificial Sequence; identical to SEQ ID NO: 173567
  Description of Artificial Sequence: Synthetic coding sequence

SEQ ID NO: 173575 - DNA, 1038 bp, Artificial Sequence; identical to SEQ ID NO: 173567
  Description of Artificial Sequence: Synthetic coding sequence

SEQ ID NO: 173576 - DNA, 1038 bp, Artificial Sequence; identical to SEQ ID NO: 173567
  Description of Artificial Sequence: Synthetic coding sequence

SEQ ID NO: 173577 - DNA, 1038 bp, Artificial Sequence; identical to SEQ ID NO: 173567
  Description of Artificial Sequence: Synthetic coding sequence

SEQ ID NO: 173578 - DNA, 1038 bp, Artificial Sequence; identical to SEQ ID NO: 173572
  Description of Artificial Sequence: Synthetic coding sequence

SEQ ID NO: 173579 - DNA, 654 bp, Artificial Sequence
  Description of Artificial Sequence: Synthetic coding sequence
accctggtgaacaacgtgcggctgccccggggccaccggctggagctgagtgatggagacctgctgaccttcggccctgagggccccccaggcaccagccccagcgagttctacttcatgttccagcaggtgcgggtgaagccccaggactttgctgccatcaccatccccaggagcagaggagaggcccgggtgggcgccggcttccggcccatgctgcccagccagggcgccccccagaggcccctgagcaccttcagccctgcccccaaggccaccctcatcctgaacagcatcggcagcctgagcaagctgcggccccagcccctgaccttcagccccagctggggcggccccaagagcctgcctgtgcctgcccctcctggagagatgggcaccacccccagcgccccaccccagaggaacagaaggaagtctgtgcaccgggtgctggccgagctggatgatgagagcgagcccccagagaaccccccacctgtgctgatggagcccaggaagaagctgcgggtggacaaggcccccctgacccccactggaaactggcacatccagggcatgcagagcatcgtgaagggccagaaggagcggccctggccccgggagcacctgagcggctatgaggaggccagctag

SEQ ID NO: 173580 - DNA, 645 bp, Artificial Sequence
  Description of Artificial Sequence: Synthetic coding sequence
atgagccagaggaaggcccggggccccccagccatgcctggggtgggccacagccagacccaggccaaggcccggctgctgcccggggctgacaggaagaggagccggctgagcaggacccggcaggacccctgggaggagaggtcctggagcaaccagcgctggagccgggccaccccaggcccccggggcaccagggctgggggcctggccctgggccgctctgaggccagcccagaaaatgctgcccgggagaggagccgggtgaggaccctgcggcaggccttcctggccctgcaggccgccctgcctgctgtgcccccagacaccaagctgagcaagctggatgtgctggtgctggccgccagctacatcgcccacctgaccaggaccctgggccacgagctgcccggccctgcctggccacccttcctgcggggcctgcgctacctgcaccccctgaagaagtggcccatgaggagccggctgtatgccggcggcctgggctacagcgacctggacagcaccacagccagcacccccagccagaggaccagagatgctgaggtgggcagccaggtgcctggagaggctgatgccctgctgagcaccacccccctgagccctgccctgggggacaagtag

SEQ ID NO: 173581 - DNA, 2031 bp, Artificial Sequence
  Description of Artificial Sequence: Synthetic coding sequence
atgagcagaagagccctgcggcggctgcggggggagcagaggggccaggagcccctgggccctggggccctgcactttgacctgagagatgatgatgatgctgaggaggagggccccaagcgggagctgggcgtgcggcggcctgggggcgccggcaaggagggcgtgcgggtgaacaacagatttgagctgatcaacattgatgacctggaggatgatcctgtggtgaatggagagaggagcggctgtgccctgacagatgctgtggcccctggcaacaagggccggggccagaggggcaacacagagagcaagacagatggagatgacacagaaacagtgcccagcgagcagagccacgccagcggcaagctgaggaagaagaagaagaagcagaagaacaagaagagcagcactggagaggcctctgaaaatggcctggaggacatcgaccgcatcctggagagaattgaggacagcacaggcctgaaccggcccggccctgcccccctgagcagcaggaagcacgtgctgtatgtggagcaccgccacctgaacccagacacagagctgaagcgctactttggagcccgggccatcctgggggagcagaggccccggcagaggcagagggtgtaccccaagtgcacctggctgaccacccccaagagcacctggccccgctacagcaagccaggcctgtccatgaggctgctggagagcaagaagggcctgtccttctttgcctttgagcacagcgaggagtaccagcaggcccagcacaagttcctggtggccgtggagagcatggagcccaacaacatcgtggtgctgctgcagaccagcccctaccacgtggacagcctgctgcagctgagtgatgcctgccgcttccaggaggaccaggagatggcccgggacctggtggagcgggccctgtacagcatggagtgtgccttccaccccctcttcagcctgaccagcggggcctgccgcctggactacagaagaccagaaaatagaagcttctacctggccctgtacaagcagatgtccttcctggagaagaggggctgccccaggacagccctggagtactgcaagctgatcctgagcctggagccagatgaggaccccctgtgcatgctgctgctgattgaccacctggccctgcgggccaggaactatgagtacctgatccgcctcttccaggagtgggaggcccacaggaacctgagccagctgcccaactttgccttctctgtgcccctggcctacttcctgctgagccagcagacagacctgcctgaatgtgagcagagcagcgcccggcagaaggccagcctgctgatccagcaggccctgaccatgtttcctggggtgctgctgcccctgctggagagctgcagcgtgcggccagatgcctctgtgagcagccaccgcttcttcggccccaatgctgagatcagccagcccccagccctgagccagctggtgaacctgtacctgggccgcagccacttcctgtggaaggagcccgccaccatgtcctggctggaggagaatgtgcatgaggtgctgcaggccgtggatgctggggaccctgctgtggaggcctgtgaaaatagaaggaaggtgctgtaccagagggcccccaggaacatccaccgccacgtgatcctgtctgagatcaaggaggccgtggccgccctgcccccagatgtgaccacccagagcgtgatgggctttgaccccctgcccccaagtgacaccatctacagctatgtgcggcctgagcggctgagccccatcagccacggcaacaccatcgccctcttcttccgcagcctgctgcccaactacaccatggagggggagaggcctgaggagggcgtggccggcggcctgaacagaaaccagggcctgaaccggctgatgctggccgtgcgggacatgatggccaacttccacctgaatgacctggaggcccctcatgaagatgatgctgagggggagggggagtgggactag

SEQ ID NO: 173582 - DNA, 1422 bp, Artificial Sequence
  Description of Artificial Sequence: Synthetic coding sequence
atgaggctgctggagagcaagaagggcctgtccttctttgcctttgagcacagcgaggagtaccagcaggcccagcacaagttcctggtggccgtggagagcatggagcccaacaacatcgtggtgctgctgcagaccagcccctaccacgtggacagcctgctgcagctgagtgatgcctgccgcttccaggaggaccaggagatggcccgggacctggtggagcgggccctgtacagcatggagtgtgccttccaccccctcttcagcctgaccagcggggcctgccgcctggactacagaagacctgagaacagaagcttctacctggccctgtacaagcagatgtccttcctggagaagaggggctgccccaggacagccctggagtactgcaagctgatcctgagcctggagccagatgaggaccccctgtgcatgctgctgctgattgaccacctggccctgcgggccagaaattatgagtacctgatccgcctcttccaggagtgggaggcccacaggaacctgagccagctgcccaactttgccttctctgtgcccctggcctacttcctgctgagccagcagacagacctgcctgaatgtgagcagagcagcgcccggcagaaggccagcctgctgatccagcaggccctgaccatgtttcctggggtgctgctgcccctgctggagagctgcagcgtgcggccagatgcctctgtgagcagccaccgcttcttcggccccaatgctgagatcagccagcccccagccctgagccagctggtgaacctgtacctgggccgcagccacttcctgtggaaggagcccgccaccatgtcctggctggaggagaatgtgcatgaggtgctgcaggccgtggatgctggggaccctgctgtggaggcctgtgagaacagaaggaaggtgctgtaccagagggcccccaggaacatccacagacatgtgatcctgtctgagatcaaggaggccgtggccgccctgcccccagatgtgaccacccagagcgtgatgggctttgaccccctgccccccagcgacaccatctacagctatgtgcggcctgagaggaagggggaggaggagagaaattctgtcatctggggcagccagctgtgtgtgtgccggcccaggagcttccccagccccccaaatgtgcaggccctggcctgccggcccctgtggcaggccaagagctaccagccctggaagcaccactgcagcctgctgcctgtgacagtggccaagctgtaccatggaggaggagaggcccggggccgcagcggctggggcagcgagccccagcccggccctgagcaggctgatgctggctgtgcccggcatgatggccagctgcccccccagaggcctggaggagctgcccggggcagaagatag

SEQ ID NO: 173583 - DNA, 651 bp, Artificial Sequence
  Description of Artificial Sequence: Synthetic coding sequence
atgagcagaagagccctgcggcggctgcggggggagcagaggggccaggagcccctgggccctggggccctgcactttgacctgagagatgatgatgatgctgaggaggagggccccaagcgggagctgggcgtgcggcggcctgggggcgccggcaaggagggcgtgcgggtgaacaacagatttgagctgatcaacattgatgacctggaggatgatcctgtggtgaatggagagaggagcggctgtgccctgacagatgctgtggcccctggcaacaagggccggggccagaggggcaacacagagagcaagacagatggagatgacacagaaacagtgcccagcgagcagagccacgccagcggcaagctgaggaagaagaagaagaagcagaagaacaagaagagcagcactggagaggcctctgaaaatggcctggaggacatcgaccgcatcctggagagaattgaggacagcacaggcctgaaccggcccggccctgcccccctgagcagcaggaagcacgtgctgtatgtggagcaccgccacctgaacccagacacagagctgaagcgctactttggagcccgggccatcctgggggagcagagggacagagtgctgctgggctgccctgtgtggttctag

SEQ ID NO: 173584 - DNA, 624 bp, Artificial Sequence
  Description of Artificial Sequence: Synthetic coding sequence
ctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcccggggagaccaatgacctgagcgcccccaagaagtgccgggcccgcttcggcctggaccagcagaacaactggtgtggcccctgcaggaggaagaagaagtgtgtgcgctacatccagggcgagggcagctgcctgagcccccccagcagtgatggcagcctgctgtag

SEQ ID NO: 173585 - DNA, 669 bp, Artificial Sequence
  Description of Artificial Sequence: Synthetic coding sequence
accaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagccccctgccctgctgcacccagggccatgactgccagcacttctacccacccagcgacttcaccgtgtccacccaggtgttccgggacatgaagaggagccacagcctgcagaaggtgggggagccctggtgcatcgagagcaacaaggtgcctgtggtgcagcacccccaccacgtgcaccccctgacccccctcatcacctacagcaatgagcacttcaccccaggcaaccccccaccccacctgcctgcagatgtggaccccaagacctag

SEQ ID NO: 173586 - DNA, 867 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggcagggccagcctgtgtaccccatcaccactggaggcttccgccacccctaccccacagccctgactgtgaatgcctccatgagcaggtag

SEQ ID NO: 173587 - DNA, 1380 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggacctacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatcccccggcccccccaccccccagacatcagcccctactaccccctgagccctggcaccgtgggccagatcccccaccccctgggctggctggtgccccagcagggccagcctgtgtaccccatcaccaccggcggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcccggggagaccaatgagcacagcgagtgcttcctgaacccctgcctgagcctgccccccatcacagacctgagcgcccccaagaagtgccgggccaggtttggcctggaccagcagaacaactggtgtggcccctgcagcctgtag

SEQ ID NO: 173588 - DNA, 1470 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggacctacctgcagatgaagtggcccctgctggatgtgcaggccggcagcctgcagagccggcaggccctgaaggatgcccggagccccagccctgcccacatcgtgagccccctgccctgctgcacccagggccatgactgccagcacttctacccacccagcgacttcaccgtgtccacccaggtgttccgggacatgaagaggagccacagcctgcagaaggtgggggagccctggtgcatcgagagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatggagagaagaagagcgcctttgccacctacaaggtgaaggccgccgccagcgcccaccccctgcagatggaggcctactag

SEQ ID NO: 173589 - DNA, 1860 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgagcacagcgagtgcttcctgaacccctgcctgagcctgccccccatcacagacctgagcgcccccaagaagtgccgggcccgcttcggcctggaccagcagaacaactggtgtggcccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaacggggccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173590 - DNA, 363 bp, Artificial Sequence
  Description of Artificial Sequence: Synthetic coding sequence
atgctgtacatgaaggagatgagggccaaggtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcccggggagaccaatgacctgagcgcccccaagaagtgccgggcccgcttcggcctggaccagcagaacaactggtgtggcccctgccgctgcaagtacagcaaggaggtgtctggaacagtgcgggcctag

SEQ ID NO: 173591 - DNA, 531 bp, Artificial Sequence
  Description of Artificial Sequence: Synthetic coding sequence
atgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcccggggagaccaacggggagaagaagagcgcctttgccacctacaaggtgaaggctgctgccagcgcccaccccctgcagatggaggcctactag

SEQ ID NO: 173592 - DNA, 954 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggacctacctgcagatgaagtggcccctgctggatgtgcaggccggcagcctgcagagccggcaggccctgaaggatgcccggagccccagccctgcccacatcgtgcagagccccctgccctgctgcacccagggccatgactgccagcacttctacccacccagcgacttcaccgtgtccacccaggtgttccgggacatgaagaggagccacagcctgcagaaggtgggggagccctggtgcatcgagagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatcccccggcccccccaccccccagacatcagcccctactaccccctgagccctggcaccgtgggccagatcccccaccccctgggctggctggtgccccagcagggccagcctgtgtaccccatcaccaccggcggcttccgccacccctaccccacagccctgactgtgaatgcctccatgagcaggtag

SEQ ID NO: 173593 - DNA, 1791 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggacctacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatcccccggcccccccaccccccagacatcagcccctactaccccctgagccctggcaccgtgggccagatcccccaccccctgggctggctggtgccccagcagggccagcctgtgtaccccatcaccaccggcggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggccgagtgcaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcccggggagaccaatgagcacagcgagtgcttcctgaacccctgcctgagcctgccccccatcacagacctgagcgcccccaagaagtgccgggccaggtttggcctggaccagcagaacaactggtgtggcccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaatggagccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173594 - DNA, 1485 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgagcacagcgagtgcttcctgaacccctgcctgagcctgccccccatcacagacctgagcgcccccaagaagtgccgggcccgcttcggcctggaccagcagaacaactggtgtggcccctgccgctgcaagtacagcaaggaggtgtctggaacagtgcgggcctag

SEQ ID NO: 173595 - DNA, 1809 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgacctgagcgcccccaagaagtgccgggccaggtttggcctggaccagcagaacaactggtgtggcccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaatggagccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173596 - DNA, 1449 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgagcacagcgagtgcttcctgaacccctgcctgagcctgccccccatcaccggggagaagaagagcgcctttgccacctacaaggtgaaggctgctgccagcgcccaccccctgcagatggaggcctactag

SEQ ID NO: 173597 - DNA, 1008 bp, Artificial Sequence
  Description of Artificial Sequence: Synthetic coding sequence
atgagcagcttcctgagcagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgagcacagcgagtgcttcctgaacccctgcctgagcctgccccccatcacagacctgagcgcccccaagaagtgccgggcccgcttcggcctggaccagcagaacaactggtgtggcccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaacggggccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173598 - DNA, 1809 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgatgccaacacccccaagaagtgccgggccctgtttggcctggaccggcagaccctgtggtgcaagccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaatggagccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173599 - DNA, 1860 bp, Artificial Sequence
  Description of Artificial Sequence: Synthetic coding sequence
atgccccagctgaatggaggcggcggagatgacctgggcgccaatgatgagctgatctccttcaaggatgaaggagagcaggaggagaagagcagcgagaacagcagcgctgagcgggacctggctgatgtgaagagcagcctggtgaatgaaagtgagaccaaccagaacagcagcagtgacagcgaggccgagcggcggcccccacccaggtctgagagcttccgggacaagagccgggagagcctggaggaggccgccaagaggcaggacggcggcctcttcaagggccccccctacccaggctaccccttcatcatgatcccagacctgaccagcccctacctgcccaacggcagcctgagccccacagcccggaccctgcacttccagagcggcagcacccactacagcgcctacaagaccatcgagcaccagattgctgtgcagtacctgcagatgaagtggcccctgctggatgtgcaggccggcagcctgcagagccggcaggccctgaaggatgcccggagccccagccctgcccacatcgtgagcaacaaggtgcctgtggtgcagcacccccaccacgtgcaccccctgacccccctcatcacctacagcaatgagcacttcaccccaggcaaccccccaccccacctgcctgcagatgtggaccccaagacaggcatccccaggcctccccaccccccagacatcagcccctactaccccctgagccctggcaccgtgggccagatcccccaccccctgggctggctggtgccccagcagggccagcctgtgtaccccatcaccactggaggcttccgccacccctaccccacagccctgactgtgaatgcctccatgagccgcttccccccccacatggtgcccccccaccacaccctgcacaccaccggcatcccccacccagccatcgtgacccccaccgtgaagcaggagagcagccagagtgatgtgggcagcctgcacagcagcaagcaccaggacagcaagaaggaggaggagaagaagaagccccacatcaagaagcccctgaatgccttcatgctgtacatgaaggagatgagggccaaggtggtggctgaatgtaccctgaaggagagcgctgccatcaaccagatcctgggccgccgctggcacgccctgagccgggaggagcaggccaagtactatgagctggccaggaaggagcggcagctgcacatgcagctgtacccaggctggagcgcccgggacaactacggcaagaagaagaagaggaagagggacaagcagcctggagagaccaatgagcacagcgagtgcttcctgaacccctgcctgagcctgccccccatcacagatgccaacacccccaagaagtgccgggccctgtttggcctggaccggcagaccctgtggtgcaagccctgcaggaggaagaagaagtgtgtgcgctacatccagggcgagggcagctgcctgagcccccccagcagtgatggcagcctgctggacagccccccacccagccccaacctgctgggcagccccccaagagatgccaagagccagacagagcagacccagcccctgagcctgagcctgaagccagaccccctggcccacctgtccatgatgcctcctcctccagccctgctgctggccgaggccacccacaaggccagcgccctgtgccccaacggggccctggacctgcccccagctgccctgcagcctgctgcccccagcagcagcatcgcccagcccagcaccagcagcctgcacagccacagcagcctggccggcacccagccccagcccctgagcctggtgaccaagagcctggagtag

SEQ ID NO: 173600 - DNA, 645 bp, Artificial Sequence
  Description of Artificial Sequence: Synthetic coding sequence
atggccttcctgcgctccatgtggggcgtgctgagcgccctgggccgctctggagctgagctgtgcaccggctgcggcagccggctgcggagccccttctcctttgtgtacctgccccgctggttcagctctgtgctggccagctgccccaagaagcctgtgagcagctacctgcgcttcagcaaggagcagctgcccatcttcaaggcccagaacccagatgccaagaccacagagctgatccgccgcatcgcccagcgctggagggagctgcctgacagcaagaagaagatctaccaggatgcctacagagctgagtggcaggtgtacaaggaggagatcagccgcttcaaggagcagctgacccccagccagatcatgagcctggagaaggagatcatggacaagcacctgaagaggaaggccatgaccaagaagaaggagaagctgaagacagtgaaggagaactggaagaacctgagtgacagcgagaaggagctgtacatccagcacgccaaggaggatgagacccgctaccacaatgagatgaagtcctgggaggagcagatgattgaggtgggcaggaaggacctgctgcggaggaccatcaagaagcagaggaaatatggagcagaagaatgttag

SEQ ID NO: 173601 - DNA, 660 bp, Artificial Sequence
  Description of Artificial Sequence: Synthetic coding sequence
tgagagctgtgcaccggctgcggcagccggctgcggagccccttctcctttgtgtacctgccccgctggttcagctctgtgctggccagctgccccaagaagcctgtgagcagctacctgcgcttcagcaaggagcagctgcccatcttcaaggcccagaacccagatgccaagaccacagagctgatccgccgcatcgcccagcgctggagggagctgcctgacagcaagaagaagatctaccaggatgcctacagagctgagtggcaggtgtacaaggaggagatcagccgcttcaaggagcagctgacccccagccagatcatgagcctggagaaggagatcatggacaagcacctgaagaggaaggccatgaccaagaagaaggagctgaccctgctgggcaagcccaagaggcccaggtctgcctacaacgtgtatgtggccgagcgcttccaggaggccaagggggacagcccccaggagaagctgaagacagtgaaggagaactggaagaacctgagtgacagcgagaaggaggtgtccatcaccgtggtgtccctgaagtgcctgctgcgcatctctgtgcgggagtgcatccgggcccggctggacagctgtgaggacaacctggtgctgctgatcatccaggtgttctag

SEQ ID NO: 173602 - DNA, 741 bp, Artificial Sequence
  Description of Artificial Sequence: Synthetic coding sequence
atggccttcctgcgctccatgtggggcgtgctgagcgccctgggccgctctggagctgagctgtgcaccggctgcggcagccggctgcggagccccttctcctttgtgtacctgccccgctggttcagctctgtgctggccagctgccccaagaagcctgtgagcagctacctgcgcttcagcaaggagcagctgcccatcttcaaggcccagaacccagatgccaagaccacagagctgatccgccgcatcgcccagcgctggagggagctgcctgacagcaagaagaagatctaccaggatgcctacagagctgagtggcaggtgtacaaggaggagatcagccgcttcaaggagcagctgacccccagccagatcatgagcctggagaaggagatcatggacaagcacctgaagaggaaggccatgaccaagaagaaggagctgaccctgctgggcaagcccaagaggcccaggtctgcctacaacgtgtatgtggccgagcgcttccaggaggccaagggggacagcccccaggagaagctgaagacagtgaaggagaactggaagaacctgagtgacagcgagaaggagctgtacatccagcacgccaaggaggatgagacccgctaccacaatgagatgaagtcctgggaggagcagatgattgaggtgggcaggaaggacctgctgcggaggaccatcaagaagcagaggaaatatggagcagaagaatgttag

SEQ ID NO: 173603 - DNA, 1302 bp, Artificial Sequence
  Description of Artificial Sequence: Synthetic coding sequence
atgagcatcctggccaagatgggagactggcaggacagacatgatggcaccagcaatggaacagcccggctgccccagctgggcaccgtgggccagagcccctacaccagcgccccacccctgagccacaccccaaatgctgacttccagcccccctacttccccccaccctaccagcccatctacccccagagccaggacccctacagccacgtgaatgacccctacagcctgaaccccctgcacgcccagccccagccccagcaccctggctggccaggccagaggcagagccaggagagcggcctgctgcacacccaccggggcctgccccaccagctgagcggcctggacccccggcgggactacagaagacatgaggacctgctgcacggcccccacgccctgagcagcggcctgggggacctgagcatccacagcctgccccacgccatcgaggaggtgccccacgtggaggaccccggcatcaacatcccagaccagaccgtcatcaagaagggccctgtgtccctgagcaagagcaacagcaatgctgtgtctgccatccccatcaacaaggacaacctgtttggaggagtggtgaaccccaatgaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgccaacgtgaccctgctgaccagcctggtggagggggaggccgtgcacctggcccgggactttggctacgtgtgtgaaacagagttccctgccaaggctgtggccgagttcctgaaccggcagcacagcgaccccaatgagcaggtgaccaggaagaacatgctgctggccaccaagcagatctgcaaggagttcacagacctgctggcccaggacaggagccccctgggcaacagccggcccaaccccatcctggagcccggcatccagagctgcctgacccacttcaacctgatcagccacggcttcggcagccctgctgtgtgtgccgctgtgacagccctgcagaactacctgacagaggccctgaaggccatggacaagatgtacctgagcaacaaccccaacagccacacagacaacaatgccaagagcagtgacaaggaggagaagcacaggaagtag

SEQ ID NO: 173604 - DNA, 1314 bp, Artificial Sequence
  Description of Artificial Sequence: Synthetic coding sequence
atgctgtggaagctgacagacaacatcaagtatgaggactgtgaagatagacatgatggcaccagcaatggaacagcccggctgccccagctgggcaccgtgggccagagcccctacaccagcgccccacccctgagccacaccccaaatgctgacttccagcccccctacttccccccaccctaccagcccatctacccccagagccaggacccctacagccacgtgaatgacccctacagcctgaaccccctgcacgcccagccccagccccagcaccctggctggccaggccagaggcagagccaggagagcggcctgctgcacacccaccggggcctgccccaccagctgagcggcctggacccccggcgggactacagaagacatgaggacctgctgcacggcccccacgccctgagcagcggcctgggggacctgagcatccacagcctgccccacgccatcgaggaggtgccccacgtggaggaccccggcatcaacatcccagaccagaccgtcatcaagaagggccctgtgtccctgagcaagagcaacagcaatgctgtgtctgccatccccatcaacaaggacaacctgtttggaggagtggtgaaccccaatgaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgccaacgtgaccctgctgaccagcctggtggagggggaggccgtgcacctggcccgggactttggctacgtgtgtgaaacagagttccctgccaaggctgtggccgagttcctgaaccggcagcacagcgaccccaatgagcaggtgaccaggaagaacatgctgctggccaccaagcagatctgcaaggagttcacagacctgctggcccaggacaggagccccctgggcaacagccggcccaaccccatcctggagcccggcatccagagctgcctgacccacttcaacctgatcagccacggcttcggcagccctgctgtgtgtgccgctgtgacagccctgcagaactacctgacagaggccctgaaggccatggacaagatgtacctgagcaacaaccccaacagccacacagacaacaatgccaagagcagtgacaaggaggagaagcacaggaagtag

SEQ ID NO: 173605 - DNA, 1296 bp, Artificial Sequence
  Description of Artificial Sequence: Synthetic coding sequence
atgctggtgcacagcttcagcgccatggacagacatgatggcaccagcaatggaacagcccggctgccccagctgggcaccgtgggccagagcccctacaccagcgccccacccctgagccacaccccaaatgctgacttccagcccccctacttccccccaccctaccagcccatctacccccagagccaggacccctacagccacgtgaatgacccctacagcctgaaccccctgcacgcccagccccagccccagcaccctggctggccaggccagaggcagagccaggagagcggcctgctgcacacccaccggggcctgccccaccagctgagcggcctggacccccggcgggactacagaagacatgaggacctgctgcacggcccccacgccctgagcagcggcctgggggacctgagcatccacagcctgccccacgccatcgaggaggtgccccacgtggaggaccccggcatcaacatcccagaccagaccgtcatcaagaagggccctgtgtccctgagcaagagcaacagcaatgctgtgtctgccatccccatcaacaaggacaacctgtttggaggagtggtgaaccccaatgaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgccaacgtgaccctgctgaccagcctggtggagggggaggccgtgcacctggcccgggactttggctacgtgtgtgaaacagagttccctgccaaggctgtggccgagttcctgaaccggcagcacagcgaccccaatgagcaggtgaccaggaagaacatgctgctggccaccaagcagatctgcaaggagttcacagacctgctggcccaggacaggagccccctgggcaacagccggcccaaccccatcctggagcccggcatccagagctgcctgacccacttcaacctgatcagccacggcttcggcagccctgctgtgtgtgccgctgtgacagccctgcagaactacctgacagaggccctgaaggccatggacaagatgtacctgagcaacaaccccaacagccacacagacaacaatgccaagagcagtgacaaggaggagaagcacaggaagtag

SEQ ID NO: 173606 - DNA, 1320 bp, Artificial Sequence
  Description of Artificial Sequence: Synthetic coding sequence
atgaagatgctgtggaagctgacagacaacatcaagtatgaggactgtgaagatagacatgatggcaccagcaatggaacagcccggctgccccagctgggcaccgtgggccagagcccctacaccagcgccccacccctgagccacaccccaaatgctgacttccagcccccctacttccccccaccctaccagcccatctacccccagagccaggacccctacagccacgtgaatgacccctacagcctgaaccccctgcacgcccagccccagccccagcaccctggctggccaggccagaggcagagccaggagagcggcctgctgcacacccaccggggcctgccccaccagctgagcggcctggacccccggcgggactacagaagacatgaggacctgctgcacggcccccacgccctgagcagcggcctgggggacctgagcatccacagcctgccccacgccatcgaggaggtgccccacgtggaggaccccggcatcaacatcccagaccagaccgtcatcaagaagggccctgtgtccctgagcaagagcaacagcaatgctgtgtctgccatccccatcaacaaggacaacctgtttggaggagtggtgaaccccaatgaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgccaacgtgaccctgctgaccagcctggtggagggggaggccgtgcacctggcccgggactttggctacgtgtgtgaaacagagttccctgccaaggctgtggccgagttcctgaaccggcagcacagcgaccccaatgagcaggtgaccaggaagaacatgctgctggccaccaagcagatctgcaaggagttcacagacctgctggcccaggacaggagccccctgggcaacagccggcccaaccccatcctggagcccggcatccagagctgcctgacccacttcaacctgatcagccacggcttcggcagccctgctgtgtgtgccgctgtgacagccctgcagaactacctgacagaggccctgaaggccatggacaagatgtacctgagcaacaaccccaacagccacacagacaacaatgccaagagcagtgacaaggaggagaagcacaggaagtag

SEQ ID NO: 173607 - DNA, 987 bp, Artificial Sequence
  Description of Artificial Sequence: Synthetic coding sequence
atgctgtggaagctgacagacaacatcaagtatgaggactgtgaagatagacatgatggcaccagcaatggaacagcccggctgccccagctgggcaccgtgggccagagcccctacaccagcgccccacccctgagccacaccccaaatgctgacttccagcccccctacttccccccaccctaccagcccatctacccccagagccaggacccctacagccacgtgaatgacccctacagcctgaaccccctgcacgcccagccccagccccagcaccctggctggccaggccagaggcagagccaggagagcggcctgctgcacacccaccggggcctgccccaccagctgagcggcctggacccccggcgggactacagaagacatgaggacctgctgcacggcccccacgccctgagcagcggcctgggggacctgagcatccacagcctgccccacgccatcgaggaggtgccccacgtggaggaccccggcatcaacatcccagaccagaccgtcatcaagaagggccctgtgtccctgagcaagagcaacagcaatgctgtgtctgccatccccatcaacaaggacaacctgtttggaggagtggtgaaccccaatgaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgccaacgtgaccctgctgaccagcctggtggaggacagatatgccaagagcagccccacctgctggctgaggacagacctgccctggggcacccacggccccacccccagctggagccctgccagcagagctgcctag

SEQ ID NO: 173608 - DNA, 1314 bp, Artificial Sequence; identical to SEQ ID NO: 173604
  Description of Artificial Sequence: Synthetic coding sequence

SEQ ID NO: 173609 - DNA, 1410 bp, Artificial Sequence
  Description of Artificial Sequence: Synthetic coding sequence
atgcacagccccccccgggaccaggccgccatcatgctgtggaagctggtggagaatgtgaagtatgaggacatctatgagatgctggtgcacacctacagctccatggacagacatgatggagtgcccagccacagcagccggctgagccagctgggctctgtgtcccagggcccctacagcagcgccccacccctgagccacacccccagcagtgacttccagcccccctacttccccccaccctaccagcccctgccctaccaccagagccaggacccctacagccacgtgaatgacccctacagcctgaaccccctgcaccagccccagcagcacccctggggccagaggcagaggcaggaggtgggcagcgaggccggcagcctgctgccccagccccgggccgccctgccccagctgagcggcctggacccccggcgggactaccacagcgtgcggcggccagatgtgctgctgcacagcgcccaccacggcctggatgctggcatgggagacagcctgagcctgcacggcctgggccaccctggcatggaggatgtgcagagcgtggaggatgccaacaacagcggcatgaacctgctggaccagagcgtcatcaagaaggtgcctgtgccccccaagtctgtgaccagcctgatgatgaacaaggatggcttcctgggcggcatgtctgtgaacacaggagaggtgttctgcagcgtgcccggccgcctgagcctgctgagcagcaccagcaagtacaaggtgacagtgggggaggtgcagaggcggctgagccccccagagtgcctgaatgccagcctgctgggcggcgtgctgcggcgggccaagagcaagaatggaggccgcagcctgcgggagcggctggagaagattggcctgaacctgcctgctggccgcaggaaggccgccaacgtgaccctgctgaccagcctggtggagggggaggccgtgcacctggcccgggactttggctacatctgtgaaacagagttccctgccaaggctgtgtctgagtacctgaaccggcagcacacagaccccagcgacctgcacagcaggaagaacatgctgctggccaccaagcagctgtgcaaggagttcacagacctgctggcccaggacaggacccccatcggcaacagccggcccagccccatcctggagcccggcatccagagctgcctgacccacttcagcctcatcacccacggctttggagccccagccatctgtgccgccctgacagccctgcagaactacctgacagaggccctgaagggcatggacaagatgttcctgaacaacaccaccaccaacagacacaccagcggggagggccctggcagcaagacaggagacaaggaggagaagcacaggaagtag

SEQ ID NO: 173610 - DNA, 597 bp, Artificial Sequence
  Description of Artificial Sequence: Synthetic coding sequence
atgctgtggaagctggtggagaatgtgaagtatgaggacatctatgagatgctggtgcacacctacagctccatggacagacatgatggagtgcccagccacagcagccggctgagccagctgggctctgtgtcccagggcccctacagcagcgccccacccctgagccacacccccagcagtgacttccagcccccctacttccccccaccctaccagcccctgccctaccaccagagccaggacccctacagccacgtgaatgacccctacagcctgaaccccctgcaccagccccagcagcacccctggggccagaggcagaggcaggaggtgggcagcgaggccggcagcctgctgccccagcccagggctgccctgccccagctgagcggcctggacccccggcgggactaccacagcgtgagaagaccagatgtgctgctgcacagcgcccaccacggcctggatgctggcatgggagacagcctgagcctgcacggcctgggccaccctggcatggaggatgtgcagagcgtggaggatgccaacaacagcggcatgaacctgctggaccagagcgtcatcaagaagtag

SEQ ID NO: 173611 - DNA, 1383 bp, Artificial Sequence
  Description of Artificial Sequence: Synthetic coding sequence
atgcacagccccccccgggaccaggccgccatcatgctgtggaagctggtggagaatgtgaagtatgaggacatctatgaagatagacatgatggagtgcccagccacagcagccggctgagccagctgggctctgtgtcccagggcccctacagcagcgccccacccctgagccacacccccagcagtgacttccagcccccctacttccccccaccctaccagcccctgccctaccaccagagccaggacccctacagccacgtgaatgacccctacagcctgaaccccctgcaccagccccagcagcacccctggggccagaggcagaggcaggaggtgggcagcgaggccggcagcctgctgccccagcccagggctgccctgccccagctgagcggcctggacccccggcgggactaccacagcgtgagaagaccagatgtgctgctgcacagcgcccaccacggcctggatgctggcatgggagacagcctgagcctgcacggcctgggccaccctggcatggaggatgtgcagagcgtggaggatgccaacaacagcggcatgaacctgctggaccagagcgtcatcaagaaggtgcctgtgccccccaagtctgtgaccagcctgatgatgaacaaggatggcttcctgggcggcatgtctgtgaacacaggagaggtgttctgcagcgtgcccggccgcctgagcctgctgagcagcaccagcaagtacaaggtgacagtgggggaggtgcagaggcggctgagccccccagaatgtctgaatgccagcctgctgggcggcgtgctgcggcgggccaagagcaagaatggaggccgcagcctgcgggagcggctggagaagattggcctgaacctgcctgctggaagaaggaaggccgccaacgtgaccctgctgaccagcctggtggagggggaggccgtgcacctggcccgggactttggctacatctgtgaaacagagttccctgccaaggctgtgtctgagtacctgaaccggcagcacacagaccccagcgacctgcacagcaggaagaacatgctgctggccaccaagcagctgtgcaaggagttcacagacctgctggcccaggacaggacccccatcggcaacagccggcccagccccatcctggagcccggcatccagagctgcctgacccacttcagcctcatcacccacggctttggagccccagccatctgtgccgccctgacagccctgcagaactacctgacagaggccctgaagggcatggacaagatgttcctgaacaacaccaccaccaacagacacaccagcggggagggccctggcagcaagacaggagacaaggaggagaagcacaggaagtag

SEQ ID NO: 173612 - DNA, 1359 bp, Artificial Sequence
  Description of Artificial Sequence: Synthetic coding sequence
atgagcaccaccttccctggcctggtgcatgatgctgagatcagacatgatggcagcaacagctaccgcctgatgcagctgggctgcctggagagcgtggccaacagcacagtggcctacagcagcagcagccccctgacctacagcaccactggaacagaatttgccagcccctacttcagcaccaaccaccagtacacccccctgcaccaccagagcttccactatgagttccagcacagccaccctgctgtgaccccagatgcctacagcctgaacagcctgcaccacagccagcagtactaccagcagatccaccacggggagcccacagacttcatcaacctgcacaatgcccgggccctgaagagcagctgcctggatgagcagaggcgggagctgggctgcctggatgcctacagaagacatgacctgagcctgatgagccacggcagccagtatggcatgcacccagaccagaggctgctgcccggccccagcctgggcctggccgctgctggagcagatgacctgcagggctctgtggaggcccagtgtggcctggtgctgaatggccagggcggcgtcatccggcggggcggcacctgtgtggtgaaccccacagacctcttctgcagcgtgcccggccgcctgagcctgctgagcagcaccagcaagtacaaggtgaccatcgccgaggtgaagaggcggctgagccccccagagtgcctgaatgccagcctgctgggcggcatcctgcggcgggccaagagcaagaatggaggccgctgcctgcgggagaagctggaccggctgggcctgaacctgcctgctggccgcaggaaggccgccaacgtgaccctgctgaccagcctggtggagggggaggccctgcacctggcccgggactttggctacacctgtgaaacagagttccctgccaaggctgtgggggagcacctggcccggcagcacatggagcagaaggagcagacagccaggaagaagatgatcctggccaccaagcagatctgcaaggagttccaggacctgctgagccaggacaggagccccctgggcagcagccggcccacccccatcctggacctggacatccagaggcacctgacccacttcagcctcatcacccacggcttcggcaccccagccatctgtgccgccctgagcaccttccagacagtgctgtctgagatgctgaactacctggagaagcacaccacccacaagaatggaggagctgctgacagcggccagggccacgccaacagcgagaaggcccccctgaggaagaccagcgaggccgctgtgaaggagggcaagacagagaagacagactag

SEQ ID NO: 173613 - DNA, 1329 bp, Artificial Sequence
  Description of Artificial Sequence: Synthetic coding sequence
atgctggtgcacacctacagcgccatggagaggccagatggcctgggcgctgctgctggaggagcccggctgagcagcctgccccaggccgcctacggccctgccccacccctgtgccacaccccagctgccacagctgctgctgagttccagcccccctacttccccccaccctacccccagccccccctgccctacggccaggccccagatgctgctgctgccttcccccacctggccggggacccctacggcggcctggcccccctggcccagccccagcccccccaggccgcctgggccgcccccagggctgctgcccgggcccacgaggagcccccaggcctgctggcccccccagcccgggccctgggcctggacccccggcgggactatgccacagctgtgccccggctgctgcacggcctggctgatggagcccacggcctggctgatgcccccctgggcctgcccggcctggccgccgcccctggcctggaggacctgcaggccatggatgagcccggcatgagcctgctggaccagagcgtcatcaagaaggtgcccatccccagcaaggccagcagcctgagcgccctgagcctggccaaggacagcctggtgggcggcatcaccaaccctggagaggtgttctgcagcgtgcccggccgcctgagcctgctgagcagcaccagcaagtacaaggtgacagtgggggaggtgcagaggcggctgagccccccagaatgtctgaatgccagcctgctgggcggcgtgctgcggcgggccaagagcaagaatggaggccgctgcctgcgggagcggctggagaagattggcctgaacctgcctgctggaagaaggaaggccgccaacgtgaccctgctgaccagcctggtggagggggaggccgtgcacctggcccgggactttggctacgtgtgtgaaacagagttccctgccaaggctgctgctgagtacctgtgccggcagcacgccgaccctggagagctgcacagcaggaagtccatgctgctggccgccaagcagatctgcaaggagtttgctgacctgatggcccaggacaggagccccctgggcaacagcaggcctgccctgatcctggagcccggggtgcagagctgcctgacccacttcagcctcatcacccacggctttggaggccctgccatctgtgccgccctgacagccttccagaactacctgctggagagcctgaagggcctggacaagatgttcctgagctctgtgggcagcggccacggggagaccaaggccagcgagaaggatgccaagcacaggaagtag

SEQ ID NO: 173614 - DNA, 1353 bp, Artificial Sequence
  Description of Artificial Sequence: Synthetic coding sequence
atgctgtggaagatcacagacaacgtgaagtatgaggaggactgtgaggacagacatgatggcagcagcaatggaaacccccgggtgccccacctgagcagcgctggccagcacctgtacagccctgccccacccctgagccacactggagtggccgagtaccagcccccaccctacttccccccaccctaccagcagctggcctacagccagagcgctgacccctacagccacctgggggaggcctatgctgctgccatcaaccccctgcaccagcctgcccccaccggcagccagcagcaggcctggccaggccggcagagccaggagggcgccggcctgcccagccaccacggccggcctgctggcctgctgccccacctgagcggcctggaggccggggctgtgtctgccaggagagatgcctaccgccgcagtgacctgctgctgccccacgcccacgccctggatgctgctggcctggccgagaacctgggcctgcatgacatgccccaccagatggatgaggtgcagaatgtggatgaccagcacctgctgctgcatgaccagaccgtcatcaggaagggccccatctccatgaccaagaaccccctgaacctgccctgccagaaggagctggtgggcgctgtgatgaaccccacagaggtgttctgcagcgtgcccggccgcctgagcctgctgagcagcaccagcaagtacaaggtgacagtggccgaggtgcagaggcggctgagccccccagaatgtctgaatgccagcctgctgggcggcgtgctgcggcgggccaagagcaagaatggaggccgcagcctgcgggagaagctggacaagattggcctgaacctgcctgctggaagaaggaaggccgcccacgtgaccctgctgaccagcctggtggagggggaggccgtgcacctggcccgggactttgcctacgtgtgtgaggccgagttccccagcaagcctgtggccgagtacctgacccggccccacctgggcggcagaaatgagatggccgccaggaagaacatgctgctggccgcccagcagctgtgcaaggagttcacagagctgctgagccaggacaggacccctcatggcaccagccggctggcccctgtgctggagaccaacatccagaactgcctgagccacttcagcctcatcacccacggcttcggcagccaggccatctgtgccgctgtgtctgccctgcagaactacatcaaggaggccctgattgtgattgacaagagctacatgaaccctggggaccagagccctgctgacagcaacaagaccctggagaagatggagaagcacaggaagtag

SEQ ID NO: 173615 - DNA, 357 bp, Artificial Sequence
  Description of Artificial Sequence: Synthetic coding sequence
atgttcctgcaggacagacatgatggcagcagcaatggaaacccccgggtgccccacctgagcagcgctggccagcacctgtacagccctgccccacccctgagccacactggagtggccgagtaccagcccccaccctacttccccccaccctaccagcagctggcctacagccagagcgctgacccctacagccacctgggggaggcctatgctgctgccatcaaccccctgcaccagcctgcccccaccggcagccagcagcaggcctggccaggccggcagagccaggagggcgccggcctgcccagccaccacggccggcctgctggcctgctgccccacctgtctggatag

SEQ ID NO: 173616 - DNA, 846 bp, Artificial Sequence
  Description of Artificial Sequence: Synthetic coding sequence
atgccccaccagatggatgaggtgcagaatgtggatgaccagcacctgctgctgcatgaccagaccgtcatcaggaagggccccatctccatgaccaagaaccccctgaacctgccctgccagaaggagctggtgggcgctgtgatgaaccccacagaggtgttctgcagcgtgcccggccgcctgagcctgctgagcagcaccagcaagtacaaggtgacagtggccgaggtgcagaggcggctgagccccccagagtgcctgaatgccagcctgctgggcggcgtgctgcggcgggccaagagcaagaatggaggccgcagcctgcgggagaagctggacaagattggcctgaacctgcctgctggccgcaggaaggccgcccacgtgaccctgctgaccagcctggtggagggggaggccgtgcacctggcccgggactttgcctacgtgtgtgaggccgagttccccagcaagcctgtggccgagtacctgacccggccccacctgggcggcagaaatgagatggccgccaggaagaacatgctgctggccgcccagcagctgtgcaaggagttcacagagctgctgagccaggacaggaccccccacggcaccagccggctggcccctgtgctggagaccaacatccagaactgcctgagccacttcagcctcatcacccacggcttcggcagccaggccatctgtgccgctgtgtctgccctgcagaactacatcaaggaggccctgattgtcatcgacaagagctacatgaaccctggggaccagagccctgctgacagcaacaagaccctggagaagatggagaagcacaggaagtag

SEQ ID NO: 173617 - DNA, 1041 bp, Artificial Sequence
  Description of Artificial Sequence: Synthetic coding sequence
atggccgccagcggcaagctgagcacctgccgcctgccccccctgcccaccatccgggagatcatcaagctgctgcggctgcaggccgccaagcagctgagccagaacttcctgctggacctgcggctgacagacaagatcgtgaggaaggccggcaacctgaccaatgcctacgtgtatgaggtgggccctggccctgggggcatcaccaggagcatcctgaatgctgatgtggccgagctgctggtggtggagaaggacacccgcttcatccctggcctgcagatgctgagtgatgctgcccctgggaagctgagaattgtgcatggagatgtgctgaccttcaaggtggagaaggccttcagcgagagcctgaagaggccctgggaggatgatcctccaaatgtgcacatcatcggcaacctgcccttctctgtgtccacccccctcatcatcaagtggctggagaacatcagctgcagagatggcccctttgtgtatggccgcacccagatgaccctgaccttccagaaggaggtggccgagcggctggccgccaacacaggcagcaagcagaggagccggctgtctgtgatggcccagtacctgtgcaatgtgcgccacatcttcaccatccctggccaggcctttgtgcccaagccagaggtggatgtgggcgtggtgcacttcacccccctcatccagcccaagattgagcagcccttcaagctggtggagaaggtggtgcagaatgtgttccagttccggaggaagtactgccaccggggcctgaggatgctgtttcctgaggcccagaggctggagagcacaggccgcctgctggagctggccgacatcgaccccaccctgcggccccggcagctgagcatcagccacttcaagagcctgtgtgatgtgtacaggaagatgtgtgatgaggacccccagctgtttgcctacaacttccgggaggagctgaagaggaggaagagcaagaatgaggagaaggaggaggatgatgctgagaactaccgcctgtag

SEQ ID NO: 173618 - DNA, 1728 bp, Artificial Sequence
  Description of Artificial Sequence: Synthetic coding sequence
atgagccacgccgctgagcccgccagagatggagtggaggccagcgctgagggccccagggctgtgtttgtgctgctggaggagaggaggcctgctgacagcgcccagctgctgagcctgaacagcctgctgcctgagagcggcatcgtggccgacatcgagctggagaatgtgctggaccctgacagcttctatgagctgaagagccagcccctgcccctgcggagcagcctgcccatcagcctgcaggccaccccagccaccccagccaccctgagcgccagcagcagcgctgggggcagcaggaccccagccatgagcagcagcagcagcagccgggtgctgctgcggcagcagctgatgagggcccaggcccaggagcaggagcggcgggagcggcgggagcaggccgctgctgcccccttccccagccctgccccagccagccctgccatctctgtggtgggcgtgtctgctgggggccacaccctgagcaggcctcctccagcccaggtgccccgggaggtgctgaaggtgcagacccacctggagaaccccacccgctaccacctgcagcaggcccggcggcagcaggtgaagcagtacctgagcaccaccctgggccccaagctggccagccaggccctgaccccacctcctggccctgccagcgcccagcccctgcctgcccctgaggccgcccacaccaccggccccaccggcagcgcccccaacagccccatggccctgctgaccatcggcagcagcagcgagaaggagattgatgatgtgattgatgagatcatcagcctggagagcagctacaatgatgagatgctgagctacctgcccggcggcaccaccggcctgcagctgcccagcaccctgcctgtgtctggcaacctgctggatgtgtacagcagccagggcgtggccaccccagccatcaccgtgagcaacagctgcccagctgagctgcccaacatcaagcgggagatcagcgagacagaggccaaggccctgctgaaggagcggcagaagaaggacaaccacaacctgattgaaagaagaagacgcttcaacatcaatgaccgcatcaaggagctgggcaccctcatccccaagagcagtgaccctgagatgcgctggaacaagggcaccatcctgaaggcctctgtggactacatcaggaagctgcagaaggagcagcagaggagcaaggacctggagagccggcagaggagcctggagcaggccaacagaagcctgcagctgcgcatccaggagctggagctgcaggcccagatccacggcctgcctgtgccccccaccccaggcctgctgagcctggccaccaccagcgccagtgacagcctgaagccagagcagctggacatcgaggaggagggccggcctggggccgccaccttccacgtgggcggcggccctgcccagaatgccccccaccagcagcccccagcccccccatctgatgccctgctggacctgcacttccccagcgaccacctgggggacctgggggaccccttccacctgggcctggaggacatcctgatggaggaggaggagggcgtggtgggcggcctgtctggaggagccctgagccccctgcgggccgccagtgaccccctgctgagctctgtgtccccagctgtgtccaaggccagcagcagaagaagcagcttctccatggaggaggagagctag

SEQ ID NO: 173619 - DNA, 1509 bp, Artificial Sequence
  Description of Artificial Sequence: Synthetic coding sequence
atggcctgggccctgaagctgcccctggctgatgaagtcatcgagagcggcctggtgcaggactttgatgccagcctgtctggaattggccaggagctgggcgctggggcctacagcatgtctgatgtgctggccctgcccatcttcaagcaggaggagagcagcctgcccccagacaatgaaaacaagatcctgcccttccagtatgtgctgtgtgccgccaccagccctgctgtgaagctgcatgatgagaccctgacctacctgaaccagggccagagctatgagatccgcatgctggacaacaggaagctgggggagctgcctgagatcaacgggaagctggtgaagagcatcttccgggtggtgttccatgaccggcggctgcagtacacagagcaccagcagctggagggctggcgctggaacagacctggggaccgcatcctggacatcgacatccccatgtctgtgggcatcatcgacccccgggccaaccccacccagctgaacacagtggagttcctgtgggaccctgccaagaggaccagcgtcttcatccaggtgcactgcatcagcacagagttcaccatgaggaagcatggaggagagaagggcgtgcccttccgggtgcagattgacaccttcaaggaaaatgaaaatggagagtacacagagcacctgcacagcgccagctgccagatcaaggtgttcaagcccaagggagctgacaggaagcagaagacagaccgggagaagatggagaagaggacccctcatgagaaggagaagtaccagcccagctatgagaccaccatcctgacagagtgcagcccctggccagagatcacctacgtgaacaacagccccagccctggcttcaacagcagccacagcagcttcagcctgggggagggcaatggcagccccaaccaccagcctgagcccccacctcctgtgacagacaacctgctgcccaccaccaccccccaggaggcccagcagtggctgcacaggaaccgcttcagcaccttcaccaggctcttcaccaacttctctggagctgacctgctgaagctgaccagagatgatgtgatccagatctgtggccctgcagatggcatccgcctcttcaatgccctgaagggccgcatggtgcggccccggctgaccatctacgtgtgccaggagagcctgcagctgcgggagcagcagcagcagcagcagcagcagcagcagaagcatgaagatggagacagcaatggcaccttctttgtgtaccacgccatctacctggaggagctgacagctgtggagctgacagagaagatcgcccagctgttcagcatcagcccctgccagatcagccagatctacaagcagggccccaccggcatccacgtgctgatcagtgatgagatgatccagaacttccaggaggaggcctgcttcatcctggacaccatgaaggccgagaccaatgacagctaccacatcatcctgaagtag

SEQ ID NO: 173620 - DNA, 1356 bp, Artificial Sequence
  Description of Artificial Sequence: Synthetic coding sequence
atggcctgggccctgaagctgcccctggctgatgaagtcatcgagagcggcctggtgcaggactttgatgccagcctgtctggaattggccaggagctgggcgctggggcctacagcatgtctgatgtgctggccctgcccatcttcaagcaggaggagagcagcctgcccccagacaatgaaaacaagatcctgcccttccagtatgtgctgtgtgccgccaccagccctgctgtgaagctgcatgatgagaccctgacctacctgaaccagggccagagctatgagatccgcatgctggacaacaggaagctgggggagctgcctgagatcaacgggaagctggtgaagagcatcttccgggtggtgttccatgaccggcggctgcagtacacagagcaccagcagctggagggctggcgctggaacagacctggggaccgcatcctggacatcgacatccccatgtctgtgggcatcatcgacccccgggccaaccccacccagctgaacacagtggagttcctgtgggaccctgccaagaggaccagcgtcttcatccagcccaagggagctgacaggaagcagaagacagaccgggagaagatggagaagaggacccctcatgagaaggagaagtaccagcccagctatgagaccaccatcctgacagaatgtagcccctggccagagatcacctacgtgaacaacagccccagccctggcttcaacagcagccacagcagcttcagcctgggggagggcaatggcagccccaaccaccagcctgagcccccacctcctgtgacagacaacctgctgcccaccaccaccccccaggaggcccagcagtggctgcacaggaaccgcttcagcaccttcaccaggctcttcaccaacttcagcggggctgacctgctgaagctgaccagagatgatgtgatccagatctgtggccctgcagatggcatccgcctcttcaatgccctgaagggccgcatggtgcggccccggctgaccatctacgtgtgccaggagagcctgcagctgcgggagcagcagcagcagcagcagcagcagcagcagaagcatgaagatggagacagcaatggcaccttctttgtgtaccacgccatctacctggaggagctgacagctgtggagctgacagagaagatcgcccagctgttcagcatcagcccctgccagatcagccagatctacaagcagggccccaccggcatccacgtgctgatcagtgatgagatgatccagaacttccaggaggaggcctgcttcatcctggacaccatgaaggccgagaccaatgacagctaccacatcatcctgaagtag

SEQ ID NO: 173621 - DNA, 1353 bp, Artificial Sequence
  Description of Artificial Sequence: Synthetic coding sequence
atggcctgggccctgaagctgcccctggctgatgaagtcatcgagagcggcctggtgcaggactttgatgccagcctgtctggaattggccaggagctgggcgctggggcctacagcatgtctgatgtgctggccctgcccatcttcaagcaggaggagagcagcctgcccccagacaatgaaaacaagatcctgcccttccagtatgtgctgtgtgccgccaccagccctgctgtgaagctgcatgatgagaccctgacctacctgaaccagggccagagctatgagatccgcatgctggacaacaggaagctgggggagctgcctgagatcaacgggaagctggtgaagagcatcttccgggtggtgttccatgaccggcggctgcagtacacagagcaccagcagctggagggctggcgctggaacagacctggggaccgcatcctggacatcgacatccccatgtctgtgggcatcatcgacccccgggccaaccccacccagctgaacacagtggagttcctgtgggaccctgccaagaggaccagcgtcttcatccagcccaagggagctgacaggaagcagaagacagaccgggagaagatggagaagaggacccctcatgagaaggagaagtaccagcccagctatgagaccaccatcctgacagaatgtagcccctggccagagatcacctacgtgaacaacagccccagccctggcttcaacagcagccacagcagcttcagcctgggggagggcaatggcagccccaaccaccagcctgagcccccacctcctgtgacagacaacctgctgcccaccaccaccccccaggaggcccagcagtggctgcacaggaaccgcttcagcaccttcaccaggctcttcaccaacttcagcggggctgacctgctgaagctgaccagagatgatgtgatccagatctgtggccctgcagatggcatccgcctcttcaatgccctgaagggccgcatggtgcggccccggctgaccatctacgtgtgccaggagagcctgcagctgcgggagcagcagcagcagcagcagcagcagcagcagaagcatgaagatggagacagcaatggcaccttctttgtgtaccacgccatctacctggaggagctgacagctgtggagctgacagagaagatcgcccagctgttcagcatcagcccctgccagatcagccagatctacaagcagggccccaccggcatccacgtgctgatcagtgatgagatgatccagaacttccaggaggaggcctgcttcatcctggacaccatgaaggagaccaatgacagctaccacatcatcctgaagtag

SEQ ID NO: 173622 - DNA, 1440 bp, Artificial Sequence
  Description of Artificial Sequence: Synthetic coding sequence
atgctgttctggcacacccagcctgagcactacaaccagcacaacagcggcagctacctgagagatgtgctggccctgcccatcttcaagcaggaggagccccagctgagcccagaaaatgaggcccggctgccccccctgcagtatgtgctgtgtgccgccaccagccctgctgtgaagctgcacgaggagaccctgacctacctgaaccagggccagagctatgagatccggctgctggagaacaggaagctgggggacttccaggacctgaacaccaagtatgtgaagagcatcatccgggtggtgttccatgaccggcggctgcagtacacagagcaccagcagctggagggctggcgctggagcaggcctggggaccgcatcctggacatcgacatccccctgtctgtgggcatcctggacccccgggccagccccacccagctgaatgctgtggagttcctgtgggaccctgccaagagggccagcgccttcatccaggtgcactgcatcagcacagagttcacccccaggaagcatggaggagagaagggcgtgcccttccgggtgcagattgacaccttcaagcagaatgaaaatggagagtacacagagcacctgcacagcgccagctgccagatcaaggtgttcaagcccaagggagctgacaggaagcagaagacagaccgggagaagatggagaagaggacagcccaggagaaggagaagtaccagcccagctatgagaccaccatcctgacagagtgcagcccctggccagatgtggcctaccaggtgaacagcgcccccagccccagctacaacggcagccccaacagctttggcctgggggagggcaatgccagccccacccaccctgtggaggccctgcctgtgggcagtgaccacctgctgcccagcgccagcatccaggatgcccagcagtggctgcacaggaaccgcttcagccagttctgccgcctgtttgccagcttcagcggggctgacctgctgaagatgagcagagatgacctggtgcagatctgtggccctgcagatggcatccgcctcttcaatgccatcaagggcagaaatgtgcggcccaagatgaccatctacgtgtgccaggagctggagcagaacagagtgcccctgcagcagaagagagatggcagcggggacagcaacctgtctgtgtaccacgccatcttcctggaggagctgaccaccctggagctgattgagaagatcgccaacctgtacagcatcagcccccagcacatccaccgggtgtaccggcagggccccaccggcatccacgtggtggtgtccaatgagatggtgcagaacttccaggatgagagctgctttgtgctgagcaccatcaaggccgagagcaatgatggctaccacatcatcctgaagtgtggcctgtag

SEQ ID NO: 173623 - DNA, 99 bp, Artificial Sequence
  Description of Artificial Sequence: Synthetic coding sequence
atggtgcagaacttccaggatgagagctgctttgtgctgagcaccatcaaggccgagagcaatgatggctaccacatcatcctgaagtgtggcctgtag

SEQ ID NO: 173624 - DNA, 1218 bp, Artificial Sequence
  Description of Artificial Sequence: Synthetic coding sequence
atggccaagtatgtgtccctgacagaggccaatgaggagctgaaggtgctgatggatgagaaccagaccagcaggcctgtggccgtgcacaccagcacagtgaaccccctgggcaagcagctgctgcccaagaccttcggccagagctctgtgaacatcgaccagcaggtggtgattggcatgccccagaggcctgctgccagcaacatccctgtggtgggcagccccaacccccccagcacccactttgccagccagaaccagcacagctacagcagccccccctgggccggccagcacaacagaaaaggagagaagaatggcatgggcctgtgccgcctgtccatgaaggtgtgggagaccgtgcagaggaagggcaccaccagctgccaggaggtggtgggggagctggtggccaagttccgggccgccagcaaccacgccagccccaatgaaagtgcctatgatgtgaagaacatcaagaggaggacctatgatgccctgaatgtgctgatggccatgaacatcatcagccgggagaagaagaagatcaagtggattggcctgaccaccaacagcgcccagaactgccagaacctgcgggtggagcggcagaagaggctggagcgcatcaagcagaagcagagcgagctgcagcagctgatcctgcagcagatcgccttcaagaacctggtgctgaggaaccagtatgtggaggagcaggtgtcccagaggcccctgcccaacagcgtcatccacgtgcccttcatcatcatcagcagcagcaagaagacagtcatcaactgcagcatcagtgatgacaagtctgagtacctgttcaagttcaacagcagctttgagatccatgatgacacagaggtgctgatgtggatgggcatgaccttcggcctggagagcggcagctgcagcgctgaggacctgaagatggccaggaacctggtgcccaaggccctggagccctacgtgacagagatggcccagggcacctttggaggagtcttcaccacagctggcagccgcagcaatggcacctggctgagcgccagtgacctgaccaacatcgccatcggcatgctggccaccagcagcggcggcagccagtacagcggcagccgggtggagaccccagctgtggaggaggaggaggaggaggacaacaatgatgatgacctgtctgaaaatgatgaagatgactag

SEQ ID NO: 173625 - DNA, 2649 bp, Artificial Sequence
  Description of Artificial Sequence: Synthetic coding sequence
atggagggggagagcagcagatttgagatccacacccctgtgtctgacaagaagaagaagaagtgcagcatccacaaggagcggccccagaagcacagccatgagatcttccgggacagcagcctggtgaatgagcagagccagatcaccaggaggaagaagaggaagaaggacttccagcacctgatcagcagccccctgaagaagagccgcatctgtgatgaaacagccaatgccaccagcaccctgaagaagaggaagaagaggcgctacagcgccctggaggtggatgaggaggccggcgtgacagtggtgctggtggacaaggagaacatcaacaacacccccaagcacttcaggaaggatgtggatgtggtgtgtgtggacatgagcattgagcagaagctgcccaggaagcccaagacagacaagttccaggtgctggccaagagccacgcccacaagtctgaggccctgcacagcaaggtgcgggagaagaagaacaagaagcaccagaggaaggccgcctcctgggagagccagagggcccgggacaccctgccccagagcgagagccaccaggaggagagctggctgtctgtgggccctggaggagagatcacagagctgcctgccagcgcccacaagaacaagagcaagaagaagaagaagaagagcagcaaccgggagtatgagaccctggccatgcctgagggcagccaggccggccgggaggccggcacagacatgcaggagagccagcccaccgtgggcctggatgatgagaccccccagctgctgggccccacccacaagaagaagagcaagaagaagaagaagaagaagagcaaccaccaggagtttgaggccctggccatgcctgagggcagccaggtgggcagcgaggtgggcgctgacatgcaggagagcaggcctgctgtgggcctgcatggagaaacagctggcatcccagccccagcctacaagaacaagagcaagaagaagaagaagaagagcaaccaccaggagtttgaggccgtggccatgcctgagagcctggagagcgcctacccagagggcagccaggtgggcagcgaggtgggcaccgtggagggcagcacagccctgaagggcttcaaggagagcaacagcaccaagaagaagagcaagaagaggaagctgacctctgtgaagagggcccgggtgtctggagatgacttctctgtgcccagcaagaacagcgagagcaccctgtttgattctgtggagggagatggagccatgatggaggagggcgtgaagagccggccccggcagaagaagacccaggcctgcctggccagcaagcacgtgcaggaggccccccggctggagcccgccaatgaggagcacaacgtggagacagctgaggacagcgagatccgctacctgtctgctgacagcggagatgctgatgacagtgatgctgacctgggcagcgctgtgaagcagctgcaggagttcatccccaacatcaaggaccgggccaccagcaccatcaagaggatgtacagagatgacctggagcgcttcaaggagttcaaggcccagggcgtggccatcaagtttgggaagttctctgtgaaggagaacaagcagctggagaagaatgtggaggacttcctggccctgaccggcatcgagagcgctgacaagctgctgtacacagaccgctacccagaggagaagagcgtcatcaccaacctgaagaggcgctacagcttccggctgcacatcggcaggaacatcgcccggccctggaagctgatctactaccgggccaagaagatgtttgatgtgaacaactacaagggccgctacagcgagggggacacagagaagctgaagatgtaccacagcctgctgggcaatgactggaagaccatcggggagatggtggcccggagcagcctgtctgtggccctgaagttcagccagatcagcagccagaggaacagaggagcctggagcaagtctgagaccaggaagctgatcaaggctgtggaggaggtgatcctgaagaagatgagcccccaggagctgaaggaggtggacagcaagctgcaggagaaccctgagagctgcctgagcatcgtgcgggagaagctgtacaagggcatctcctgggtggaggtggaggccaaggtgcagaccaggaactggatgcagtgcaagagcaagtggacagagatcctgaccaagaggatgaccaatggaagacgcatctactacggcatgaatgccctgcgggccaaggtgtccctgattgagcggctgtatgagatcaacgtggaggacaccaatgaaattgactgggaggacctggccagcgccatcggagatgtgccccccagctatgtgcagaccaagttcagccggctgaaggctgtgtatgtgcccttctggcagaagaagaccttccctgagatcatcgactacctgtatgagaccaccctgcccctgctgaaggagaagctggagaagatgatggagaagaagggcaccaagatccagaccccagctgcccccaagcaggtgttccccttccgggacatcttctactatgaagatgacagcgagggcggccacaggaagaggaagagaagatag

SEQ ID NO: 173626 - DNA, 2718 bp, Artificial Sequence
  Description of Artificial Sequence: Synthetic coding sequence
atggagggggagagcagcagatttgagatccacacccctgtgtctgacaagaagaagaagaagtgcagcatccacaaggagcggccccagaagcacagccatgagatcttccgggacagcagcctggtgaatgagcagagccagatcaccaggaggaagaagaggaagaaggacttccagcacctgatcagcagccccctgaagaagagccgcatctgtgatgaaacagccaatgccaccagcaccctgaagaagaggaagaagaggcgctacagcgccctggaggtggatgaggaggccggcgtgacagtggtgctggtggacaaggagaacatcaacaacacccccaagcacttcaggaaggatgtggatgtggtgtgtgtggacatgagcattgagcagaagctgcccaggaagcccaagacagacaagttccaggtgctggccaagagccacgcccacaagtctgaggccctgcacagcaaggtgcgggagaagaagaacaagaagcaccagaggaaggccgcctcctgggagagccagagggcccgggacaccctgccccagagcgagagccaccaggaggagagctggctgtctgtgggccctggaggagagatcacagagctgcctgccagcgcccacaagaacaagagcaagaagaagaagaagaagagcagcaaccgggagtatgagaccctggccatgcctgagggcagccaggccggccgggaggccggcacagacatgcaggagagccagcccaccgtgggcctggatgatgagaccccccagctgctgggccccacccacaagaagaagagcaagaagaagaagaagaagaagagcaaccaccaggagtttgaggccctggccatgcctgagggcagccaggtgggcagcgaggtgggcgctgacatgcaggagagcaggcctgctgtgggcctgcatggagaaacagctggcatcccagccccagcctacaagaacaagagcaagaagaagaagaagaagagcaaccaccaggagtttgaggccgtggccatgcctgagagcctggagagcgcctacccagagggcagccaggtgggcagcgaggtgggcaccgtggagggcagcacagccctgaagggcttcaaggagagcaacagcaccaagaagaagagcaagaagaggaagctgacctctgtgaagagggcccgggtgtctggagatgacttctctgtgcccagcaagaacagcgagagcaccctgtttgattctgtggagggagatggagccatgatggaggagggcgtgaagagccggccccggcagaagaagacccaggcctgcctggccagcaagcacgtgcaggaggccccccggctggagcccgccaatgaggagcacaacgtggagacagctgaggacagcgagatccgctacctgtctgctgacagcggagatgctgatgacagtgatgctgacctgggcagcgctgtgaagcagctgcaggagttcatccccaacatcaaggaccgggccaccagcaccatcaagaggatgtacagagatgacctggagcgcttcaaggagttcaaggcccagggcgtggccatcaagtttgggaagttctctgtgaaggagaacaagcagctggagaagaatgtggaggacttcctggccctgaccggcatcgagagcgctgacaagctgctgtacacagaccgctacccagaggagaagagcgtcatcaccaacctgaagaggcgctacagcttccggctgcacatcggcaggaacatcgcccggccctggaagctgatctactaccgggccaagaagatgtttgatgtgaacaactacaagggccgctacagcgagggggacacagagaagctgaagatgtaccacagcctgctgggcaatgactggaagaccatcggggagatggtggcccggagcagcctgtctgtggccctgaagttcagccagatcagcagccagaggaacagaggagcctggagcaagtctgagaccaggaagctgatcaaggctgtggaggaggtgatcctgaagaagatgagcccccaggagctgaaggaggtggacagcaagctgcaggagaaccctgagagctgcctgagcatcgtgcgggagaagctgtacaagggcatctcctgggtggaggtggaggccaaggtgcagaccaggaactggatgcagtgcaagagcaagtggacagagatcctgaccaagaggatgaccaatggaagacgcatctactacggcatgaatgccctgcgggccaaggtgtccctgattgagcggctgtatgagatcaacgtggaggacaccaatgaaattgactgggaggacctggccagcgccatcggagatgtgccccccagctatgtgcagaccaagttcagccggctgaaggctgtgtatgtgcccttctggcagaagaagaccttccctgagatcatcgactacctgtatgagaccaccctgcccctgctgaaggagaagctggagaagatgatggagaagaagggcaccaagatccagaccccagctgcccccaagcaggtgttccccttccgggacatcttctactatgaagatgacagtgaaggagaagatattgagaaggagagcgagggccaggccccctgcatggcccacgcctgcaacagcagcaccctgggcggccagggccgctggatcatctag

SEQ ID NO: 173627 - DNA, 3489 bp, Artificial Sequence
  Description of Artificial Sequence: Synthetic coding sequence
atggaggaggtgcgctgcccagagcacggcaccttctgcttcctgaagacaggagtgagagatggccccaacaagggcaagagcttctacgtgtgcagagctgacacctgcagctttgtgcgggccacagacatccctgtgagccactgcctgctgcacgaggactttgtggtggagctgcagggcctgctgctgccccaggacaagaaggagtaccgcctcttcttccgctgcatccgcagcaaggccgagggcaagcgctggtgtggcagcatcccctggcaggaccctgacagcaaggagcacagcgtgagcaacaagagccagcacgccagcgagaccttccaccacagcagcaactggctgaggaaccccttcaaggtgctggacaagaaccaggagcccgccctgtggaagcagctgatcaagggggagggggaggagaagaaggctgacaagaagcagcgggagaagggggaccagctgtttgaccagaagaaggagcagaagccagagatgatggagaaggacctgagcagcggcctggtgcccaagaagaagcagagcgtggtgcaggagaagaagcaggaggagggcgctgagatccagtgtgaggccgagaccggcggcacccacaagagggacttcagcgagatcaagagccagcagtgccagggcaatgagctgacccggcccagcgccagcagccaggagaagagcagcggcaagagccaggatgtgcagcgggagagcgagcccctgcgggagaaggtgacccagctgctgccccagaatgtgcacagccacaacagcatcagcaagccccagaagggcggccccctgaacaaggagtacaccaactgggaggccaaggagaccaaggccaaggatggccccagcatccaggccacccagaagagcctgccccagggccacttccaggagaggcctgagacccacagcgtgcctgcccctgggggccctgctgcccaggccgccccagctgcccctggcctgagcctgggggagggccgggaggccgccaccagcagtgatgatgaggaggaggatgatgtggtgtttgtgagcagcaagccaggcagccccctgctgtttgacagcaccctggacctggagaccaaggagaacctgcagttcccagacagatctgtgcagaggaaggtgtccccagccagcggcgtgtccaagaaggtggagcccagcgaccctgtggccaggagagtgtacctgaccacccagctgaagcagaagaagagcaccctggcctctgtgaacatccaggccctgcctgacaagggccagaagctgatcaagcagatccaggagctggaggaggtgctgagcggcctgaccctgagccctgagcagggcaccaatgagaagagcaacagccaggtgccccagcagagccacttcaccaagaccaccaccggccccccccacctggtgcccccccagcccctgccccggcggggcacccagcctgtgggcagcctggagctgaagagcgcctgccaggtgacagctgggggcagcagccagtgctaccggggccacaccaaccaggaccacgtgcatgctgtgtggaagatcaccagcgaggccatcggccagctgcacaggagcctggagagctgccctggagaaacagtggtggctgaagatcctgctggcctgaaggtgcccctgctgctgcaccagaagcaggccctggcctggctgctgtggagggagagccagaagccccagggcggcatcctggctgatgacatgggcctgggcaagaccctgaccatgattgccctgatcctgacccagaagaaccaggagaagaaggaggagaaggagaagagcacagccctgacctggctgagcaaggatgacagctgtgacttcaccagccacggcaccctcatcatctgcccagccagcctcatccaccactggaagaatgaggtggagaagagggtgaacagcaacaagctgcgggtgtacctgtaccacggccccaacagagacagccgggcccgggtgctgagcacctatgacatcgtcatcaccacctacagcctggtggccaaggagatccccaccaacaagcaggaggccgagatccctggggccaacctgaatgtggagggcaccagcacccccctgctgagaattgcctgggcccgcatcatcctggatgaggcccacaacgtgaagaacccccgggtgcagaccagcattgctgtgtgcaagctgcaggcctgtgcccgctgggccgtgacaggcacccccatccagaacaacctgctggacatgtacagcctgctgaagttcctgcgctgcagcccctttgatgagttcaacctgtggaggagccaggtggacaatggcagcaagaagggcggggagcggctgagcatcctgaccaagagcctgctgctgcggaggaccaaggaccagctggacagcacaggccggcccctggtgatcctgccccagaggaagttccagctgcaccacctgaagctgtctgaagatgaggagaccgtgtacaacgtgttctttgcccggagccgcagcgccctgcagagctacctgaagagacatgagagccggggcaaccagagcggccgcagccccaacaaccccttcagccgggtggccctggagtttggaagtgaggagcccaggcacagcgaggccgctgacagccccaggagcagcacagtgcacatcctgagccagctgctgcggctgcggcagtgctgctgccacctgagcctgctgaagagcgccctggaccccatggagctgaagggggagggcctggtgctgagcctggaggagcagctgagcgccctgaccctgtctgagctgcgggacagcgagcccagcagcacagtgtccctgaatggcaccttcttcaagatggagctgtttgagggcatgagggagagcaccaagatcagcagcctgctggccgagctggaggccatccagagaaattctgccagccagaagagcgtcatcgtgtcccagtggaccaacatgctgaaggtggtggccctgcacctgaagaagcacggcctgacctacgccaccattgatggctctgtgaaccccaagcagaggatggacctggtggaggccttcaaccacagccggggcccccaggtgatgctgatcagcctgctggccggcggcgtgggcctgaacctgaccggcggcaaccacctgttcctgctggacatgcactggaaccccagcctggaggaccaggcctgtgaccgcatctacagagtgggccagcagaaggatgtggtgatccacagatttgtgtgtgagggcaccgtggaggagaagatcctgcagctgcaggagaagaagaaggacctggccaagcaggtgctgagcggcagcggggagagcgtgaccaagctgaccctggccgacctgcgggtgctgtttggcatctag

SEQ ID NO: 173628 - DNA, 432 bp, Artificial Sequence
  Description of Artificial Sequence: Synthetic coding sequence
aacatgctgaaggtggtggccctgcacctgaagaagcacggcctgacctacgccaccattgatggctctgtgaaccccaagcagaggatggacctggtggaggccttcaaccacagccggggcccccaggtgatgctgatcagcctgctggccggcggcgtgggcctgaacctgactggaggcaaccacctgttcctgctggacatgcactggaaccccagcctggaggaccaggcctgtgaccgcatctacagagtgggccagcagaaggatgtggtgatccacagatttgtgtgtgagggcaccgtggaggagaagatcctgcagctgcaggagaagaagaaggacctggccaagcaggtgctgagcggcagcggggagagcgtgaccaagctgaccctggccgacctgcgggtgctgtttggcatctag

SEQ ID NO: 173629 - DNA, 1263 bp, Artificial Sequence
  Description of Artificial Sequence: Synthetic coding sequence
atggccgagctgggcaagaagtactgtgtgtactgcctggccgaggtgagccccctgcgcttccgctgcacagagtgccaggacatcgagctgtgcccagagtgcttctctgctggagctgagatcggccaccaccggcgctaccacggctaccagctggtggatggcggccgcttcaccctgtggggccctgaggccgagggcggctggaccagccgggaggagcagctgctgctggatgccatcgagcagtttggatttggaaactgggaggacatggccgcccacgtgggcgccagcaggaccccccaggaggtgatggagcactacgtgtccatgtacatccacggcaacctgggcaaggcctgcatcccagacaccatccccaacagagtgacagaccacacctgccccagcggcggccccctgagccccagcctgaccacccccctgccccccctggacatctctgtggccgagcagcagcagctgggctacatgcccctgagagatgattatgaaattgaatatgaccaggatgctgagaccctcatcagcggcctgtctgtgaactatgatgatgatgatgtggagattgagctgaagagggcccacgtggacatgtatgtgaggaagctgaaggagcggcagaggaggaagaacatcgcccgggactacaacctggtgcctgccttcctgggcaaggacaagaaggagaaggagaaggccctgaagaggaagatcaccaaggaggagaaggagctgcggctgaagctgcggcccctgtaccagttcatgagctgcaaggagtttgatgacctgtttgagaacatgcacaaggagaagatgctgcgggccaagatccgggagctgcagcgctacagaagaaatggcatcaccaagatggaggagagcgcagaatatgaggccgcccggcacaagcgggagaagaggaaggagaacaagaacctggccggcagcaagaggggcaaggaggatggcaaggacagcgagtttgctgccatcgagaacctgcccggctttgagctgctgagtgaccgggagaaggtgctgtgcagcagcctgaacctgagccctgcccgctacgtgacagtgaagaccatcatcatcaaggaccacctgcagaagaggcagggcatccccagcaagagccggctgcccagctacctggacaaggtgctgaagaagaggatcctgaacttcctgacagagagcggctggatcagcagagatgccagctag

SEQ ID NO: 173630 - DNA, 366 bp, Artificial Sequence
  Description of Artificial Sequence: Synthetic coding sequence
atggccgcccacgtgggcgccagcaggaccccccaggaggtgatggagcactacgtgtccatgtacatccacggcaacctgggcaaggcctgcatcccagacaccatccccaacagagtgacagaccacacctgccccagcggcggccccctgagccccagcctgaccacccccctgccccccctggacatctctgtggccgagcagcagcagctgggctacatgcccctgagagatgattatgaaattgaatatgaccaggatgctgagaccctcatcagcggcctgtctgtgaactatgatgatgatgatgtggagattgagctgaagagggcccacgtggacatgtatgtgaggaagctgtag

SEQ ID NO: 173631 - DNA, 390 bp, Artificial Sequence
  Description of Artificial Sequence: Synthetic coding sequence
atggccgcccacgtgggcgccagcaggaccccccaggaggtgatggagcactacgtgtccatgtacatccacggcaacctgggcaaggcctgcatcccagacaccatccccaacagagtgacagaccacacctgccccagcggcggccccctgagccccagcctgaccacccccctgccccccctggacatctctgtggccgagcagcagcagctgggctacatgcccctgagagatgattatgaaattgaatatgaccaggatgctgagaccctcatcagcggcctgtctgtgaactatgatgatgatgatgtggagattgagctgaagagggcccacgtggacatgtatgtgaggaagctgaaggagcggcagaggaggaagaactag

SEQ ID NO: 173632 - DNA, 1038 bp, Artificial Sequence
  Description of Artificial Sequence: Synthetic coding sequence
atggccgagctgggcaagaagtactgtgtgtactgcctggccgaggaggacatggccgcccacgtgggcgccagcaggaccccccaggaggtgatggagcactacgtgtccatgtacatccacggcaacctgggcaaggcctgcatcccagacaccatccccaacagagtgacagaccacacctgccccagcggcggccccctgagccccagcctgaccacccccctgccccccctggacatctctgtggccgagcagcagcagctgggctacatgcccctgagagatgattatgaaattgaatatgaccaggatgctgagaccctcatcagcggcctgtctgtgaactatgatgatgatgatgtggagattgagctgaagagggcccacgtggacatgtatgtgaggaagctgaaggagcggcagaggaggaagaacatcgcccgggactacaacctggtgcctgccttcctgggcaaggacaagaaggagaaggagaaggccctgaagaggaagatcaccaaggaggagaaggagctgcggctgaagctgcggcccctgtaccagttcatgagctgcaaggagtttgatgacctgtttgagaacatgcacaaggagaagatgctgcgggccaagatccgggagctgcagcgctacagaagaaatggcatcaccaagatggaggagagcgcagaatatgaagctgcccggcacaagcgggagaagaggaaagaaaacaagaacctggccggcagcaagaggggcaaggaggatggcaaggacagcgagtttgctgccatcgagaacctgcccggctttgagctgctgagtgaccgggagaaggtgctgtgcagcagcctgaacctgagccctgcccgctacgtgacagtgaagaccatcatcatcaaggaccacctgcagaagaggcagggcatccccagcaagagccggctgcccagctacctggacaaggtgctgaagaagaggatcctgaacttcctgacagaaagtggctggatcagcagagatgccagctag

SEQ ID NO: 173633 - DNA, 987 bp, Artificial Sequence
  Description of Artificial Sequence: Synthetic coding sequence
atggccgcccacgtgggcgccagcaggaccccccaggaggtgatggagcactacgtgtccatgtacatccacggcaacctgggcaaggcctgcatcccagacaccatccccaacagagtgacagaccacacctgccccagcggcggccccctgagccccagcctgaccacccccctgccccccctggacatctctgtggccgagcagcagcagctgggctacatgcccctgagagatgattatgaaattgaatatgaccaggatgctgagaccctcatcagcggcctgtctgtgaactatgatgatgatgatgtggagattgagctgaagagggcccacgtggacatgtatgtgaggaagctgaaggagcggcagaggaggaagaacatcgcccgggactacaacctggtgcctgccttcctgggcaaggacaagaaggagaaggagaaggccctgaagaggaagatcaccaaggaggagaaggagctgcggctgaagctgcggcccctgtaccagttcatgagctgcaaggagtttgatgacctgtttgagaacatgcacaaggagaagatgctgcgggccaagatccgggagctgcagcgctacagaagaaatggcatcaccaagatggaggagagcgcagaatatgaggccgcccggcacaagcgggagaagaggaaggagaacaagaacctggccggcagcaagaggggcaaggaggatggcaaggacagcgagtttgctgccatcgagaacctgcccggctttgagctgctgagtgaccgggagaaggtgctgtgcagcagcctgaacctgagccctgcccgctacgtgacagtgaagaccatcatcatcaaggaccacctgcagaagaggcagggcatccccagcaagagccggctgcccagctacctggacaaggtgctgaagaagaggatcctgaacttcctgacagagagcggctggatcagcagagatgccagctag

SEQ ID NO: 173634 - DNA, 1299 bp, Artificial Sequence
  Description of Artificial Sequence: Synthetic coding sequence
atgtctgagctgaaggactgccccctgcagttccatgacttcaagtctgtggaccacctgaaggtgtgcccccgctacacagctgtgctggcccggagtgaagatgatggcatcggcatcgaggagctggacaccctgcagctggagctggagaccctgctgagcagcgccagccggcggctgcgggtgctggaggccgagacccagatcctgacagactggcaggacaagaagggggaccggcgcttcctgaagctgggccgggaccacgagctgggcgccccacccaagcacggcaagcccaagaagcagaagctggagggcaaggccggccacggccctggccctggccctggccggcccaagagcaagaacctgcagcccaagatccaggagtatgagttcacagatgaccccattgatgtgccccgcatccccaagaatgatgcccccaaccgcttctgggcctctgtggagccctactgtgccgacatcaccagcgaggaggtgaggaccctggaggagctgctgaagcccccagaagatgaggccgagcactacaagatcccccccctgggcaagcactacagccagcgctgggcccaggaggacctgctggaggagcagaaggatggagcccgggctgctgctgtggccgacaagaagaagggcctgatgggccccctgacagagctggacaccaaggatgtggatgccctgctgaagaagtctgaggcccagcacgagcagccagaagatggctgcccctttggagccctgacccagaggctgctgcaggccctggtggaggagaacatcatcagccccatggaggacagccccatcccagacatgtctgggaaggagagcggggctgatggagccagcaccagccccaggaaccagaacaagcccttctctgtgccccacaccaagagcctggagagccgcatcaaggaggagctgattgcccagggcctgctggagagtgaagatagacctgctgaggacagtgaagatgaggtgctggccgagctgaggaagaggcaggccgagctgaaggccctgagcgcccacaacagaaccaagaagcatgacctgctgcggctggccaaggaggaggtgtcccggcaggagctgcggcagagggtgaggatggctgacaatgaggtgatggatgccttcaggaagatcatggccgcccggcagaagaagaggacccccaccaagaaggagaaggaccaggcctggaagaccctgaaggagcgggagagcatcctgaagctgctggatggatag

SEQ ID NO: 173635 - DNA, 1110 bp, Artificial Sequence
  Description of Artificial Sequence: Synthetic coding sequence
atgtctgagctgaaggactgccccctgcagttccatgacttcaagtctgtggaccacctgaaggtgtgcccccgctacacagctgtgctggcccggagtgaagatgatggcatcggcatcgaggagctggacaccctgcagctggagctggagaccctgctgagcagcgccagccggcggctgcgggtgctggaggccgagacccagatcctgacagactggcaggacaagaagggggaccggcgcttcctgaagctgggccgggaccacgagctgggcgccccacccaagcacggcaagcccaagaagcagaagctggagggcaaggccggccacggccctggccctggccctggccggcccaagagcaagaacctgcagcccaagatccaggagtatgagttcacagatgaccccattgatgtgccccgcatccccaagaatgatgcccccaaccgcttctgggcctctgtggagccctactgtgccgacatcaccagcgaggaggtgaggaccctggaggagctgctgaagcccccagaagatgaggccgagcactacaagatcccccccctgggcaagcactacagccagcgctgggcccaggaggacctgctggaggagcagaaggatggagcccgggctgctgctgtggccgacaagaagaagggcctgatgggccccctgacagagctggacaccaaggatgtggatgccctgctgaagaagtctgaggcccagcacgagcagccagaagatggctgcccctttggagccctgacccagaggctgctgcaggccctggtggaggagaacatcatcagccccatggaggacagccccatcccagacatgtctgggaaggagagcggggctgatggagccagcaccagccccaggaaccagaacaagcccttctctgtgccccacaccaagagcctggagagccgcatcaaggaggagctgattgcccagggcctgctggagagtgaagatagacctgctgaggacagtgaagatgaggtgctggccgagctgaggaagaggcaggccgagctgaaggccctgagcgcccacaacagaaccaagaagcatgacctgctgaggtag

SEQ ID NO: 173636 - DNA, 288 bp, Artificial Sequence
  Description of Artificial Sequence: Synthetic coding sequence
atgtctgagctgaaggactgccccctgcagttccatgacttcaagtctgtggaccacctgaaggtgtgcccccgctacacagctgtgctggcccggagtgaagatgatggcatcggcatcgaggagctggacaccctgcagctggagctggagaccctgctgagcagcgccagccggcggctgcgggtgctggaggccgagacccagatcctgacagactggcaggacaagaagggggaccggcgcttcctgaagctgggccgggaccacgagctgggcgccccctag

SEQ ID NO: 173637 - DNA, 1299 bp, Artificial Sequence; identical to SEQ ID NO: 173634
  Description of Artificial Sequence: Synthetic coding sequence

SEQ ID NO: 173638 - DNA, 1038 bp, Artificial Sequence
  Description of Artificial Sequence: Synthetic coding sequence
atgcagctggagatccaggtggccctgaacttcatcatctcctacctgtacaacaagctgcccaggagaagagtgaacatctttggagaggagctggagcggctgctgaagaagaagtatgagggccactggtacccagagaagccctacaagggcagcggcttccgctgcatccacatcggggagaaggtggaccccgtcatcgagcaggccagcaaggagagcggcctggacattgatgatgtgcggggcaacctgccccaggacctgtctgtgtggattgacccctttgaggtgtcctaccagattggagagaagggccctgtgaaggtgctgtatgtggatgacaacaatgaaaatggctgtgagctggacaaggagatcaagaacagcttcaaccctgaggcccaggtgttcatgcccatcagtgaccctgccagctctgtgagcagcagccccagccccccatttggccacagcgctgctgtgagccccaccttcatgcccaggagcacccagcccctgaccttcaccacagccacctttgctgccaccaagtttggcagcaccaagatgaagaacagcggccgcagcaacaaggtggcccggaccagccccatcaacctgggcctgaatgtgaatgacctgctgaagcagaaggccatcagcagctccatgcacagcctgtatggcctgggcctgggcagccagcagcagccccagcagcagcagcagcctgcccagcccccacctcctcctcctccaccccagcagcagcagcagcagaagaccagcgccctgagccccaatgccaaggagttcatcttccccaacatgcagggccagggcagcagcaccaacggcatgtttcctggggacagccccctgaacctgagccccctgcagtacagcaatgcctttgatgtgtttgctgcctatggaggcctgaatgagaagagctttgtggatggcctgaacttcagcctgaacaacatgcagtacagcaaccagcagttccagcctgtgatggccaactag

SEQ ID NO: 173639 - DNA, 1038 bp, Artificial Sequence; identical to SEQ ID NO: 173638
  Description of Artificial Sequence: Synthetic coding sequence

SEQ ID NO: 173640 - DNA, 1035 bp, Artificial Sequence
  Description of Artificial Sequence: Synthetic coding sequence
atgcagctggagatcaaggtggccctgaacttcatcatctcctacctgtacaacaagctgcccaggagaagagctgacctgtttggagaggagctggagcggctgctgaagaagaagtatgagggccactggtacccagagaagcccctgaagggcagcggcttccgctgtgtgcacatcggggagatggtggaccctgtggtggagctggccgccaagaggagcggcctggccgtggaggatgtgcgggccaacgtgcctgaggagctgtctgtgtggattgacccctttgaggtgtcctaccagattggagagaagggagctgtgaaggtgctgtacctggatgattctgagggctgtggggcccctgagctggacaaggagatcaagagcagcttcaacccagatgcccaggtgtttgtgcccatcggcagccaggacagcagcctgagcaacagccccagccccagctttggccagagccccagccccaccttcatccccaggtctgcccagcccatcaccttcaccacagccagctttgctgccaccaagtttggcagcaccaagatgaagaagggcggcggggccgccagcggcggcggcgtggccagcagcggggccggcggccagcagcccccccagcagcccaggatggcccggagccccaccaacagcctgctgaagcacaagagcctgagcctgtccatgcacagcctgaacttcatcacagccaacccagccccccagagccagctgagccccaatgccaaggagtttgtgtacaatggaggcggcagccccagcctcttctttgatgctgctgatggccagggcagcggcaccccaggcccctttggaggcagcggggccggcacctgcaacagcagcagctttgacatggcccaggtgtttggaggaggagccaacagcctcttcctggagaagaccccatttgtggagggcctgagctacaacctgaacaccatgcagtaccccagccagcagttccagcctgtggtgctggccaactag

SEQ ID NO: 173641 - DNA, 306 bp, Artificial Sequence
  Description of Artificial Sequence: Synthetic coding sequence
atgcagctggagatcaaggtggccctgaacttcatcatctcctacctgtacaacaagctgcccaggagaagagctgacctgtttggagaggagctggagcggctgctgaagaagaagtatgagggccactggtacccagagaagcccctgaagggcagcggcttccgctgtgtgcacatcggggagatggtggaccctgtggtggagctggccgccaagaggagcggcctggccgtggaggatgtgcgggccaacgtgcctgaggagctgtctgtgtggattgacccctttgaggtgtcctactag

SEQ ID NO: 173642 - DNA, 1569 bp, Artificial Sequence
  Description of Artificial Sequence: Synthetic coding sequence
atgagcatcaccagtgatgaggtgaacttcctggtgtaccgctacctgcaggagagcggcttcagccacagcgccttcaccttcggcatcgagagccacatcagccagagcaacatcaatggcaccctggtgcccccatctgccctgatcagcatcctgcagaagggcctgcagtatgtggaggccgagatcagcatcaacaaggatggcaccgtgtttgacagccggcccatcgagagcctgagcctcatcgtggccgtcatcccagatgtggtgcagatgaggcagcaggcctttggagagaagctgacccagcagcaggccagcgctgctgccacagaggccagcgccatggccaaggccgccaccatgaccccagctgccatcagccagcagaacccccccaagaaccgggaggccaccgtgaatggagaggagaatggagcccacgagatcaacaaccacagcaagcccatggagattgatggagatgtggagatcccccccaacaaggccaccgtgctgcggggccacgagagcgaggtgttcatctgtgcctggaaccctgtgtctgacctgctggccagcggcagcggggacagcacagcccgcatctggaacctgaatgaaaacagcaatggaggcagcacccagctggtgctgcggcactgcatccgggagggcggccatgatgtgcccagcaacaaggatgtgaccagcctggactggaacagtgatggcaccctgctggccatgggcagctatgatggctttgcccgcatctggacagaaaatggaaacctggccagcaccctgggccagcacaagggccccatctttgccctgaagtggaacaagaagggcaactacgtgctgtctgctggggtggacaagaccaccatcatctgggatgcccacactggagaggccaagcagcagttccccttccacagcgccccagccctggatgtggactggcagaacaacatgacctttgccagctgcagcacagacatgtgcatccacgtgtgccgcctgggctgtgaccaccctgtgaagaccttccagggccacaccaatgaggtgaatgccatcaagtgggaccccagcggcatgctgctggccagctgcagtgatgacatgaccctgaagatctggagcatgaagcaggatgcctgtgtgcatgacctgcaggcccacagcaaggagatctacaccatcaagtggagccccaccggccctgccaccagcaaccccaacagcagcatcatgctggccagcgccagctttgacagcacagtgcggctgtgggatgtggagcagggcgtgtgcacccacaccctgatgaagcaccaggagcctgtgtacagcgtggccttctccccagatggcaagtacctggccagcggcagctttgacaagtatgtgcacatctggaacacccagagcggcagcctggtgcacagctaccagggcactggaggcatctttgaggtgtgctggaatgcccggggggacaaggtgggcgccagcgccagtgatggctctgtgtgtgtgctggacctgtag

SEQ ID NO: 173643 - DNA, 1569 bp, Artificial Sequence; identical to SEQ ID NO: 173642
  Description of Artificial Sequence: Synthetic coding sequence

SEQ ID NO: 173644 - DNA, 1569 bp, Artificial Sequence; identical to SEQ ID NO: 173642
  Description of Artificial Sequence: Synthetic coding sequence

SEQ ID NO: 173645 - DNA, 1095 bp, Artificial Sequence
  Description of Artificial Sequence: Synthetic coding sequence
atggagattgatggagatgtggagatcccccccaacaaggccaccgtgctgcggggccacgagagcgaggtgttcatctgtgcctggaaccctgtgtctgacctgctggccagcggcagcggggacagcacagcccgcatctggaacctgaatgaaaacagcaatggaggcagcacccagctggtgctgcggcactgcatccgggagggcggccatgatgtgcccagcaacaaggatgtgaccagcctggactggaacagtgatggcaccctgctggccatgggcagctatgatggctttgcccgcatctggacagaaaatggaaacctggccagcaccctgggccagcacaagggccccatctttgccctgaagtggaacaagaagggcaactacgtgctgtctgctggggtggacaagaccaccatcatctgggatgcccacactggagaggccaagcagcagttccccttccacagcgccccagccctggatgtggactggcagaacaacatgacctttgccagctgcagcacagacatgtgcatccacgtgtgccgcctgggctgtgaccaccctgtgaagaccttccagggccacaccaatgaggtgaatgccatcaagtgggaccccagcggcatgctgctggccagctgcagtgatgacatgaccctgaagatctggagcatgaagcaggatgcctgtgtgcatgacctgcaggcccacagcaaggagatctacaccatcaagtggagccccaccggccctgccaccagcaaccccaacagcagcatcatgctggccagcgccagctttgacagcacagtgcggctgtgggatgtggagcagggcgtgtgcacccacaccctgatgaagcaccaggagcctgtgtacagcgtggccttctccccagatggcaagtacctggccagcggcagctttgacaagtatgtgcacatctggaacacccagagcggcagcctggtgcacagctaccagggcactggaggcatctttgaggtgtgctggaatgcccggggggacaaggtgggcgccagcgccagtgatggctctgtgtgtgtgctggacctgtag

SEQ ID NO: 173646 - DNA, 1752 bp, Artificial Sequence
  Description of Artificial Sequence: Synthetic coding sequence
atgcccctgaggaagatgaagatccccttcctgctgctcttcttcctgtgggaggccgagagccatgctgccagccggcccaacatcatcctggtgatggctgatgacctgggcattggagaccccggctgctacggcaacaagaccatccgcacccccaacatcgaccggctggccagcggcggcgtgaagctgacccagcacctggccgccagccccctgtgcacccccagccgggccgccttcatgacaggccgctaccctgtgcgcagcggcatggcctcctggagcaggactggagtcttcctgttcaccgccagcagcggcggcctgcccacagatgagatcacctttgccaagctgctgaaggaccagggctacagcacagccctgattggcaagtggcacctgggcatgagctgccacagcaagacagacttctgccaccaccccctgcaccacggcttcaactacttctacggcatcagcctgaccaacctgcgggactgcaagccaggagagggcagcgtcttcaccaccggcttcaagaggctggtgttcctgcccctgcagatcgtgggcgtgaccctgctgaccctggccgccctgaactgcctgggcctgctgcacgtgcccctgggcgtcttcttcagcctgctcttcctggccgccctgatcctgaccctcttcctgggcttcctgcactacttccggcccctgaactgcttcatgatgaggaactatgagatcatccagcagcccatgtcctatgacaacctgacccagaggctgactgtggaggccgcccagttcatccagaggaacacagagacccccttcctgctggtgctgagctacctgcacgtgcacacagccctcttcagcagcaaggactttgctgggaagagccagcacggcgtgtatggagatgctgtggaggagatggactggagcgtgggccagatcctgaacctgctggatgagctgcggctggccaatgacaccctcatctacttcaccagtgaccagggcgcccacgtggaggaggtgagcagcaaaggagagatccatggaggcagcaatggcatctacaagggcggcaaggccaacaactgggagggcggcatccgggtgcccggcatcctgcgctggcccagggtcatccaggccggccagaagattgatgagcccaccagcaacatggacatcttccccaccgtggccaagctggccggggcccccctgcctgaagatcgcatcattgatggccgggacctgatgcccctgctggagggcaagagccagaggagtgaccacgagttcctgttccactactgcaatgcctacctgaatgctgtgcgctggcacccccagaacagcaccagcatctggaaggccttcttcttcacccccaacttcaaccctgtgggcagcaatggctgctttgccacccacgtgtgcttctgcttcggcagctatgtgacccaccacgacccccccctgctgtttgacatcagcaaggacccccgggagaggaaccccctgaccccagccagcgagccccgcttctatgagatcctgaaggtgatgcaggaggccgctgacagacacacccagaccctgcctgaggtgcctgaccagttctcctggaacaacttcctgtggaagccctggctgcagctgtgctgccccagcacaggcctgagctgccagtgtgaccgggagaagcaggacaagaggctgagcaggtag

SEQ ID NO: 173647 - DNA, 1581 bp, Artificial Sequence
  Description of Artificial Sequence: Synthetic coding sequence
atgagcatcaccagtgatgaggtgaacttcctggtgtaccgctacctgcaggagagcggcttcagccacagcgccttcaccttcggcatcgagagccacatcagccagagcaacatcaatggcaccctggtgcccccagctgccctgatcagcatcctgcagaagggcctgcagtatgtggaggccgagatcagcatcaatgaagatggcaccgtgtttgatggccggcccatcgagagcctgagcctgattgatgctgtgatgccagatgtggtgcagacccggcagcaggccttccgggagaagctggcccagcagcaggccagcgctgctgctgctgctgctgctgccacagctgctgccacagctgccaccaccaccagcgctggggtgagccaccagaaccccagcaagaaccgggaggccaccgtgaatggagaggagaacagagcccacagcgtgaacaaccacgccaagcccatggagattgatggagaggtggagatccccagcagcaaggccaccgtgctgcggggccacgagagcgaggtgttcatctgtgcctggaaccctgtgtctgacctgctggccagcggcagcggggacagcacagcccgcatctggaacctgaatgaaaacagcaatggaggcagcacccagctggtgctgcggcactgcatccgggagggcggccatgatgtgcccagcaacaaggatgtgaccagcctggactggaacaccaacggcaccctgctggccaccggcagctatgatggctttgcccgcatctggacagaagatggcaacctggccagcaccctgggccagcacaagggccccatctttgccctgaagtggaacagaaaaggaaactacatcctgtctgctggggtggacaagaccaccatcatctgggatgcccacactggagaggccaagcagcagttccccttccacagcgccccagccctggatgtggactggcagaacaacaccacctttgccagctgcagcacagacatgtgcatccacgtgtgccgcctgggctgtgacaggcctgtgaagaccttccagggccacaccaatgaggtgaatgccatcaagtgggaccccagcggcatgctgctggccagctgcagtgatgacatgaccctgaagatctggagcatgaagcaggaggtgtgcatccatgacctgcaggcccacaacaaggagatctacaccatcaagtggagccccaccggccctgccaccagcaaccccaacagcaacatcatgctggccagcgccagctttgacagcacagtgcggctgtgggacatcgagcggggcgtgtgcacccacaccctgaccaagcaccaggagcctgtgtacagcgtggccttctccccagatggcaagtacctggccagcggcagctttgacaagtgtgtgcacatctggaacacccagagcggcaacctggtgcacagctaccggggcactggaggcatctttgaggtgtgctggaatgcccggggggacaaggtgggcgccagcgccagtgatggctctgtgtgtgtgctggacctgaggaagtag

SEQ ID NO: 173648 - DNA, 1734 bp, Artificial Sequence; identical to SEQ ID NO: 165306
  Description of Artificial Sequence: Synthetic coding sequence

SEQ ID NO: 173649 - DNA, 228 bp, Artificial Sequence
  Description of Artificial Sequence: Synthetic coding sequence
atgagcatcaccagtgatgaggtgaacttcctggtgtaccgctacctgcaggagagcggcttcagccacagcgccttcaccttcggcatcgagagccacatcagccagagcaacatcaatggcaccctggtgcccccagctgccctgatcagcatcctgcagaagggcctgcagtatgtggaggccgagatcagcatcaatgaagatggcaccgtgtttgatggatag

SEQ ID NO: 173650 - DNA, 138 bp, Artificial Sequence
  Description of Artificial Sequence: Synthetic coding sequence
atgagcatcaccagtgatgaggtgaacttcctggtgtaccgctacctgcaggagagcggcttcagccacagcgccttcaccttcggcatcgagagccacatcagccagagcaacatcaatggcaccctggtgccctag

SEQ ID NO: 173651 - DNA, 1581 bp, Artificial Sequence; identical to SEQ ID NO: 173647
  Description of Artificial Sequence: Synthetic coding sequence

SEQ ID NO: 173652 - DNA, 180 bp, Artificial Sequence
  Description of Artificial Sequence: Synthetic coding sequence
atgacagagctggccggggccagcagcagctgctgccacaggcctgctggccgcggggccatgcagagcgtgctgcaccacttccagaggctgcggggccgggagggcggcagccacttcatcaacaccagcagccccagaggagaggccaagatgagcatcaccagtgatgaggtgtag

SEQ ID NO: 173653 - DNA, 243 bp, Artificial Sequence
  Description of Artificial Sequence: Synthetic coding sequence
atgacagagctggccggggccagcagcagctgctgccacaggcctgctggccgcggggccatgcagagcgtgctgcaccacttccagaggctgcggggccgggagggcggcagccacttcatcaacaccagcagccccagaggagaggccaagatgagcatcaccagtgatgaggtgaacttcctggtgtaccgctacctgcaggagagcggcttcagccacagcgccttcacctttggatag

SEQ ID NO: 173654 - DNA, 1581 bp, Artificial Sequence; identical to SEQ ID NO: 173647
  Description of Artificial Sequence: Synthetic coding sequence

SEQ ID NO: 173655 - DNA, 1344 bp, Artificial Sequence
  Description of Artificial Sequence: Synthetic coding sequence
atggagctgagccagatgtctgagctgatgggcctgtctgtgctgctgggcctgctggccctgatggccacagctgctgtggcccggggctggctgcgggccggggaggagaggagcggccggcctgcctgccagaaggccaacggcttccccccagacaagagcagcggcagcaagaagcagaagcagtaccagaggatcaggaaggagaagccccagcagcacaacttcacccaccggctgctggccgccgccctgaagagccacagcggcaacatcagctgcatggacttcagcagcaatggcaagtacctggccacctgtgctgatgacaggaccatccgcatctggagcaccaaggacttcctgcagcgggagcaccgctccatgagggccaacgtggagctggaccacgccaccctggtgcgcttctccccagactgccgggccttcatcgtgtggctggccaatggagacaccctgcgggtcttcaagatgaccaagcgggaggatggcggctacaccttcaccgccaccccagaggacttccccaagaagcacaaggcccctgtgattgacatcggcatcgccaacacaggcaagttcatcatgacagccagcagtgacaccaccgtgctgatctggagcctgaagggccaggtgctgagcaccatcaacaccaaccagatgaacaacacccatgctgctgtgagcccctgtggccgctttgtggccagctgtggcttcaccccagatgtgaaggtgtgggaggtgtgcttcggcaagaagggggagttccaggaggtggtgcgggcctttgagctgaagggccacagcgctgctgtgcacagctttgccttcagcaatgacagcaggaggatggcctctgtgtccaaggatggcacctggaagctgtgggacacagatgtggagtacaagaagaagcaggacccctacctgctgaagacaggccgctttgaggaggccgccggggccgccccctgccgcctggccctgagccccaatgcccaggtgctggccctggccagcggcagcagcatccacctgtacaacacccggcggggggagaaggaggagtgctttgagcgggtgcacggggagtgcatcgccaacctgagctttgacatcaccggccgcttcctggccagctgtggggacagagctgtgcggctcttccacaacaccccaggccaccgggccatggtggaggagatgcagggccacctgaagagggccagcaatgaaagcacccggcagaggctgcagcagcagctgacccaggcccaggagaccctgaagagcctgggcgccctgaagaagtag

SEQ ID NO: 173656 - DNA, 1341 bp, Artificial Sequence
  Description of Artificial Sequence: Synthetic coding sequence
atggagctgagccagatgtctgagctgatgggcctgtctgtgctgctgggcctgctggccctgatggccacagctgctgtggcccggggctggctgcgggccggggaggagaggagcggccggcctgcctgccagaaggccaacggcttccccccagacaagagcagcggcagcaagaagcagaagcagtaccagaggatcaggaaggagaagccccagcagcacaacttcacccaccggctgctggccgccgccctgaagagccacagcggcaacatcagctgcatggacttcagcagcaatggcaagtacctggccacctgtgctgatgacaggaccatccgcatctggagcaccaaggacttcctgcagcgggagcaccgctccatgagggccaacgtggagctggaccacgccaccctggtgcgcttctccccagactgccgggccttcatcgtgtggctggccaatggagacaccctgcgggtcttcaagatgaccaagcgggaggatggcggctacaccttcaccgccaccccagaggacttccccaagaagcacaaggcccctgtgattgacatcggcatcgccaacacaggcaagttcatcatgacagccagcagtgacaccaccgtgctgatctggagcctgaagggccaggtgctgagcaccatcaacaccaaccagatgaacaacacccatgctgctgtgagcccctgtggccgctttgtggccagctgtggcttcaccccagatgtgaaggtgtgggaggtgtgcttcggcaagaagggggagttccaggaggtggtgcgggcctttgagctgaagggccacagcgctgctgtgcacagctttgccttcagcaatgacagcaggaggatggcctctgtgtccaaggatggcacctggaagctgtgggacacagatgtggagtacaagaagaagcaggacccctacctgctgaagacaggccgctttgaggaggccgccggggccgccccctgccgcctggccctgagccccaatgcccaggtgctggccctggccagcggcagcagcatccacctgtacaacacccggcggggggagaaggaggagtgctttgagcgggtgcacggggagtgcatcgccaacctgagctttgacatcaccggccgcttcctggccagctgtggggacagagctgtgcggctcttccacaacaccccaggccaccgggccatggtggaggagatgcagggccacctgaagagggccagcaatgaaagcacccggcagaggctgcagcagcagctgacccaggcccaggtgaccctgggcggccctggagcagaagattag

SEQ ID NO: 173657 - DNA, 2427 bp, Artificial Sequence
  Description of Artificial Sequence: Synthetic coding sequence
atggccgagacagctgctggggtgggccgcttcaagaccaactatgctgtggagaggaagattgagcccttctacaagggcggcaaggcccagctggaccagacaggccagcacctgttctgtgtgtgtggcaccagggtgaacatcctggaggtggccagcggggctgtgctgcggagcctggagcaggaggaccaggaggacatcacagcctttgacctgagcccagacaatgaggtgctggtgacagccagccgggccctgctgctggcccagtgggcctggcaggagggctctgtgacccggctgtggaaggccatccacacagcccctgtggccaccatggcctttgaccccaccagcaccctgctggccaccggcggctgtgatggagctgtgcgggtgtgggacatcgtgcgccactacggcacccaccacttccggggcagccctggggtggtgcacctggtggccttccacccagaccccacccggctgctgctcttcagcagcgccacagatgctgccatccgggtgtggagcctgcaggacaggagctgcctggccgtgctgacagcccactacagcgctgtgaccagcctggccttcagcgcagatggccacaccatgctgagcagcggccgggacaagatctgcatcatctgggacctgcagagctgccaggccaccaggacagtgcctgtgtttgagagcgtggaggccgctgtgctgctgcctgaggagcctgtgtcccagctgggcgtgaagagccctggcctgtacttcctgacagctggggaccagggcaccctgcgggtgtgggaggccgccagcggccagtgtgtgtacacccaggcccagcccccaggccctggccaggagctgacccactgcaccctggcccacacagctggggtggtgctgacagccacagctgaccacaacctgctgctgtatgaggcccggagcctgcggctgcagaagcagtttgctggctacagcgaggaggtgctggatgtgcgcttcctgggccctgaggacagccacgtggtggtggccagcaacagcccctgcctgaaggtgtttgagctgcagaccagcgcctgccagatcctgcacggccacacagacatcgtgctggccctggatgtgttcaggaagggctggctgtttgccagctgtgccaaggaccagagcgtgcgcatctggaggatgaacaaggccggccaggtgatgtgtgtggcccagggcagcggccacacccacagcgtgggcaccgtgtgctgcagccggctgaaggagagcttcctggtgacaggcagccaggactgcaccgtgaagctgtggcccctgcccaaggccctgctgagcaagaacacagccccagacaatggccccatcctgctgcaggcccagaccacccagcgctgccacgacaaggacatcaacagcgtggccatcgccccaaatgacaagctgctggccaccggcagccaggacagaacagccaagctgtgggccctgccccagtgccagctgctgggcgtcttcagcggccacagaagaggcctgtggtgtgtgcagttcagccccatggaccaggtgctggccacagccagcgcagatggcaccatcaagctgtgggccctgcaggacttcagctgcctgaagacctttgagggccatgatgcctctgtgctgaaggtggcctttgtgtcccggggcacccagctgctgagcagcggcagtgatggcctggtgaagctgtggaccatcaagaacaatgaatgtgtgaggaccctggatgcccacgaggacaaggtgtggggcctgcactgcagccggctggatgaccacgccctgaccggggccagtgacagcagggtcatcctgtggaaggatgtgacagaggccgagcaggccgaggagcaggcccggcaggaggagcaggtggtgcggcagcaggagctggacaacctgctgcacgagaagcgctacctgcgggccctgggcctggccatcagcctggaccggccccacacagtgctgaccgtcatccaggccatccggcgggaccctgaggcctgtgagaagctggaggccaccatgctgcggctgcggcgggaccagaaggaggccctgctgcgcttctgtgtgacctggaacaccaacagccgccactgccacgaggcccaggccgtgctgggcgtgctgctgcggcgggaggcccctgaggagctgctggcctatgagggcgtgcgggccgccctggaggccctgctgccctacacagagcggcacttccagaggctgagcaggaccctgcaggccgccgccttcctggacttcctgtggcacaacatgaagctgcctgtgcctgctgctgcccccaccccctgggagacccacaagggggccctgccctag

SEQ ID NO: 173658 - DNA, 2427 bp, Artificial Sequence; identical to SEQ ID NO: 173657
  Description of Artificial Sequence: Synthetic coding sequence

SEQ ID NO: 173659 - DNA, 729 bp, Artificial Sequence
  Description of Artificial Sequence: Synthetic coding sequence
atgttcccccagagccgccaccccaccccccaccaggccgccggccagcccttcaagttcaccatccctgagagcctggaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcagacagaaattgccaagaggctgaacaccatctgtgcccaggtgatccccttcctgagccaggagcaccagcagcaggtggcccaggccgtggagcgggccaagcaggtgaccatggccgagctgaatgccatcattggagtgcggggcctgcccggcctgccccccacccagcagcagctgcaggcccagcacctgagccacggccacggcccccctgtgcccctgaccccccaccccagcggcctgcagcccccaggcatcccccccctgggcggcagcgctggcctgctggccctgagcagcgccctgagcggccagagccacctggccatcaaggatgacaagaagcaccatgatgctgagcaccacagaggagagaggcctgggaagagcaacagcctgctggtgcctgacagcctgcggggcacagacaagagaagaaatggacctgagttcagcaatgacatcaagaagaggaaggtggatgacaagtag

SEQ ID NO: 173660 - DNA, 435 bp, Artificial Sequence
  Description of Artificial Sequence: Synthetic coding sequence
atgcagaggcactacgtgatgtactatgagatgtcctatggcctgaacatcgagatgcacaagcagacagaaattgccaagaggctgaacaccatctgtgcccaggtgatccccttcctgagccaggagcaccagcagcaggtggcccaggccgtggagcgggccaagcaggtgaccatggccgagctgaatgccatcatcggccagcagcagctgcaggcccagcacctgagccacggccacggcccccctgtgcccctgaccccccaccccagcggcctgcagcccccaggcatcccccccctgggcggcagcgctggcctgctggccctgagcagcgccctgagcggccagagccacctggccatcaaggatgacaagaagcaccatgatgctgagcaccacagaggagagaggcctgggaagccagactag

SEQ ID NO: 173661 - DNA, 384 bp, Artificial Sequence
  Description of Artificial Sequence: Synthetic coding sequence
atgcccaccccaggcaccagcgccaccccaggcctgcggcccggcctgggcaagcccccagccatcgaccccctggtgaaccaggccgctgctggcctgcggacccccctggccgtgcccggcccctacccagcccccttcggcatggtgccccatgctggcatgaatggagagctgaccagccctggggccgcctatgccagcctgcacaacatgagcccccagatgtctgctgctgctgctgctgctgctgtggtggcctacggccgcagccccatggtgggctttgaccccccaccccacatgagggtgcccaccatcccccccaacctggccggcatccctgggggcaagcccagcctggtgcctgccccagcccactag

SEQ ID NO: 173662 - DNA, 384 bp, Artificial Sequence; identical to SEQ ID NO: 173661
  Description of Artificial Sequence: Synthetic coding sequence

SEQ ID NO: 173663 - DNA, 2313 bp, Artificial Sequence
  Description of Artificial Sequence: Synthetic coding sequence
atgttcccccagagccgccaccccaccccccaccaggccgccggccagcccttcaagttcaccatccctgagagcctggaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcagacagaaattgccaagaggctgaacaccatctgtgcccaggtgatccccttcctgagccaggagcaccagcagcaggtggcccaggccgtggagcgggccaagcaggtgaccatggccgagctgaatgccatcatcggccagcagcagctgcaggcccagcacctgagccacggccacggcccccctgtgcccctgaccccccaccccagcggcctgcagcccccaggcatcccccccctgggcggcagcgctggcctgctggccctgagcagcgccctgagcggccagagccacctggccatcaaggatgacaagaagcaccatgatgctgagcaccaccgggaccgggagcccggcaccagcaacagcctgctggtgcctgacagcctgcggggcacagacaagagaagaaatggacctgagttcagcaatgacatcaagaagaggaaggtggatgacaaggacagcagccactatgacagtgatggagacaagagtgatgacaacctggtggtggatgtgtccaatgaagaccccagcagcccccgggccagccctgcccacagcccccgggagaatggaattgacaagaaccggctgctgaagaaggatgccagcagcagccctgccagcacagccagcagcgccagcagcaccagcctgaagagcaaggagatgagcctgcacgagaaggccagcacccctgtgctgaagagcagcacccccacccccaggagtgacatgcccaccccaggcaccagcgccaccccaggcctgcggcccggcctgggcaagcccccagccatcgaccccctggtgaaccaggccgccgccggcctgcggacccccctggccgtgcccggcccctacccagcccccttcggcatggtgccccacgccggcatgaatggagagctgaccagccctggagctgcctatgccagcctgcacaacatgagcccccagatgtctgctgctgctgctgctgctgctgtggtggcctacggccgcagccccatggtgggctttgatcctccaccccacatgagggtgcccaccatcccccccaacctggccggcatccctgggggcaagccagcctacagcttccacgtgacagcagatggccagatgcagcctgtgcccttccccccagatgccctgattggccctggcatccccaggcatgcccggcagatcaacaccctgaaccacggggaggtggtgtgtgctgtgaccatcagcaaccccaccaggcatgtgtacacaggaggcaagggctgtgtgaaggtgtgggacatcagccaccctggcaacaagagccctgtgtcccagctggactgcctgaacagagacaactacatccgcagctgcaagctgctgcctgatggctgcaccctcatcgtgggcggggaggccagcaccctgagcatctgggacctggccgcccccaccccccgcatcaaggccgagctgaccagcagcgccccagcctgctacgccctggccatcagcccagacagcaaggtgtgcttcagctgctgcagtgatggcaacattgctgtgtgggacctgcacaaccagaccctggtgcggcagttccagggccacacagatggagccagctgcatcgacatcagcaatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcacgtgaacaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgtggatgacaagtacatcgtgacaggcagcggggacaagaaggccaccgtgtatgaggtgatctactag

SEQ ID NO: 173664 - DNA, 729 bp, Artificial Sequence
  Description of Artificial Sequence: Synthetic coding sequence
atgttcccccagagccgccaccccaccccccaccaggccgccggccagcccttcaagttcaccatccctgagagcctggaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcagacagaaattgccaagaggctgaacaccatctgtgcccaggtgatccccttcctgagccaggagcaccagcagcaggtggcccaggccgtggagcgggccaagcaggtgaccatggccgagctgaatgccatcattggagtgcggggcctgcccggcctgccccccacccagcagcagctgcaggcccagcacctgagccacggccacggcccccctgtgcccctgaccccccaccccagcggcctgcagcccccaggcatcccccccctgggcggcagcgctggcctgctggccctgagcagcgccctgagcggccagagccacctggccatcaaggatgacaagaagcaccatgatgctgagcaccaccgggaccgggagcccggcaccagcaacagcctgctggtgcctgacagcctgcggggcacagacaagagaagaaatggacctgagttcagcaatgacatcaagaagaggaaggtggatgacaagtag

SEQ ID NO: 173665 - DNA, 2121 bp, Artificial Sequence
  Description of Artificial Sequence: Synthetic coding sequence
atggtgcagagccggctgacagccaccagcgccagccaggacagccctgccagcggcctgcagacccccctgcagagcggccagcccttcaagttcagcatcctggagatctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgagcggcatctgtgcccagatcatccccttcctgacccaggagcaccagcagcaggtgctgcaggccgtggagcgggccaagcaggtgacagtgggggagctgaacagcctgattggccagcagcagctgcagcccctgagccaccacgcccctcctgtgcccctgacccccaggcctgctggcctggtgggcggcagcgccaccggcctgctggccctgagcggggccctggccgcccaggcccagctggccgctgctgtgaaggaggacagagctggggtggaggccgagggcagccgggtggagcgggcccccagccgcagcgccagccccagccccccagagagcctggtggaggaggagcggcccagcggccctgggggcggcggcaagcagagagcagatgagaaggagcccagcggcccctatgaaagtgatgaggacaagagtgactacaacctggtggtggatgaggaccagcccagcgagccccccagccctgccaccaccccctgtgggaaggtgcccatctgcatcccagcccggcgggacctggtggacagccctgccagcctggccagcagcctgggcagccccctgccccgggccaaggagctgatcctgaatgacctgcctgccagcaccccagccagcaagagctgtgacagcagccccccccaggatgccagcaccccaggccccagcagcgccagccacctgtgccagctggccgccaagccagcccccagcacagacagcgtggccctgcggagccccctgaccctgagcagccccttcaccaccagcttcagcctgggcagccacagcaccctgaatggagacctgtctgtgcccagcagctatgtgtccctgcacctgagcccccaggtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccaggcatgcccggcagctgcacaccctggcccacggggaggtggtgtgtgctgtgaccatcagcggcagcacccagcacgtgtacacaggaggcaagggctgtgtgaaggtgtgggatgtgggccagcccggggccaagacccctgtggcccagctggactgcctgaacagagacaactacatccgcagctgcaagctgctgcctgatggccgcagcctgattgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtgtgcagggcgtggtgctgagccctgagctgtag

SEQ ID NO: 173666 - DNA, 2232 bp, Artificial Sequence
  Description of Artificial Sequence: Synthetic coding sequence
atgtacccccagggccgccaccccacccccctgcagagcggccagcccttcaagttcagcatcctggagatctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgagcggcatctgtgcccagatcatccccttcctgacccaggagcaccagcagcaggtgctgcaggccgtggagcgggccaagcaggtgacagtgggggagctgaacagcctcatcggccagcagctgcagcccctgagccaccacgcccctcctgtgcccctgacccccaggcctgctggcctggtgggcggcagcgccaccggcctgctggccctgagcggggccctggccgcccaggcccagctggccgctgctgtgaaggaggacagagctggggtggaggccgagggcagccgggtggagcgggcccccagccgcagcgccagccccagccccccagagagcctggtggaggaggagcggcccagcggccctgggggcggcggcaagcagagagcagatgagaaggagcccagcggcccctatgaaagtgatgaggacaagagtgactacaacctggtggtggatgaggaccagcccagcgagccccccagccctgccaccaccccctgtgggaaggtgcccatctgcatcccagcccggcgggacctggtggacagccctgccagcctggccagcagcctgggcagccccctgccccgggccaaggagctgatcctgaatgacctgcctgccagcaccccagccagcaagagctgtgacagcagccccccccaggatgccagcaccccaggccccagcagcgccagccacctgtgccagctggccgccaagccagcccccagcacagacagcgtggccctgcggagccccctgaccctgagcagccccttcaccaccagcttcagcctgggcagccacagcaccctgaatggagacctgtctgtgcccagcagctatgtgtccctgcacctgagcccccaggtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccaggcatgcccggcagctgcacaccctggcccacggggaggtggtgtgtgctgtgaccatcagcggcagcacccagcacgtgtacacaggaggcaagggctgtgtgaaggtgtgggatgtgggccagcccggggccaagacccctgtggcccagctggactgcctgaacagagacaactacatccgcagctgcaagctgctgcctgatggccgcagcctgattgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtggccgctggtttgtgtccacaggcaaggacaacctgctgaatgcctggaggaccccctacggggccagcatcttccagagcaaggagagcagctctgtgctgagctgtgacatcagcaggaacaacaagtacatcgtgactggaagtggggacaagaaggccaccgtgtatgaggtggtgtactag

SEQ ID NO: 173667 - DNA, 879 bp, Artificial Sequence
  Description of Artificial Sequence: Synthetic coding sequence
ctggcccatggagaggtggtgtgtgctgtgaccatcagcggcagcacccagcacgtgtacacaggaggcaagggctgtgtgaaggtgtgggatgtggatggagctgtgtttgctggccagaggggcggggcccaccagcccatccggaacagagacaactacatccgcagctgcaagctgctgcctgatggccgcagcctcatcgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtggccgctggtttgtgtccacaggcaaggacaacctgctgaatgcctggaggaccccctatggagccagcatcttccagagcaaggagagcagctctgtgctgagctgtgacatcagcaggaacaacaagtacatcgtgacaggcagcggggacaagaaggccaccgtgtatgaggtggtgtactag

SEQ ID NO: 173668 - DNA, 2121 bp, Artificial Sequence; identical to SEQ ID NO: 173665
  Description of Artificial Sequence: Synthetic coding sequence

SEQ ID NO: 173669 - DNA, 1083 bp, Artificial Sequence
  Description of Artificial Sequence: Synthetic coding sequence
atgtacccccagggccgccaccccacccccctgcagagcggccagcccttcaagttcagcatcctggagatctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgagcggcatctgtgcccagatcatccccttcctgacccaggagagcgccagccccagccccccagagagcctggtggaggaggagcggcccagcggccctgggggcggcggcaagcagagagcagatgagaaggagcccagcggcccctatgaaagtgatgaggacaagagtgactacaacctggtggtggatgaggaccagcccagcgagccccccagccctgccaccaccccctgtgggaaggtgcccatctgcatcccagcccggcgggacctggtggacagccctgccagcctggccagcagcctgggcagccccctgccccgggccaaggagctgatcctgaatgacctgcctgccagcaccccagccagcaagagctgtgacagcagccccccccaggatgccagcaccccaggccccagcagcgccagccacctgtgccagctggccgccaagccagcccccagcacagacagcgtggccctgcggagccccctgaccctgagcagccccttcaccaccagcttcagcctgggcagccacagcaccctgaatggagacctgtctgtgcccagcagctatgtgtccctgcacctgagcccccaggtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccccctggcccagcagcacagcctag

SEQ ID NO: 173670 - DNA, 1866 bp, Artificial Sequence
  Description of Artificial Sequence: Synthetic coding sequence
atgcagaggcactacgtgatgtactatgagatgtcctatggcctgaacatcgagatgcacaagcaggccgagatcgtgaagaggctgagcggcatctgtgcccagatcatccccttcctgacccaggagcaccagcagcaggtgctgcaggccgtggagcgggccaagcaggtgacagtgggggagctgaacagcctgattggcagcgccagccccagccccccagagagcctggtggaggaggagcggcccagcggccctgggggcggcggcaagcagagagcagatgagaaggagcccagcggcccctatgaaagtgatgaggacaagagtgactacaacctggtggtggatgaggaccagcccagcgagccccccagccctgccaccaccccctgtgggaaggtgcccatctgcatcccagcccggcgggacctggtggacagccctgccagcctggccagcagcctgggcagccccctgccccgggccaaggagctgatcctgaatgacctgcctgccagcaccccagccagcaagagctgtgacagcagccccccccaggatgccagcaccccaggccccagcagcgccagccacctgtgccagctggccgccaagccagcccccagcacagacagcgtggccctgcggagccccctgaccctgagcagccccttcaccaccagcttcagcctgggcagccacagcaccctgaatggagacctgtctgtgcccagcagctatgtgtccctgcacctgagcccccaggtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccaggcatgcccggcagctgcacaccctggcccacggggaggtggtgtgtgctgtgaccatcagcggcagcacccagcacgtgtacacaggaggcaagggctgtgtgaaggtgtgggatgtgggccagcccggggccaagacccctgtggcccagctggactgcctgaacagagacaactacatccgcagctgcaagctgctgcctgatggccgcagcctgattgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtggccgctggtttgtgtccacaggcaaggacaacctgctgaatgcctggaggaccccctacggggccagcatcttccagagcaaggagagcagctctgtgctgagctgtgacatcagcaggaacaacaagtacatcgtgactggaagtggggacaagaaggccaccgtgtatgaggtggtgtactag

SEQ ID NO: 173671 - DNA, 1233 bp, Artificial Sequence
  Description of Artificial Sequence: Synthetic coding sequence
atgaccttccccccagccctgctgccccccaaccctgtgaccccaccccggcccaggaccctgcccccacctggccctgcccggcctgtgaccagcgccagcctgctgcccagccagcacctgcccaggacagcctctgtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccaggcatgcccggcagctgcacaccctggcccatggagaggtggtgtgtgctgtgaccatcagcggcagcacccagcacgtgtacacaggaggcaagggctgtgtgaaggtgtgggatgtgggccagcccggggccaagacccctgtggcccagctggactgcctgaacagagacaactacatccgcagctgcaagctgctgcctgatggccgcagcctcatcgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtggccgctggtttgtgtccacaggcaaggacaacctgctgaatgcctggaggaccccctatggagccagcatcttccagagcaaggagagcagctctgtgctgagctgtgacatcagcaggaacaacaagtacatcgtgacaggcagcggggacaagaaggccaccgtgtatgaggtggtgtactag

SEQ ID NO: 173672 - DNA, 2061 bp, Artificial Sequence
  Description of Artificial Sequence: Synthetic coding sequence
cagacccccctgcagagcggccagcccttcaagttcagcatcctggagatctgtgaccgcatcaaggaggagttccagttcctgcaggcccagtaccacagcctgaagctggagtgtgagaagctggccagcgagaagacagagatgcagaggcactacgtgatgtactatgagatgtcctatggcctgaacatcgagatgcacaagcaggccgagatcgtgaagaggctgagcggcatctgtgcccagatcatccccttcctgacccaggagcaccagcagcaggtgctgcaggccgtggagcgggccaagcaggtgacagtgggggagctgaacagcctgattggccagcagcagctgcagcccctgagccaccacgcccctcctgtgcccctgacccccaggcctgctggcctggtgggcggcagcgccaccggcctgctggccctgagcggggccctggccgcccaggcccagctggccgctgctgtgaaggaggacagagctggggtggaggccgagggcagccgggtggagcgggcccccagccgcagcgccagccccagccccccagagagcctggtggaggaggagcggcccagcggccctgggggcggcggcaagcagagagcagatgagaaggagcccagcggcccctatgaaagtgatgaggacaagagtgactacaacctggtggtggatgaggaccagcccagcgagccccccagccctgccaccaccccctgtgggaaggtgcccatctgcatcccagcccggcgggacctggtggacagccctgccagcctggccagcagcctgggcagccccctgccccgggccaaggagctgatcctgaatgacctgcctgccagcaccccagccagcaagagctgtgacagcagccccccccaggatgccagcaccccaggccccagcagcgccagccacctgtgccagctggccgccaagccagcccccagcacagacagcgtggccctgcggagccccctgaccctgagcagccccttcaccaccagcttcagcctgggcagccacagcaccctgaatggagacctgtctgtgcccagcagctatgtgtccctgcacctgagcccccaggtgagcagctctgtggtgtatggccgcagccctgtgatggcctttgagagccacccccacctgcggggcagctctgtgagcagcagcctgcccagcatccctgggggcaagccagcctacagcttccacgtgtctgcagatggccagatgcagcctgtgcccttccccagtgatgccctggtgggcgccggcatccccaggcatgcccggcagctgcacaccctggcccacggggaggtggtgtgtgctgtgaccatcagcggcagcacccagcacgtgtacacaggaggcaagggctgtgtgaaggtgtgggatgtgggccagcccggggccaagacccctgtggcccagctggactgcctgaacagagacaactacatccgcagctgcaagctgctgcctgatggccgcagcctgattgtgggcggggaggccagcaccctgagcatctgggacctggccgcccccaccccccgcatcaaggccgagctgaccagcagcgccccagcctgctacgccctggccgtgtccccagatgccaaggtgtgcttcagctgctgcagtgatggcaacatcgtggtgtgggacctgcagaaccagaccatggtgcggcagttccagggccacacagatggagccagctgcatcgacatcagtgactatggcacccggctgtggacaggaggcctggacaacacagtgcgctgctgggacctgcgggagggccggcagctgcagcagcacgacttcagcagccagatcttcagcctgggccactgccccaaccaggactggctggccgtgggcatggagagcagcaatgtggagatcctgcacgtgaggaagccagagaagtaccagctgcacctgcacgagagctgtgtgctgagcctgaagtttgccagctgtgtgcagggcgtggtgctgagccctgagctgtag

SEQ ID NO: 173673 - DNA, 1866 bp, Artificial Sequence; identical to SEQ ID NO: 173670
  Description of Artificial Sequence: Synthetic coding sequence

SEQ ID NO: 173674 - DNA, 2283 bp, Artificial Sequence
  Description of Artificial Sequence: Synthetic coding sequence
atgtacccccagggccgccacccagccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgtcctttggagctgtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173675 - DNA, 2289 bp, Artificial Sequence
  Description of Artificial Sequence: Synthetic coding sequence
atggccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagagatcgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgtcctttggagctgtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173676 - DNA, 2295 bp, Artificial Sequence
  Description of Artificial Sequence: Synthetic coding sequence
atgtacccccagggccgccacccagccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagaggagcagcgccagcaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173677 - DNA, 2310 bp, Artificial Sequence
  Description of Artificial Sequence: Synthetic coding sequence
atgtacccccagggccgccacccagccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgtcctttggagctgtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccacggggaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctgattgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccactggagagtggctggccgtgggcatggagagcagcaatgtggaggtgctgcaccacaccaagccagacaagtaccagctgcacctgcacgagagctgtgtgctgagcctgaagtttgcctactgtgggaagtggtttgtgtccacaggcaaggacaacctgctgaatgcctggaggaccccctacggggccagcatcttccagagcaaggagagcagctctgtgctgagctgtgacatctctgcagatgacaagtacatcgtgactggaagtggggacaagaaggccaccgtgtatgaagtcatctactag

SEQ ID NO: 173678 - DNA, 2295 bp, Artificial Sequence
  Description of Artificial Sequence: Synthetic coding sequence
atgtacccccagggccgccacccagccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173679 - DNA, 2319 bp, Artificial Sequence
  Description of Artificial Sequence: Synthetic coding sequence
atgtacccccagggccgccacccagccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcggcatcatggccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgtcctttggagctgtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173680 - DNA, 2319 bp, Artificial Sequence
  Description of Artificial Sequence: Synthetic coding sequence
atgcctcctcctccacccctgagctgcctgcggggcctgcaggccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcggcatcatggccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173681 - DNA, 2325 bp, Artificial Sequence
  Description of Artificial Sequence: Synthetic coding sequence
atgcctcctcctccacccctgagctgcctgcggggcctgcaggccccccaccagcccggccagcccggcttcaagttcaccgtggccgagagctgtgaccgcatcaaggatgagttccagttcctgcaggcccagtaccacagcctgaaggtggagtatgacaagctggccaatgagaagacagagatgcagaggcactacgtgatgtactatgagatgtcctatggcctgaacatcgagatgcacaagcagacagaaattgccaagaggctgaacaccatcctggcccagatcatgcccttcctgagccaggagcaccagcagcaggtggcccaggccgtggagcgggccaagcaggtgaccatgacagagctgaatgccatcatcggccagcagctgcaggcccagcacctgagccacgccacccacggcccccctgtgcagctgcccccccaccccagcggcctgcagcccccaggcatcccccctgtgacaggcagcagcagcggcctgctggccctgggcgccctgggcagccaggcccacctgactgtgaaggatgagaagaaccaccacgagctggaccaccgggagcgggagagcagcgccaacaacagcgtgagccccagcgagagcctgcgggccagcgagaagcaccggggcagcgctgactacagcatggaggccaagaagaggaaggccgaggagaaggacagcctgagccgctatgacagtgatggagacaagagtgatgacctggtggtggatgtgtccaatgaagatcctgccaccccccgggtgtccccagcccacagccccccagaaaatggcctggacaaggcccggagcctgaagaaggatgcccccaccagccctgcctctgtggccagcagcagcagcacccccagcagcaagaccaaggacctgggccacaatgacaagagcagcaccccaggcctgaagagcaacacccccaccccaagaaatgatgcccccaccccaggcaccagcaccaccccaggcctgcgctccatgcctgggaagcccccaggcatggaccccatcgccagcgccctgcggacccccatcagcatcaccagcagctatgctgccccctttgccatgatgagccaccacgagatgaatggcagcctgaccagccctggggcctatgccggcctgcacaacatccccccccagatgtctgctgctgctgctgctgctgctgctgcctacggccgcagccccatggtgtcctttggagctgtgggctttgacccccacccccccatgagggccaccggcctgcccagcagcctggccagcatccctgggggcaagccagcctacagcttccacgtgtctgcagatggccagatgcagcctgtgcccttcccccatgatgccctggccggccctggcatccccaggcatgcccggcagatcaacaccctgagccatggagaggtggtgtgtgctgtgaccatcagcaaccccaccaggcatgtgtacacaggaggcaagggctgtgtgaagatctgggacatcagccagcccggcagcaagagccccatcagccagctggactgcctgaacagagacaactacatccgcagctgcaagctgctgcctgatggccgcaccctcatcgtgggcggggaggccagcaccctgaccatctgggacctggccagccccaccccccgcatcaaggccgagctgaccagcagcgccccagcctgctacgccctggccatcagcccagatgccaaggtgtgcttcagctgctgcagtgatggcaacattgctgtgtgggacctgcacaaccagaccctggtgcggcagttccagggccacacagatggagccagctgcatcgacatcagccatgatggcaccaagctgtggacaggaggcctggacaacacagtgcgctcctgggacctgcgggagggccggcagctgcagcagcacgacttcaccagccagatcttcagcctgggctactgccccaccggggagtggctggccgtgggcatggagagcagcaatgtggaggtgctgcaccacaccaagccagacaagtaccagctgcacctgcacgagagctgtgtgctgagcctgaagtttgcctactgcggcaagtggtttgtgtccacaggcaaggacaacctgctgaatgcctggaggaccccctatggagccagcatcttccagagcaaggagagcagctctgtgctgagctgtgacatctctgcagatgacaagtacatcgtgacaggcagcggggacaagaaggccaccgtgtatgaggtgatctactag

SEQ ID NO: 173682 - DNA, 1719 bp, Artificial Sequence
  Description of Artificial Sequence: Synthetic coding sequence
atgaccagccgggaccagccccggcccaagggcccccccaagagcaccagcccctgccccggcatcagcaacagcgagagcagccccaccctgaactaccagggcatcctgaaccggctgaagcagttcccccgcttcagcccccactttgctgctgagctggagagcatctactacagcctgcacaagatccagcaggatgtggccgagcaccacaagcagattggaaatgtgctgcagatcgtggagagctgcagccagctgcagggcttccagagcgaggaggtgtccccagctgagcccgccagccctggcaccccccagcaggtgaaggacaagaccctgcaggagagcagctttgaggacatcatggccaccaggagcagtgactggctgcggcggcccctgggggaggacaaccagcctgagacccagctgttctgggacaaggagccctggttctggcatgacaccctgacagagcagctgtggaggatctttgctggggtgcatgatgagaaggccaagccccgggaccggcagcaggcccctggcctgggccaggagagcaaggcccctggcagctgtgaccccggcacagacccctgcccagaagatgccagcaccccccggcccccagaggccagcagcagccccccagagggcagccaggacaggaacacctcctggggcgtggtgcaggagcccccaggccgggccagccgcttcctgcagagcatctcctgggaccctgaggactttgaagatgcctggaagaggccagatgccctgcccggccagagcaagaggctggccgtgccctgcaagctggagaagatgaggatcctggcccatggagagctggtgctggccacagccatcagcagcttcaccaggcatgtgttcacctgtggccggcggggcatcaaggtgtggagcctgaccggccaggtggccgaggaccgcttccctgagagccacctgcccatccagacccctggggccttcctgcggacctgcctgctgagcagcaacagccgcagcctgctgactggaggctacaacctggcctctgtgtctgtgtgggacctggccgcccccagcctgcacgtgaaggagcagctgccctgtgccggcctgaactgccaggccctggatgccaacctggatgccaacctggcctttgccagcttcaccagcggcgtggtgcgcatctgggacctgcgggaccagagcgtggtgcgggacctgaagggctacccagatggagtgaagagcatcgtggtgaagggctacaacatctggacaggaggcccagatgcctgcctgcgctgctgggaccagaggaccatcatgaagcccctggagtaccagttcaagagccagatcatgagcctgagccacagcccccaggaggactgggtgctgctgggcatggccaacggccagcagtggctgcagagcaccagcggcagccagaggcacatggtgggccagaaggacagcgtcatcctgtctgtgaagttcagccccttcggccagtggtgggcctctgtgggcatggatgacttcctgggcgtgtacagcatgcctgctggcaccaaggtgtttgaggtgcctgagatgagccctgtgacctgctgtgatgtgagcagcaacaaccggctggtggtgactggaagtggagagcacgcctctgtgtaccagatcacctactag

SEQ ID NO: 173683 - DNA, 1251 bp, Artificial Sequence
  Description of Artificial Sequence: Synthetic coding sequence
atggccaccaggagcagtgactggctgcggcggcccctgggggaggacaaccagcctgagacccagctgttctgggacaaggagccctggttctggcatgacaccctgacagagcagctgtggaggatctttgctggggtgcatgatgagaaggccaagccccgggaccggcagcaggcccctggcctgggccaggagagcaaggcccctggcagctgtgaccctggaacagacccctgcccagaagatgccagcacccccaggcctcctgaggccagcagcagccccccagagggcagccaggacaggaacacctcctggggcgtggtgcaggagcccccaggccgggccagccgcttcctgcagagcatctcctgggaccctgaagattttgaagatgcctggaagaggccagatgccctgcccggccagagcaagaggctggccgtgccctgcaagctggagaagatgaggatcctggcccacggggagctggtgctggccacagccatcagcagcttcaccaggcatgtgttcacctgtggcagaagaggcatcaaggtgtggagcctgaccggccaggtggctgaagatcgcttccctgagagccacctgcccatccagacccctggggccttcctgcggacctgcctgctgagcagcaacagccgcagcctgctgaccggcggctacaacctggcctctgtgtctgtgtgggacctggccgcccccagcctgcacgtgaaggagcagctgccctgtgccggcctgaactgccaggccctggatgccaacctggatgccaacctggcctttgccagcttcaccagcggcgtggtgcgcatctgggacctgcgggaccagagcgtggtgcgggacctgaagggctacccagatggagtgaagagcatcgtggtgaagggctacaacatctggacaggaggcccagatgcctgcctgcgctgctgggaccagaggaccatcatgaagcccctggagtaccagttcaagagccagatcatgagcctgagccacagcccccaggaggactgggtgctgctgggcatggccaacggccagcagtggctgcagagcaccagcggcagccagaggcacatggtgggccagaggcagaggcaccctgagcggcaggtgctgcccctgtggcctgtggtgggcaagcgctggaatggccgcctgccctggaggctgcagcacgccggcggggacaagtctgtgcggggggcctag

SEQ ID NO: 173684 - DNA, 1719 bp, Artificial Sequence
  Description of Artificial Sequence: Synthetic coding sequence
atgaccagccgggaccagccccggcccaagggcccccccaagagcaccagcccctgccccggcatcagcaacagcgagagcagccccaccctgaactaccagggcatcctgaaccggctgaagcagttcccccgcttcagcccccactttgctgctgagctggagagcatctactacagcctgcacaagatccagcaggatgtggccgagcaccacaagcagattggaaatgtgctgcagatcgtggagagctgcagccagctgcagggcttccagagcgaggaggtgtccccagctgagcccgccagccctggcaccccccagcaggtgaaggacaagaccctgcaggagagcagctttgaggacatcatggccaccaggagcagtgactggctgcggcggcccctgggggaggacaaccagcctgagacccagctgttctgggacaaggagccctggttctggcatgacaccctgacagagcagctgtggaggatctttgctggggtgcatgatgagaaggccaagccccgggacagacacttcagcatcttccagggccaggagagcaaggcccctggcagctgtgaccccggcacagacccctgcccagaagatgccagcaccccccggcccccagaggccagcagcagccccccagagggcagccaggacaggaacacctcctggggcgtggtgcaggagcccccaggccgggccagccgcttcctgcagagcatctcctgggaccctgaggactttgaagatgcctggaagaggccagatgccctgcccggccagagcaagaggctggccgtgccctgcaagctggagaagatgaggatcctggcccatggagagctggtgctggccacagccatcagcagcttcaccaggcatgtgttcacctgtggccggcggggcatcaaggtgtggagcctgaccggccaggtggccgaggaccgcttccctgagagccacctgcccatccagacccctggggccttcctgcggacctgcctgctgagcagcaacagccgcagcctgctgactggaggctacaacctggcctctgtgtctgtgtgggacctggccgcccccagcctgcacgtgaaggagcagctgccctgtgccggcctgaactgccaggccctggatgccaacctggatgccaacctggcctttgccagcttcaccagcggcgtggtgcgcatctgggacctgcgggaccagagcgtggtgcgggacctgaagggctacccagatggagtgaagagcatcgtggtgaagggctacaacatctggacaggaggcccagatgcctgcctgcgctgctgggaccagaggaccatcatgaagcccctggagtaccagttcaagagccagatcatgagcctgagccacagcccccaggaggactgggtgctgctgggcatggccaacggccagcagtggctgcagagcaccagcggcagccagaggcacatggtgggccagaaggacagcgtcatcctgtctgtgaagttcagccccttcggccagtggtgggcctctgtgggcatggatgacttcctgggcgtgtacagcatgcctgctggcaccaaggtgtttgaggtgcctgagatgagccctgtgacctgctgtgatgtgagcagcaacaaccggctggtggtgactggaagtggagagcacgcctctgtgtaccagatcacctactag

SEQ ID NO: 173685 - DNA, 1350 bp, Artificial Sequence
  Description of Artificial Sequence: Synthetic coding sequence
atggccaccaggagcagtgactggctgcggcggcccctgggggaggacaaccagcctgagacccagctgttctgggacaaggagccctggttctggcatgacaccctgacagagcagctgtggaggatctttgctggggtgcatgatgagaaggccaagccccgggaccggcagcaggcccctggcctgggccaggagagcaaggcccctggcagctgtgaccctggaacagacccctgcccagaagatgccagcacccccaggcctcctgaggccagcagcagccccccagagggcagccaggacaggaacacctcctggggcgtggtgcaggagcccccaggccgggccagccgcttcctgcagagcatctcctgggaccctgaagattttgaagatgcctggaagaggccagatgccctgcccggccagagcaagaggctggccgtgccctgcaagctggagaagatgaggatcctggcccacggggagctggtgctggccacagccatcagcagcttcaccaggcatgtgttcacctgtggcagaagaggcatcaaggtgtggagcctgaccggccaggtggctgaagatcgcttccctgagagccacctgcccatccagacccctggggccttcctgcggacctgcctgctgagcagcaacagccgcagcctgctgaccggcggctacaacctggcctctgtgtctgtgtgggacctggccgcccccagcctgcacgtgaaggagcagctgccctgtgccggcctgaactgccaggccctggatgccaacctggatgccaacctggcctttgccagcttcaccagcggcgtggtgcgcatctgggacctgcgggaccagagcgtggtgcgggacctgaagggctacccagatggagtgaagagcatcgtggtgaagggctacaacatctggacaggaggcccagatgcctgcctgcgctgctgggaccagaggaccatcatgaagcccctggagtaccagttcaagagccagatcatgagcctgagccacagcccccaggaggactgggtgctgctgggcatggccaacggccagcagtggctgcagagcaccagcggcagccagaggcacatggtgggccagaaggacagcgtcatcctgtctgtgaagttcagccccttcggccagtggtgggcctctgtgggcatggatgacttcctgggcgtgtacagcatgcctgctggcaccaaggtgtttgaggtgcctgagatgagccctgtgacctgctgtgatgtgagcagcaacaaccggctggtggtgacaggcagcggggagcacgcctctgtgtaccagatcacctactag

SEQ ID NO: 173686 - DNA, 1716 bp, Artificial Sequence
  Description of Artificial Sequence: Synthetic coding sequence
atgaaccagctgcggggcaagaagagctgccacacaggcctgggccgctctgctggctggaacatccccatcggcctgctgtactgtgacctgcctgagcccaggaagcccctggagaaggctgtggccaacttcttcagcggcagctgtgccccctgtgctgatggaacagacttcccccagctgtgccagctgtgccccggctgcggctgcagcaccctgaaccagtacttcggctacagcggggccttcaagtgcctgaaggatggagctggagatgtggcctttgtgaagcacagcaccatctttgagaacctggccaacaaggctgaccgggaccagtatgagctgctgtgcctggacaacaccaggaagcctgtggatgagtacaaggactgccacctggcccaggtgcccagccacacagtggtggcccgctccatgggcggcaaggaggacctgatctgggagctgctgaaccaggcccaggagcactttgggaaggacaagagcaaggagttccagctgttcagcagcccccacggcaaggacctgctcttcaaggacagcgcccacggcttcctgaaggtgccccccaggatggatgccaagatgtacctgggctatgaatatgtgacagccatccggaacctgcgggagggcacctgcccagaggcccccacagatgagtgcaagcctgtgaagtggtgtgccctgagccaccacgagcggctgaagtgtgatgagtggagcgtgaacagcgtgggcaagattgaatgtgtgtctgctgagaccacagaggactgcatcgccaagatcatgaatggagaggctgatgccatgagcctggatggcggctttgtgtacatcgccgggaaatgtggcctggtgcctgtgctggccgagaactacaacaagagtgacaactgtgaggacaccccagaggccggctactttgccatcgctgtggtgaagaagagcgccagtgacctgacctgggacaacctgaagggcaagaagagctgccacacagctgtgggccgcacagctggctggaacatccccatgggcctgctgtacaacaagatcaaccactgccgctttgatgagttcttcagcgagggctgtgcccctggcagcaagaaggacagcagcctgtgcaagctgtgcatgggcagcggcctgaacctgtgtgagcccaacaacaaggagggctactacggctacaccggggccttccgctgcctggtggagaagggagatgtggcctttgtgaagcaccagacagtgccccagaacacaggaggcaagaacccagacccctgggccaagaacctgaatgagaaggactatgagctgctgtgcctggatggcaccaggaagcctgtggaggagtatgccaactgccacctggcccgggcccccaaccacgctgtggtgaccaggaaggacaaggaggcctgtgtgcacaagatcctgcggcagcagcagcacctgtttggcagcaatgtgacagactgcagcggcaacttctgcctcttccgctctgagaccaaggacctgctcttcagagatgacacagtgtgcctggccaagctgcatgacaggaacacctatgagaagtacctgggggaggagtatgtgaaggctgtgggcaacctgaggaagtgcagcaccagcagcctgctggaggcctgcaccttcagaagaccctag

SEQ ID NO: 173687 - DNA, 2097 bp, Artificial Sequence
  Description of Artificial Sequence: Synthetic coding sequence
atgaggctggccgtgggcgccctgctggtgtgtgctgtgctgggcctgtgcctggccgtgcctgacaagacagtgcgctggtgtgctgtgtctgaacatgaggccaccaagtgccagagcttccgggaccacatgaagagcgtcatccccagtgatggccccagcgtggcctgtgtgaagaaggccagctacctggactgcatccgggccatcgccgccaatgaagcagatgctgtgaccctggatgctggcctggtgtatgatgcctacctggcccccaacaacctgaagcctgtggtggccgagttctacggcagcaaggaggacccccagaccttctactatgctgtggccgtggtgaagaaggacagcggcttccagatgaaccagctgcggggcaagaagagctgccacacaggcctgggccgctctgctggctggaacatccccatcggcctgctgtactgtgacctgcctgagcccaggaagcccctggagaaggctgtggccaacttcttcagcggcagctgtgccccctgtgctgatggaacagacttcccccagctgtgccagctgtgccccggctgcggctgcagcaccctgaaccagtacttcggctacagcggggccttcaagtgcctgaaggatggagctggagatgtggcctttgtgaagcacagcaccatctttgagaacctggccaacaaggctgaccgggaccagtatgagctgctgtgcctggacaacaccaggaagcctgtggatgagtacaaggactgccacctggcccaggtgcccagccacacagtggtggcccgctccatgggcggcaaggaggacctgatctgggagctgctgaaccaggcccaggagcactttgggaaggacaagagcaaggagttccagctgttcagcagcccccacggcaaggacctgctcttcaaggacagcgcccacggcttcctgaaggtgccccccaggatggatgccaagatgtacctgggctatgaatatgtgacagccatccggaacctgcgggagggcacctgcccagaggcccccacagatgagtgcaagcctgtgaagtggtgtgccctgagccaccacgagcggctgaagtgtgatgagtggagcgtgaacagcgtgggcaagattgaatgtgtgtctgctgagaccacagaggactgcatcgccaagatcatgaatggagaggctgatgccatgagcctggatggcggctttgtgtacatcgccgggaaatgtggcctggtgcctgtgctggccgagaactacaacaagagtgacaactgtgaggacaccccagaggccggctactttgccatcgctgtggtgaagaagagcgccagtgacctgacctgggacaacctgaagggcaagaagagctgccacacagctgtgggccgcacagctggctggaacatccccatgggcctgctgtacaacaagatcaaccactgccgctttgatgagttcttcagcgagggctgtgcccctggcagcaagaaggacagcagcctgtgcaagctgtgcatgggcagcggcctgaacctgtgtgagcccaacaacaaggagggctactacggctacacaggagccttccgctgcctggtggagaagggagatgtggcctttgtgaagcaccagacagtgccccagaacacaggaggcaagaacccagacccctgggccaagaacctgaatgagaaggactatgagctgctgtgcctggatggcaccaggaagcctgtggaggagtatgccaactgccacctggcccgggcccccaaccacgctgtggtgaccaggaaggacaaggaggcctgtgtgcacaagatcctgcggcagcagcagcacctgtttggcagcaatgtgacagactgcagcggcaacttctgcctcttccgctctgagaccaaggacctgctcttcagagatgacacagtgtgcctggccaagctgcatgacaggaacacctatgagaagtacctgggggaggagtatgtgaaggctgtgggcaacctgaggaagtgcagcaccagcagcctgctggaggcctgcaccttccggcggccctag

SEQ ID NO: 173688 - DNA, 2283 bp, Artificial Sequence
  Description of Artificial Sequence: Synthetic coding sequence
atgatggaccaggcccggagcgccttcagcaacctgtttggaggagagcccctgagctacacccgcttcagcctggcccggcaggtggatggagacaacagccacgtggagatgaagctggccgtggatgaggaggagaatgctgacaacaacaccaaggccaacgtgaccaagcccaagcgctgcagcggcagcatctgctacggcaccatcgccgtcatcgtgttcttcctgattggcttcatgattggctacctgggctactgcaagggcgtggagcccaagacagaatgtgagcggctggccggcacagagagccctgtgcgggaggagcccggggaggacttccctgctgcccggcggctgtactgggatgacctgaagaggaagctgtctgagaagctggacagcacagacttcaccggcaccatcaagctgctgaatgaaaattcctatgtgccccgggaggccggcagccagaaggatgagaacctggccctgtatgtggagaaccagttccgggagttcaagctgagcaaggtgtggagggaccagcactttgtgaagatccaggtgaaggacagcgcccagaacagcgtcatcatcgtggacaagaatggccgcctggtgtacctggtggagaaccctgggggctacgtggcctacagcaaggccgccaccgtgacaggcaagctggtgcacgccaactttggcaccaagaaggactttgaggacctgtacacccctgtgaatggcagcatcgtcatcgtgcgggccggcaagatcacctttgctgagaaggtggccaatgctgagagcctgaatgccatcggcgtgctgatctacatggaccagaccaagttccccatcgtgaatgctgagctgtccttcttcggccacgcccacctgggcactggagacccctacaccccaggcttccccagcttcaaccacacccagttcccccccagccgcagcagcggcctgcccaacatccctgtgcagaccatcagcagagctgctgctgagaagctgtttggaaacatggagggggactgccccagcgactggaagacagacagcacctgcaggatggtgaccagcgagagcaagaatgtgaagctgactgtgtccaatgtgctgaaggagatcaagatcctgaacatctttggagtcatcaagggctttgtggagccagaccactacgtggtggtgggcgcccagagagatgcctggggccctggggccgccaagtctggagtgggcacagccctgctgctgaagctggcccagatgttcagtgacatggtgctgaaggatggcttccagcccagccgcagcatcatctttgcctcctggagcgctggggactttggatctgtgggcgccacagagtggctggagggctacctgagcagcctgcacctgaaggccttcacctacatcaacctggacaaggctgtgctgggcaccagcaacttcaaggtgtctgccagccccctgctgtacaccctcatcgagaagaccatgcagaatgtgaagcaccctgtgacaggccagttcctgtaccaggacagcaactgggccagcaaggtggagaagctgaccctggacaatgctgccttccccttcctggcctacagcggcatcccagctgtgtccttctgcttctgtgaggacacagactacccctacctgggcaccaccatggacacctacaaggagctgattgagcgcatccctgagctgaacaaggtggcccgggctgctgctgaggtggccggccagtttgtgatcaagctgacccatgatgtggagctgaacctggactatgagcgctacaacagccagctgctgagctttgtgcgggacctgaaccagtacagagctgacatcaaggagatgggcctgagcctgcagtggctgtacagcgcccggggggacttcttccgggccaccagccggctgaccacagactttggaaatgctgagaagacagacagatttgtgatgaagaagctgaatgacagagtgatgagggtggagtaccacttcctgagcccctacgtgagccccaaggagagccccttcagacatgtgttctggggcagcggcagccacaccctgcctgccctgctggagaacctgaagctgaggaagcagaacaatggagccttcaatgagaccctcttcaggaaccagctggccctggccacctggaccatccagggcgccgccaatgccctgtctggagatgtgtgggacatcgacaatgagttctag

SEQ ID NO: 173689 - DNA, 2283 bp, Artificial Sequence; identical to SEQ ID NO: 173688
  Description of Artificial Sequence: Synthetic coding sequence

SEQ ID NO: 173690 - DNA, 1437 bp, Artificial Sequence
  Description of Artificial Sequence: Synthetic coding sequence
atggaccagaccaagttccccatcgtgaatgctgagctgtccttcttcggccacgcccacctgggcactggagacccctacaccccaggcttccccagcttcaaccacacccagttcccccccagccgcagcagcggcctgcccaacatccctgtgcagaccatcagcagagctgctgctgagaagctgtttggaaacatggagggggactgccccagcgactggaagacagacagcacctgcaggatggtgaccagcgagagcaagaatgtgaagctgactgtgtccaatgtgctgaaggagatcaagatcctgaacatctttggagtcatcaagggctttgtggagccagaccactacgtggtggtgggcgcccagagagatgcctggggccctggggccgccaagtctggagtgggcacagccctgctgctgaagctggcccagatgttcagtgacatggtgctgaaggatggcttccagcccagccgcagcatcatctttgcctcctggagcgctggggactttggatctgtgggcgccacagagtggctggagggctacctgagcagcctgcacctgaaggccttcacctacatcaacctggacaaggctgtgctgggcaccagcaacttcaaggtgtctgccagccccctgctgtacaccctcatcgagaagaccatgcagaatgtgaagcaccctgtgacaggccagttcctgtaccaggacagcaactgggccagcaaggtggagaagctgaccctggacaatgctgccttccccttcctggcctacagcggcatcccagctgtgtccttctgcttctgtgaggacacagactacccctacctgggcaccaccatggacacctacaaggagctgattgagcgcatccctgagctgaacaaggtggcccgggctgctgctgaggtggccggccagtttgtgatcaagctgacccatgatgtggagctgaacctggactatgagcgctacaacagccagctgctgagctttgtgcgggacctgaaccagtacagagctgacatcaaggagatgggcctgagcctgcagtggctgtacagcgcccggggggacttcttccgggccaccagccggctgaccacagactttggaaatgctgagaagacagacagatttgtgatgaagaagctgaatgacagagtgatgagggtggagtaccacttcctgagcccctacgtgagccccaaggagagccccttcagacatgtgttctggggcagcggcagccacaccctgcctgccctgctggagaacctgaagctgaggaagcagaacaatggagccttcaatgagaccctcttcaggaaccagctggccctggccacctggaccatccagggcgccgccaatgccctgtctggagatgtgtgggacatcgacaatgagttctag

SEQ ID NO: 173691 - DNA, 42 bp, Artificial Sequence
  Description of Artificial Sequence: Synthetic coding sequence
atggaccaggcccggagcgccttcagcaacctggacctgtag

SEQ ID NO: 173692 - DNA, 11493 bp, Artificial Sequence
  Description of Artificial Sequence: Synthetic coding sequence
atggcctttgtggccacccagggcgccaccgtggtggaccagaccaccctgatgaagaagtacctgcagtttgtggccgccctgacagatgtgaacaccccagatgagaccaagctgaagatgatgcaggaggtgtctgaaaattttgaaaatgtgaccagcagcccccagtacagcaccttcctggagcacatcatcccccgcttcctgaccttcctgcaggatggagaggtgcagttcctgcaggagaagccagcccagcagctgaggaagctggtgctggagatcatccaccgcatccccaccaatgagcacctgcggccccacaccaagaatgtgctgtctgtgatgttccgcttcctggagacagaaaatgaagaaaatgtgctgatctgcctgcgcatcatcatcgagctgcacaagcagttccggccccccatcacccaggagatccaccacttcctggactttgtgaagcagatctacaaggagctgcccaaggtggtgaaccgctactttgagaacccccaggtgatcccagaaaatacagtgcccccacctgagatggtgggcatgatcaccaccatcgctgtgaaggtgaaccctgagagagaagattctgagaccaggacccacagcatcatcccccggggcagcctgagcctgaaggtgctggccgagctgcccatcatcgtggtgctgatgtaccagctgtacaagctgaacatccacaacgtggtggccgagtttgtgcccctcatcatgaacaccatcgccatccaggtgtctgcccaggcccggcagcacaagctgtacaacaaggagctgtatgctgacttcatcgccgcccagatcaagaccctgtccttcctggcctacatcatccgcatctaccaggagctggtgaccaagtacagccagcagatggtgaagggcatgctgcagctgctgagcaactgcccagctgagacagcccacctgaggaaggagctgctgattgctgccaagcacatcctgaccacagagctgaggaaccagttcatcccctgcatggacaagctgtttgatgagagcatcctgattggcagcggctacacagcccgggagaccctgcggcccctggcctacagcaccctggccgacctggtgcaccacgtgcggcagcacctgcccctgagtgacctgagcctggccgtgcagctgtttgccaagaacattgatgatgagagcctgcccagcagcatccagaccatgagctgcaagctgctgctgaacctggtggactgcatccgcagcaagtctgagcaggagagcggaaatggaagagatgtgctgatgaggatgctggaggtgtttgtgctgaagttccacaccatcgcccgctaccagctgagcgccatcttcaagaagtgcaagccccagagcgagctgggcgctgtggaggccgccctgcccggggtgcccacagccccagctgcccctggccctgcccccagccctgcccctgtgcctgcccctcctcctcctcctcctcctcctcctccagccacccctgtgaccccagcccctgtgcccccatttgagaagcagggcgagaaggacaaggaggacaagcagaccttccaggtgacagactgccgcagcctggtgaagaccctggtgtgtggggtgaagaccatcacctggggcatcaccagctgcaaggcccctggagaggcccagttcatccccaacaagcagctgcagcccaaggagacccagatctacatcaagctggtgaagtatgccatgcaggccctggacatctaccaggtgcagattgctggaaatggccagacctacatccgggtggccaactgccagacagtgaggatgaaggaggagaaggaggtgctggagcactttgctggggtcttcaccatgatgaaccccctgaccttcaaggagatcttccagaccaccgtgccctacatggtggagcgcatcagcaagaactatgccctgcagatcgtggccaacagcttcctggccaaccccaccaccagcgccctgtttgccaccatcctggtggagtacctgctggaccggctgcctgagatgggcagcaatgtggagctgagcaacctgtacctgaagctgttcaagctggtgtttggatctgtgtccctgtttgctgctgaaaatgagcagatgctgaagccccacctgcacaagatcgtgaacagctccatggagctggcccagacagccaaggagccctacaactacttcctgctgctgcgggccctcttccgcagcattggaggcggcagccatgacctgctgtaccaggagttcctgcccctgctgcccaacctgctgcagggcctgaacatgctgcagagcggcctgcacaagcagcacatgaaggacctgtttgtggagctgtgcctgactgtgcctgtgcggctgagcagcctgctgccctacctgcccatgctgatggaccccctggtgtctgccctgaatggcagccagaccctggtgtcccagggcctgcggaccctggagctgtgtgtggacaacctgcagcctgacttcctgtatgaccacatccagcctgtgcgggcagagctgatgcaggccctgtggaggaccctgagaaatcctgctgacagcatcagccacgtggcctacagagtgctgggcaagtttggaggcagcaacaggaagatgctgaaggagagccagaagctgcactacgtggtgacagaggtgcagggccccagcatcaccgtggagttcagtgactgcaaggccagcctgcagctgcccatggagaaggccattgaaacagccctggactgcctgaagagcgccaacacagagccctactaccgccggcaggcctgggaggtgatcaagtgcttcctggtggccatgatgagcctggaggacaacaagcacgccctgtaccagctgctggcccaccccaacttcacagagaagaccatccccaacgtcatcatcagccaccgctacaaggcccaggacaccccagccaggaagacctttgagcaggccctgactggagccttcatgtctgctgtgatcaaggacctgcggcccagcgccctgccctttgtggccagcctcatccgccactacaccatggtggccgtggcccagcagtgtggccccttcctgctgccctgctaccaggtgggcagccagcccagcacagccatgttccacagtgaagaaaatggcagcaagggcatggaccccctggtgctgattgatgccatcgccatctgcatggcctatgaggagaaggagctgtgcaagatcggggaggtggccctggccgtcatctttgatgtggccagcatcatcctgggcagcaaggagcgggcctgccagctgcccctcttctcctacatcgtggagcggctgtgtgcctgctgctatgagcaggcctggtacgccaagctgggcggcgtggtgtccatcaagttcctgatggagcggctgcccctgacctgggtgctgcagaaccagcagaccttcctgaaggccctgctgtttgtgatgatggacctgactggagaggtgtccaatggagctgtggccatggccaagaccaccctggagcagctgctgatgagatgtgccacccccctgaaggatgaggagagagctgaggagatcgtggccgcccaggagaagagcttccaccacgtgacccatgacctggtgcgggaggtgaccagccccaacagcacagtgaggaagcaggccatgcacagcctgcaggtgctggcccaggtgacaggcaagtctgtgaccgtcatcatggagccccacaaggaggtgctgcaggacatggtgccccccaagaagcacctgctgcggcaccagcctgccaatgcccagatcggcctgatggagggcaacaccttctgcaccaccctgcagcccaggctcttcaccatggacctgaatgtggtggagcacaaggtgttctacacagagctgctgaacctgtgtgaggccgaggacagcgccctgaccaagctgccctgctacaagagcctgcccagcctggtgcccctgagaattgctgccctgaatgccctggccgcctgcaactacctgccccagagccgggagaagatcatcgccgccctcttcaaggccctgaacagcaccaacagcgagctgcaggaggccggggaggcctgcatgaggaagttcctggagggcgccaccatcgaggtggaccagatccacacccacatgaggcccctgctgatgatgctgggggactaccgcagcctgaccctgaatgtggtgaaccggctgacctctgtgaccaggctcttccccaacagcttcaatgacaagttctgtgaccagatgatgcagcacctgaggaagtggatggaggtggtggtgatcacccacaagggcggccagaggagtgatggaaatgagatgaagatctgcagcgccatcatcaacctcttccacctgatcccagctgccccccagaccctggtgaagcccctgctggaggtggtgatgaagacagagcgggccatgctgattgaggccggcagccccttccgggagcccctcatcaagttcctgaccaggcaccccagccagacagtggagctgttcatgatggaggccaccctgaatgacccccagtggagcaggatgttcatgtccttcctgaagcacaaggatgcccggcccctgagagatgtgctggccgccaaccccaaccgcttcatcaccctgctgctgcctggaggagcccagacagctgtgcggcccggcagccccagcaccagcaccatgaggctggacctgcagttccaggccatcaagatcatcagcatcatcgtgaagaatgatgacagctggctggccagccagcacagcctggtgtcccagctgcggcgggtgtgggtgtctgagaacttccaggagcggcacaggaaagaaaacatggccgccaccaactggaaggagcccaagctgctggcctactgcctgctgaactactgcaagaggaactacggggacatcgagctgctcttccagctgctgcgggccttcaccggccgcttcctgtgcaacatgaccttcctgaaggagtacatggaggaggagatccccaagaactacagcatcgcccagaagagggccctcttcttccgctttgtggacttcaatgaccccaactttggagatgagctgaaggccaaggtgctgcagcacatcctgaacccagccttcctgtacagctttgagaagggggagggggagcagctgctgggcccccccaaccctgagggggacaaccctgagagcatcacctctgtgttcatcaccaaggtgctggaccctgagaagcaggccgacatgctggacagcctgcgcatctacctgctgcagtatgccaccctgctggtggagcacgccccccaccacatccatgacaacaacaagaacagaaacagcaagctgcggcggctgatgacctttgcctggccctgcctgctgagcaaggcctgtgtggaccctgcctgcaagtacagcggccacctgctgctggcccacatcatcgccaagtttgccatccacaagaagatcgtgctgcaggtgttccacagcctgctgaaggcccacgccatggaggcccgggccatcgtgcggcaggccatggccatcctgaccccagctgtgcctgccaggatggaggatggccaccagatgctgacccactggaccaggaagatcatcgtggaggagggccacacagtgccccagctggtgcacatcctgcacctgattgtgcagcacttcaaggtgtactaccctgtgcgccaccacctggtgcagcacatggtgtctgccatgcagaggctgggcttcaccccatctgtgaccatcgagcagaggcggctggccgtggacctgtctgaggtggtgatcaagtgggagctgcagaggatcaaggaccagcagcctgacagcgacatggaccccaacagcagtggagagggcgtgaacagcgtgagcagcagcatcaagaggggcctgtctgtggacagcgcccaggaggtgaagcgcttcagaacagccactggagccatctctgctgtgtttggccgcagccagagcctgcctggagctgacagcctgctggccaagcccatcgacaagcagcacacagacacagtggtgaacttcctgatccgggtggcctgccaggtgaatgacaacaccaacacagctggcagccctggagaggtgctgagccgccgctgtgtgaacctgctgaagacagccctgcggccagacatgtggcccaagtctgagctgaagctgcagtggtttgacaagctgctgatgacagtggagcagcccaaccaggtgaactacggcaacatctgcaccggcctggaggtgctgtccttcctgctgactgtgctgcagagccctgccatcctgagcagcttcaagcccctgcagaggggcattgctgcctgcatgacctgtggcaacaccaaggtgctgcgggctgtgcacagcctgctgagccggctgatgagcatcttccccacagagcccagcaccagctctgtggccagcaaatatgaggagctggagtgcctgtatgctgctgtgggcaaggtgatctatgagggcctgaccaactatgagaaggccaccaatgccaaccccagccagctgtttggcaccctgatgatcctgaagagcgcctgcagcaacaaccccagctacatcgacaggctcatctctgtgttcatgaggagcctgcagaagatggtgcgggagcacctgaacccccaggccgccagcggcagcacagaggccaccagcggcaccagcgagctggtgatgctgagcctggagctggtgaagacccggctggccgtgatgtccatggagatgaggaagaacttcatccaggccatcctgaccagcctgattgagaagagcccagatgccaagatcctgcgggctgtggtgaagatcgtggaggagtgggtgaagaacaacagccccatggccgccaaccagacccccaccctgcgggagaagagcatcctgctggtgaagatgatgacctacatcgagaagcgcttccctgaggacctggagctgaatgcccagttcctggacctggtgaactacgtgtacagagatgagaccctgagcggcagcgagctgacagccaagctggagcccgccttcctgagcggcctgcgctgtgcccagcccctcatccgggccaagttctttgaggtgtttgacaacagcatgaagagaagagtgtatgagcggctgctgtatgtgacctgcagccagaactgggaggccatgggcaaccacttctggatcaagcagtgcatcgagctgctgctggccgtgtgtgagaagagcacccccatcggcaccagctgccagggcgccatgctgcccagcatcaccaacgtcatcaacctggccgacagccatgaccgggccgcctttgccatggtgacccacgtgaagcaggagccccgggagcgggagaacagcgagagcaaggaggaggatgtggagattgatattgagctggcccctggggaccagaccagcacccccaagaccaaggagctgtctgagaaggacatcggcaaccagctgcacatgctgaccaacagacatgacaagttcctggacaccctgcgggaggtgaagacaggagccctgctgagcgcctttgtgcagctgtgccacatcagcaccaccctggccgagaagacctgggtgcagctgttcccccggctgtggaagatcctgagtgaccggcagcagcacgccctggccggggagatcagccccttcctgtgcagcggcagccaccaggtgcagagggactgccagcccagcgccctgaactgctttgtggaggccatgagccagtgtgtgccccccatccccatccggccctgtgtgctgaagtacctgggcaagacccacaacctgtggttccgcagcaccctgatgctggagcaccaggcctttgagaagggcctgagcctgcagatcaagcccaagcagaccacagagttctatgagcaggagagcatcaccccaccccagcaggagatcctggacagcctggccgagctgtacagcctgctgcaggaggaggacatgtgggccggcctgtggcagaagcgctgcaagtacagcgagacagccacagccatcgcctatgagcagcacggcttctttgagcaggcccaggagagctatgagaaggccatggacaaggccaagaaggagcacgagaggagcaatgccagccctgccatcttccctgagtaccagctgtgggaggaccactggatccgctgcagcaaggagctgaaccagtgggaggccctgacagaatatggccagagcaagggccacatcaacccctacctggtgctggagtgtgcctggagggtgagcaactggacagccatgaaggaggccctggtgcaggtggaggtgtcctgccccaaggagatggcctggaaggtgaacatgtaccggggctacctggccatctgccaccctgaggagcagcagctgtccttcatcgagcggctggtggagatggccagcagcctggccatccgggagtggaggcggctgccccacgtggtgagccacgtgcacacccccctgctgcaggccgcccagcagatcatcgagctgcaggaggccgcccagatcaatgccggcctgcagcccaccaacctgggcaggaacaacagcctgcatgacatgaagacagtggtgaagacctggaggaaccggctgcccatcgtgtctgatgacctgagccactggagcagcatcttcatgtggaggcagcaccactaccaggccatcgtgacagcctatgagaacagcagccagcacgaccccagcagcaacaatgccatgctgggcgtgcacgccagcgccagcgccatcatccagtatggcaagatcgccaggaagcagggcctggtgaatgtggccctggacatcctgagccgcatccacaccatccccaccgtgcccatcgtggactgcttccagaagatccggcagcaggtgaagtgctacctgcagctggccggcgtgatgggcaagaatgaatgcatgcagggcctggaggtgattgagagcaccaacctgaagtacttcaccaaggagatgacagctgagttctacgccctgaagggcatgttcctggcccagatcaacaagtctgaggaggccaacaaggccttctctgctgctgtgcagatgcatgatgtgctggtgaaggcctgggccatgtggggagactacctggagaacatctttgtgaaggagcggcagctgcacctgggcgtgtctgccatcacctgctacctgcacgcctgccgccaccagaatgaaagcaagagcaggaagtacctggccaaggtgctgtggctgctgagctttgatgatgacaagaacaccctggctgatgctgtggacaagtactgcattggagtgccccccatccagtggctggcctggatcccccagctgctgacctgcctggtgggcagcgagggcaagctgctgctgaacctgatcagccaggtgggccgggtgtacccccaggccgtgtacttccccatccgcaccctgtacctgaccctgaagattgagcagcgggagcgctacaagagtgaccccggccccatccgggccacagcccccatgtggcgctgcagccgcatcatgcacatgcagcgggagctgcaccccaccctgctgagcagcctggagggcatcgtggaccagatggtgtggttccgggagaactggcatgaggaggtgctgcggcagctgcagcagggcctggccaagtgctacagcgtggcctttgagaagagcggggctgtgtctgatgccaagatcaccccccacaccctgaactttgtgaagaagctggtgtccacctttggagtgggcctggagaatgtgtccaatgtgtccaccatgttcagcagcgctgccagcgagagcctggcccggcgggcccaggccacagcccaggaccccgtcttccagaagctgaagggccagttcaccacagactttgacttctctgtgcccggctccatgaagctgcacaacctgatcagcaagctgaagaagtggatcaagatcctggaggccaagaccaagcagctgcccaagttcttcctgattgaggagaagtgccgcttcctgagcaacttcagcgcccagacagctgaggtggagatccctggagagttcctgatgcccaagcccacccactactacatcaagatcgcccgcttcatgccccgggtggagatcgtgcagaagcacaacacagctgcccggcggctgtacatccggggccacaacgggaagatctacccctacctggtgatgaatgatgcctgcctgacagagagcagaagagaggagcgggtgctgcagctgctgcggctgctgaacccctgcctggagaagaggaaggagaccaccaagaggcacctgttcttcaccgtgccccgggtggtggccgtgagcccccagatgaggctggtggaggacaaccccagcagcctgagcctggtggagatctacaagcagagatgtgccaagaagggcattgaacatgacaaccccatcagccgctactatgaccggctggccaccgtgcaggcccggggcacccaggccagccaccaggtgctgcgggacatcctgaaggaggtgcagagcaacatggtgcccaggtccatgctgaaggagtgggccctgcacaccttccccaatgccacagactactggaccttcaggaagatgttcaccatccagctggccctgattggatttgctgagtttgtgctgcacctgaaccggctgaaccctgagatgctgcagatcgcccaggacaccgggaagctgaatgtggcctacttccgctttgacatcaatgatgccactggagacctggatgccaacagacctgtgcccttccggctgacccccaacatcagcgagttcctgaccaccatcggcgtgtctggccccctgacagcctccatgattgctgtggcccgctgctttgcccagcccaacttcaaggtggatggcatcctgaagacagtgctgagagatgagatcatcgcctggcacaagaagacccaggaggacaccagcagccccctgtctgctgctggccagcctgagaacatggacagccagcagctggtgtccctggtgcagaaggctgtgacagccatcatgacccggctgcacaacctggcccagtttgaaggaggagagagcaaggtgaacaccctggtggccgccgccaacagcctggacaacctgtgcaggatggaccctgcctggcacccctggctgtag

SEQ ID NO: 173693 - DNA, 11580 bp, Artificial Sequence
  Description of Artificial Sequence: Synthetic coding sequence
atggcctttgtggccacccagggcgccaccgtggtggaccagaccaccctgatgaagaagtacctgcagtttgtggccgccctgacagatgtgaacaccccagatgagaccaagctgaagatgatgcaggaggtgtctgaaaattttgaaaatgtgaccagcagcccccagtacagcaccttcctggagcacatcatcccccgcttcctgaccttcctgcaggatggagaggtgcagttcctgcaggagaagccagcccagcagctgaggaagctggtgctggagatcatccaccgcatccccaccaatgagcacctgcggccccacaccaagaatgtgctgtctgtgatgttccgcttcctggagacagaaaatgaagaaaatgtgctgatctgcctgcgcatcatcatcgagctgcacaagcagttccggccccccatcacccaggagatccaccacttcctggactttgtgaagcagatctacaaggagctgcccaaggtggtgaaccgctactttgagaacccccaggtgatcccagaaaatacagtgcccccacctgagatggtgggcatgatcaccaccatcgctgtgaaggtgaaccctgagagagaagattctgagaccaggacccacagcatcatcccccggggcagcctgagcctgaaggtgctggccgagctgcccatcatcgtggtgctgatgtaccagctgtacaagctgaacatccacaacgtggtggccgagtttgtgcccctcatcatgaacaccatcgccatccaggtgtctgcccaggcccggcagcacaagctgtacaacaaggagctgtatgctgacttcatcgccgcccagatcaagaccctgtccttcctggcctacatcatccgcatctaccaggagctggtgaccaagtacagccagcagatggtgaagggcatgctgcagctgctgagcaactgcccagctgagacagcccacctgaggaaggagctgctgattgctgccaagcacatcctgaccacagagctgaggaaccagttcatcccctgcatggacaagctgtttgatgagagcatcctgattggcagcggctacacagcccgggagaccctgcggcccctggcctacagcaccctggccgacctggtgcaccacgtgcggcagcacctgcccctgagtgacctgagcctggccgtgcagctgtttgccaagaacattgatgatgagagcctgcccagcagcatccagaccatgagctgcaagctgctgctgaacctggtggactgcatccgcagcaagtctgagcaggagagcggaaatggaagagatgtgctgatgaggatgctggaggtgtttgtgctgaagttccacaccatcgcccgctaccagctgagcgccatcttcaagaagtgcaagccccagagcgagctgggcgctgtggaggccgccctgcccggggtgcccacagccccagctgcccctggccctgcccccagccctgcccctgtgcctgcccctcctcctcctcctcctcctcctcctccagccacccctgtgaccccagcccctgtgcccccatttgagaagcagggcgagaaggacaaggaggacaagcagaccttccaggtgacagactgccgcagcctggtgaagaccctggtgtgtggggtgaagaccatcacctggggcatcaccagctgcaaggcccctggagaggcccagttcatccccaacaagcagctgcagcccaaggagacccagatctacatcaagctggtgaagtatgccatgcaggccctggacatctaccaggtgcagattgctggaaatggccagacctacatccgggtggccaactgccagacagtgaggatgaaggaggagaaggaggtgctggagcactttgctggggtcttcaccatgatgaaccccctgaccttcaaggagatcttccagaccaccgtgccctacatggtggagcgcatcagcaagaactatgccctgcagatcgtggccaacagcttcctggccaaccccaccaccagcgccctgtttgccaccatcctggtggagtacctgctggaccggctgcctgagatgggcagcaatgtggagctgagcaacctgtacctgaagctgttcaagctggtgtttggatctgtgtccctgtttgctgctgaaaatgagcagatgctgaagccccacctgcacaagatcgtgaacagctccatggagctggcccagacagccaaggagccctacaactacttcctgctgctgcgggccctcttccgcagcattggaggcggcagccatgacctgctgtaccaggagttcctgcccctgctgcccaacctgctgcagggcctgaacatgctgcagagcggcctgcacaagcagcacatgaaggacctgtttgtggagctgtgcctgactgtgcctgtgcggctgagcagcctgctgccctacctgcccatgctgatggaccccctggtgtctgccctgaatggcagccagaccctggtgtcccagggcctgcggaccctggagctgtgtgtggacaacctgcagcctgacttcctgtatgaccacatccagcctgtgcgggcagagctgatgcaggccctgtggaggaccctgagaaatcctgctgacagcatcagccacgtggcctacagagtgctgggcaagtttggaggcagcaacaggaagatgctgaaggagagccagaagctgcactacgtggtgacagaggtgcagggccccagcatcaccgtggagttcagtgactgcaaggccagcctgcagctgcccatggagaaggccattgaaacagccctggactgcctgaagagcgccaacacagagccctactaccgccggcaggcctgggaggtgatcaagtgcttcctggtggccatgatgagcctggaggacaacaagcacgccctgtaccagctgctggcccaccccaacttcacagagaagaccatccccaacgtcatcatcagccaccgctacaaggcccaggacaccccagccaggaagacctttgagcaggccctgactggagccttcatgtctgctgtgatcaaggacctgcggcccagcgccctgccctttgtggccagcctcatccgccactacaccatggtggccgtggcccagcagtgtggccccttcctgctgccctgctaccaggtgggcagccagcccagcacagccatgttccacagtgaagaaaatggcagcaagggcatggaccccctggtgctgattgatgccatcgccatctgcatggcctatgaggagaaggagctgtgcaagatcggggaggtggccctggccgtcatctttgatgtggccagcatcatcctgggcagcaaggagcgggcctgccagctgcccctcttctcctacatcgtggagcggctgtgtgcctgctgctatgagcaggcctggtacgccaagctgggcggcgtggtgtccatcaagttcctgatggagcggctgcccctgacctgggtgctgcagaaccagcagaccttcctgaaggccctgctgtttgtgatgatggacctgactggagaggtgtccaatggagctgtggccatggccaagaccaccctggagcagctgctgatgagatgtgccacccccctgaaggatgaggagagagctgaggagatcgtggccgcccaggagaagagcttccaccacgtgacccatgacctggtgcgggaggtgaccagccccaacagcacagtgaggaagcaggccatgcacagcctgcaggtgctggcccaggtgacaggcaagtctgtgaccgtcatcatggagccccacaaggaggtgctgcaggacatggtgccccccaagaagcacctgctgcggcaccagcctgccaatgcccagatcggcctgatggagggcaacaccttctgcaccaccctgcagcccaggctcttcaccatggacctgaatgtggtggagcacaaggtgttctacacagagctgctgaacctgtgtgaggccgaggacagcgccctgaccaagctgccctgctacaagagcctgcccagcctggtgcccctgagaattgctgccctgaatgccctggccgcctgcaactacctgccccagagccgggagaagatcatcgccgccctcttcaaggccctgaacagcaccaacagcgagctgcaggaggccggggaggcctgcatgaggaagttcctggagggcgccaccatcgaggtggaccagatccacacccacatgaggcccctgctgatgatgctgggggactaccgcagcctgaccctgaatgtggtgaaccggctgacctctgtgaccaggctcttccccaacagcttcaatgacaagttctgtgaccagatgatgcagcacctgaggaagtggatggaggtggtggtgatcacccacaagggcggccagaggagtgatggaaatgaaagcatcagtgaatgtggccgctgccccctgagccccttctgccagtttgaggagatgaagatctgcagcgccatcatcaacctcttccacctgatcccagctgccccccagaccctggtgaagcccctgctggaggtggtgatgaagacagagcgggccatgctgattgaggccggcagccccttccgggagcccctcatcaagttcctgaccaggcaccccagccagacagtggagctgttcatgatggaggccaccctgaatgacccccagtggagcaggatgttcatgtccttcctgaagcacaaggatgcccggcccctgagagatgtgctggccgccaaccccaaccgcttcatcaccctgctgctgcctggaggagcccagacagctgtgcggcccggcagccccagcaccagcaccatgaggctggacctgcagttccaggccatcaagatcatcagcatcatcgtgaagaatgatgacagctggctggccagccagcacagcctggtgtcccagctgcggcgggtgtgggtgtctgagaacttccaggagcggcacaggaaagaaaacatggccgccaccaactggaaggagcccaagctgctggcctactgcctgctgaactactgcaagaggaactacggggacatcgagctgctcttccagctgctgcgggccttcaccggccgcttcctgtgcaacatgaccttcctgaaggagtacatggaggaggagatccccaagaactacagcatcgcccagaagagggccctcttcttccgctttgtggacttcaatgaccccaactttggagatgagctgaaggccaaggtgctgcagcacatcctgaacccagccttcctgtacagctttgagaagggggagggggagcagctgctgggcccccccaaccctgagggggacaaccctgagagcatcacctctgtgttcatcaccaaggtgctggaccctgagaagcaggccgacatgctggacagcctgcgcatctacctgctgcagtatgccaccctgctggtggagcacgccccccaccacatccatgacaacaacaagaacagaaacagcaagctgcggcggctgatgacctttgcctggccctgcctgctgagcaaggcctgtgtggaccctgcctgcaagtacagcggccacctgctgctggcccacatcatcgccaagtttgccatccacaagaagatcgtgctgcaggtgttccacagcctgctgaaggcccacgccatggaggcccgggccatcgtgcggcaggccatggccatcctgaccccagctgtgcctgccaggatggaggatggccaccagatgctgacccactggaccaggaagatcatcgtggaggagggccacacagtgccccagctggtgcacatcctgcacctgattgtgcagcacttcaaggtgtactaccctgtgcgccaccacctggtgcagcacatggtgtctgccatgcagaggctgggcttcaccccatctgtgaccatcgagcagaggcggctggccgtggacctgtctgaggtggtgatcaagtgggagctgcagaggatcaaggaccagcagcctgacagcgacatggaccccaacagcagtggagagggcgtgaacagcgtgagcagcagcatcaagaggggcctgtctgtggacagcgcccaggaggtgaagcgcttcagaacagccactggagccatctctgctgtgtttggccgcagccagagcctgcctggagctgacagcctgctggccaagcccatcgacaagcagcacacagacacagtggtgaacttcctgatccgggtggcctgccaggtgaatgacaacaccaacacagctggcagccctggagaggtgctgagccgccgctgtgtgaacctgctgaagacagccctgcggccagacatgtggcccaagtctgagctgaagctgcagtggtttgacaagctgctgatgacagtggagcagcccaaccaggtgaactacggcaacatctgcaccggcctggaggtgctgtccttcctgctgactgtgctgcagagccctgccatcctgagcagcttcaagcccctgcagaggggcattgctgcctgcatgacctgtggcaacaccaaggtgctgcgggctgtgcacagcctgctgagccggctgatgagcatcttccccacagagcccagcaccagctctgtggccagcaaatatgaggagctggagtgcctgtatgctgctgtgggcaaggtgatctatgagggcctgaccaactatgagaaggccaccaatgccaaccccagccagctgtttggcaccctgatgatcctgaagagcgcctgcagcaacaaccccagctacatcgacaggctcatctctgtgttcatgaggagcctgcagaagatggtgcgggagcacctgaacccccaggccgccagcggcagcacagaggccaccagcggcaccagcgagctggtgatgctgagcctggagctggtgaagacccggctggccgtgatgtccatggagatgaggaagaacttcatccaggccatcctgaccagcctgattgagaagagcccagatgccaagatcctgcgggctgtggtgaagatcgtggaggagtgggtgaagaacaacagccccatggccgccaaccagacccccaccctgcgggagaagagcatcctgctggtgaagatgatgacctacatcgagaagcgcttccctgaggacctggagctgaatgcccagttcctggacctggtgaactacgtgtacagagatgagaccctgagcggcagcgagctgacagccaagctggagcccgccttcctgagcggcctgcgctgtgcccagcccctcatccgggccaagttctttgaggtgtttgacaacagcatgaagagaagagtgtatgagcggctgctgtatgtgacctgcagccagaactgggaggccatgggcaaccacttctggatcaagcagtgcatcgagctgctgctggccgtgtgtgagaagagcacccccatcggcaccagctgccagggcgccatgctgcccagcatcaccaacgtcatcaacctggccgacagccatgaccgggccgcctttgccatggtgacccacgtgaagcaggagccccgggagcgggagaacagcgagagcaaggaggaggatgtggagattgatattgagctggcccctggggaccagaccagcacccccaagaccaaggagctgtctgagaaggacatcggcaaccagctgcacatgctgaccaacagacatgacaagttcctggacaccctgcgggaggtgaagacaggagccctgctgagcgcctttgtgcagctgtgccacatcagcaccaccctggccgagaagacctgggtgcagctgttcccccggctgtggaagatcctgagtgaccggcagcagcacgccctggccggggagatcagccccttcctgtgcagcggcagccaccaggtgcagagggactgccagcccagcgccctgaactgctttgtggaggccatgagccagtgtgtgccccccatccccatccggccctgtgtgctgaagtacctgggcaagacccacaacctgtggttccgcagcaccctgatgctggagcaccaggcctttgagaagggcctgagcctgcagatcaagcccaagcagaccacagagttctatgagcaggagagcatcaccccaccccagcaggagatcctggacagcctggccgagctgtacagcctgctgcaggaggaggacatgtgggccggcctgtggcagaagcgctgcaagtacagcgagacagccacagccatcgcctatgagcagcacggcttctttgagcaggcccaggagagctatgagaaggccatggacaaggccaagaaggagcacgagaggagcaatgccagccctgccatcttccctgagtaccagctgtgggaggaccactggatccgctgcagcaaggagctgaaccagtgggaggccctgacagaatatggccagagcaagggccacatcaacccctacctggtgctggagtgtgcctggagggtgagcaactggacagccatgaaggaggccctggtgcaggtggaggtgtcctgccccaaggagatggcctggaaggtgaacatgtaccggggctacctggccatctgccaccctgaggagcagcagctgtccttcatcgagcggctggtggagatggccagcagcctggccatccgggagtggaggcggctgccccacgtggtgagccacgtgcacacccccctgctgcaggccgcccagcagatcatcgagctgcaggaggccgcccagatcaatgccggcctgcagcccaccaacctgggcaggaacaacagcctgcatgacatgaagacagtggtgaagacctggaggaaccggctgcccatcgtgtctgatgacctgagccactggagcagcatcttcatgtggaggcagcaccactaccagggcaagcccacctggagcggcatgcacagcagcagcatcgtgacagcctatgagaacagcagccagcacgaccccagcagcaacaatgccatgctgggcgtgcacgccagcgccagcgccatcatccagtatggcaagatcgccaggaagcagggcctggtgaatgtggccctggacatcctgagccgcatccacaccatccccaccgtgcccatcgtggactgcttccagaagatccggcagcaggtgaagtgctacctgcagctggccggcgtgatgggcaagaatgaatgcatgcagggcctggaggtgattgagagcaccaacctgaagtacttcaccaaggagatgacagctgagttctacgccctgaagggcatgttcctggcccagatcaacaagtctgaggaggccaacaaggccttctctgctgctgtgcagatgcatgatgtgctggtgaaggcctgggccatgtggggagactacctggagaacatctttgtgaaggagcggcagctgcacctgggcgtgtctgccatcacctgctacctgcacgcctgccgccaccagaatgaaagcaagagcaggaagtacctggccaaggtgctgtggctgctgagctttgatgatgacaagaacaccctggctgatgctgtggacaagtactgcatcggcgtgccccccatccagtggctggcctggatcccccagctgctgacctgcctggtgggcagcgagggcaagctgctgctgaacctgatcagccaggtgggccgggtgtacccccaggccgtgtacttccccatccgcaccctgtacctgaccctgaagattgagcagcgggagcgctacaagagtgaccccggccccatccgggccacagcccccatgtggcgctgcagccgcatcatgcacatgcagcgggagctgcaccccaccctgctgagcagcctggagggcatcgtggaccagatggtgtggttccgggagaactggcatgaggaggtgctgcggcagctgcagcagggcctggccaagtgctacagcgtggcctttgagaagtctggagctgtgtctgatgccaagatcaccccccacaccctgaactttgtgaagaagctggtgtccaccttcggcgtgggcctggagaatgtgtccaatgtgtccaccatgttcagcagcgctgccagcgagagcctggcccggcgggcccaggccacagcccaggaccctgtgttccagaagctgaagggccagttcaccacagactttgacttctctgtgcccggctccatgaagctgcacaacctgatcagcaagctgaagaagtggatcaagatcctggaggccaagaccaagcagctgcccaagttcttcctgattgaggagaagtgccgcttcctgagcaacttcagcgcccagacagctgaggtggagatccctggagagttcctgatgcccaagcccacccactactacatcaagatcgcccgcttcatgccccgggtggagatcgtgcagaagcacaacacagctgcccggcggctgtacatccggggccacaacgggaagatctacccctacctggtgatgaatgatgcctgcctgacagagagccggcgggaggagcgggtgctgcagctgctgcggctgctgaacccctgcctggagaagaggaaggagaccaccaagaggcacctgttcttcaccgtgccccgggtggtggccgtgagcccccagatgaggctggtggaggacaaccccagcagcctgagcctggtggagatctacaagcagagatgtgccaagaagggcatcgagcatgacaaccccatcagccgctactatgaccggctggccaccgtgcaggcccggggcacccaggccagccaccaggtgctgcgggacatcctgaaggaggtgcagagcaacatggtgcccaggtccatgctgaaggagtgggccctgcacaccttccccaatgccacagactactggaccttcaggaagatgttcaccatccagctggccctgattggatttgctgagtttgtgctgcacctgaaccggctgaaccctgagatgctgcagatcgcccaggacaccgggaagctgaatgtggcctacttccgctttgacatcaatgatgccaccggggacctggatgccaacagacctgtgcccttccggctgacccccaacatcagcgagttcctgaccaccatcggcgtgtctggccccctgacagcctccatgattgctgtggcccgctgctttgcccagcccaacttcaaggtggatggcatcctgaagacagtgctgagagatgagatcatcgcctggcacaagaagacccaggaggacaccagcagccccctgtctgctgctggccagcctgagaacatggacagccagcagctggtgtccctggtgcagaaggctgtgacagccatcatgacccggctgcacaacctggcccagtttgagggcggggagagcaaggtgaacaccctggtggccgccgccaacagcctggacaacctgtgcaggatggaccctgcctggcacccctggctgtag

SEQ ID NO: 173694 - DNA, 216 bp, Artificial Sequence
  Description of Artificial Sequence: Synthetic coding sequence
atggcctttgtggccacccagggcgccaccgtggtggaccagaccaccctgatgaagaagtacctgcagtttgtggccgccctgacagatgtgaacaccccagatgagaccaagctgaagatgatgcaggaggtgtctgaaaattttgaaaatgtgaccagcagcccccagtacagcaccttcctggagcacatcatcccccgcttcctgacctag

SEQ ID NO: 173695 - DNA, 117 bp, Artificial Sequence
  Description of Artificial Sequence: Synthetic coding sequence
atgtctgacagcggggagcagaactatggagagcgggtgaatgtggaggagggcaaatgtggcagccgccacctgaccagcttcatcaatgagtacctgaagctgaggaacaagtag

SEQ ID NO: 173696 - DNA, 567 bp, Artificial Sequence
  Description of Artificial Sequence: Synthetic coding sequence
atgagcaccaggagaagacatgtgggcaacagagccaacccagaccccaactgctgcctgggcgtgtttggcctgagcctgtacaccacagagcgggacctgcgggaggtgttcagcaaatatggccccatcgcagatgtgtccatcgtgtatgaccagcagagccgccgcagccggggctttgcctttgtgtactttgaaaatgtggatgatgccaaggaggccaaggagcgggccaacggcatggagctggatggaagacgcatccgggtggacttcagcatcaccaagaggccccacacccccaccccaggcatctacatgggccggcccacctacggcagcagcagaagaagagactactatgaccggggctatgaccggggctatgatgaccgggactactacagccgcagctaccggggcggcggcggcggcggcggcggctggagggctgcccaggaccgggaccagatctacagaagaagaagccccagcccctactacagccggggcggctaccgcagccgcagccgcagccgcagctacagcccccggcgctactag

SEQ ID NO: 173697 - DNA, 867 bp, Artificial Sequence
  Description of Artificial Sequence: Synthetic coding sequence
atgtctgacagcggggagcagaactatggagagcgggagagccgcagcgccagccgcagcggcagcgcccacggcagcggcaagagcgcccggcacaccccagcccggagccgcagcaaagaagacagccgccgcagccgcagcaagagccgcagccgctctgagagccgcagccgcagcagaagaagcagcagaagacactacaccaggagccgcagccgcagccgcagccacagaagaagccgcagccgcagctacagccgggactacagaagaagacacagccacagccacagccccatgagcaccaggagaagacatgtgggcaacagagccaacccagaccccaactgctgcctgggcgtgtttggcctgagcctgtacaccacagagcgggacctgcgggaggtgttcagcaaatatggccccatcgcagatgtgtccatcgtgtatgaccagcagagccgccgcagccggggctttgcctttgtgtactttgaaaatgtggatgatgccaaggaggccaaggagcgggccaacggcatggagctggatggaagacgcatccgggtggacttcagcatcaccaagaggccccacacccccaccccaggcatctacatgggccggcccacctacggcagcagcagaagaagagactactatgaccggggctatgaccggggctatgatgaccgggactactacagccgcagctaccggggcggcggcggcggcggcggcggctggagggctgcccaggaccgggaccagatctacagaagaagaagccccagcccctactacagccggggcggctaccgcagccgcagccgcagccgcagctacagcccccggcgctactag

SEQ ID NO: 173698 - DNA, 483 bp, Artificial Sequence
  Description of Artificial Sequence: Synthetic coding sequence
atggtgcccagcgctggccagctggccctgtttgccctgggcatcgtgctggccgcctgccaggccctggagaacagcaccagccccctgtctgctgacccccctgtggccgctgctgtggtgagccacttcaatgactgcccagacagccacacccagttctgcttccacggcacctgccgcttcctggtgcaggaggacaagccagcctgtgtgtgccacagcggctacgtgggcgcccgctgtgagcacgccgacctgctggccgtggtggccgccagccagaagaagcaggccatcacagccctggtggtggtgtccatcgtggccctggccgtgctgatcatcacctgtgtgctgatccactgctgccaggtgaggaagcactgtgagtggtgccgggccctgatctgcagacatgagaagcccagcgccctgctgaagggccgcacagcctgctgccacagcgagaccgtggtgtag

SEQ ID NO: 173699 - DNA, 480 bp, Artificial Sequence
  Description of Artificial Sequence: Synthetic coding sequence
atggtgcccagcgctggccagctggccctgtttgccctgggcatcgtgctggccgcctgccaggccctggagaacagcaccagccccctgagtgacccccctgtggccgctgctgtggtgagccacttcaatgactgcccagacagccacacccagttctgcttccacggcacctgccgcttcctggtgcaggaggacaagccagcctgtgtgtgccacagcggctacgtgggcgcccgctgtgaacatgctgacctgctggccgtggtggccgccagccagaagaagcaggccatcacagccctggtggtggtgtccatcgtggccctggccgtgctgatcatcacctgtgtgctgatccactgctgccaggtgaggaagcactgtgagtggtgccgggccctgatctgcagacatgagaagcccagcgccctgctgaagggccgcacagcctgctgccacagcgagaccgtggtgtag

SEQ ID NO: 173700 - DNA, 2583 bp, Artificial Sequence
  Description of Artificial Sequence: Synthetic coding sequence
atgatgagcatcaaggccttcaccctggtgtctgctgtggagcgggagctgctgatgggagacaaggagcgggtgaacattgaatgtgtggagtgctgcggccgggacctgtatgtgggcaccaatgactgctttgtgtaccacttcctgctggaggagaggcctgtgcctgctggccctgccaccttcaccgccaccaagcagctgcagaggcacctgggcttcaagaagcctgtgaatgagctgcgggccgccagcgccctgaaccggctgctggtgctgtgtgacaacagcatcagcctggtgaacatgctgaacctggagcctgtgcccagcggggcccgcatcaagggagctgccacctttgccctgaatgaaaatcctgtgtctggggaccccttctgtgtggaggtgtgcatcatctctgtgaagaggaggaccatccagatgttcctggtgtatgaagatagagtgcagatcgtgaaggaggtgtccacagctgagcagcccctggccgtggccgtggatggccacttcctgtgcctggccctgaccacccagtacatcatccacaactacagcactggagtgtcccaggacctcttcccctactgcagcgaggagcggccccccatcgtgaagagaattggccggcaggagttcctgctggccggccctgggggcctgggcatgtttgccaccgtggccggcatcagccagagggcccctgtgcactggagcgaaaatgtgattggagctgctgtgtccttcccctacgtgattgccctggatgatgagttcatcaccgtgcacagcatgctggaccagcagcagaagcagaccctgcccttcaaggagggccacatcctgcaggactttgagggccgggtcatcgtggccaccagcaaaggagtgtacatcctggtgcccctgcccctggagaagcagatccaggacctgctggccagccggcgggtggaggaggccctggtgctggccaagggggcccggaggaacatccccaaggagaagttccaggtgatgtaccgccgcatcctgcagcaggccggcttcatccagtttgcccagctgcagttcctggaggccaaggagctgttccgcagcggccagctggatgtgcgggagctgatcagcctgtaccccttcctgctgcccaccagcagcagcttcaccaggagccacccccccctgcatgaatatgctgacctgaaccagctgacccagggcgaccaggagaagatggccaagtgcaagcgcttcctgatgagctacctgaatgaggtgcgcagcacagaggtggccaacggctacaaggaggacatcgacacagccctgctgaagctgtatgcagaggccgaccatgacagcctgctggacctgctggtgacagagaacttctgcctgctgacagattctgctgcctggctggagaagcacaagaagtactttgccctgggcctgctgtaccactacaacaaccaggatgctgctgctgtgcagctgtgggtgaacatcgtgaatggagatgtgcaggacagcaccaggagtgacctgtatgagtacatcgtggacttcctgacctactgcctggatgaggagctggtgtgggcctatgctgactgggtgctgcagaagtctgaggaggtgggcgtgcaggtgttcaccaagaggcccctggatgagcagcagaagaacagcttcaacccagatgacatcatcaactgcctgaagaagtaccccaaggccctggtgaagtacctggagcacctggtgattgacaagaggctgcagaaggaggagtaccacacccacctggccgtgctgtacctggaggaggtgctgctgcagagggccagcgccagcgggaaaggagctgaggccacagagacccaggccaagctgcggcggctgctgcagaagagtgacctgtacagagtgcacttcctgctggagcggctgcagggcgccggcctgcccatggagagcgccatcctgcacggcaagctgggggagcacgagaaggccctgcacatcctggtgcatgagctgcaggactttgctgctgctgaggactactgcctgtggtgcagcgagggccgggaccccccccaccggcagcagctgttccacaccctgctggccatctacctgcacgccggccccacagcccacgagctggccgtggccgctgtggacctgctgaacagacatgccacagaatttgatgctgcccaggtgctgcagatgctgcctgacacctggagcgtgcagctgctgtgccccttcctgatgggcgccatgagggacagcatccacgcccggaggaccatgcaggtggccctgggcctggcccggtctgagaacctgatctacacctatgacaagatgaagctgaagggcagcagcatccagctgagtgacaagaagctgtgccagatctgccagaaccccttctgtgagcctgtgtttgtgcgctacccaaatggaggcctggtgcacacccactgtgccgccagccgccacaccaaccccagcagcagcagccctggcaccaggacatag

SEQ ID NO: 173701 - DNA, 2583 bp, Artificial Sequence; identical to SEQ ID NO: 173700
  Description of Artificial Sequence: Synthetic coding sequence

SEQ ID NO: 173702 - DNA, 948 bp, Artificial Sequence
  Description of Artificial Sequence: Synthetic coding sequence
atgctgattggcagctgcaggaaggtgaagaggtctgtgcaggtgttcaccaagaggcccctggatgagcagcagaagaacagcttcaacccagatgacatcatcaactgcctgaagaagtaccccaaggccctggtgaagtacctggagcacctggtgattgacaagaggctgcagaaggaggagtaccacacccacctggccgtgctgtacctggaggaggtgctgctgcagagggccagcgccagcgggaaaggagctgaggccacagagacccaggccaagctgcggcggctgctgcagaagagtgacctgtacagagtgcacttcctgctggagcggctgcagggcgccggcctgcccatggagagcgccatcctgcacggcaagctgggggagcacgagaaggccctgcacatcctggtgcatgagctgcaggactttgctgctgctgaggactactgcctgtggtgcagcgagggccgggaccccccccaccggcagcagctgttccacaccctgctggccatctacctgcatgctggccccacagcccacgagctggccgtggccgctgtggacctgctgaacagacatgccacagaatttgatgctgcccaggtgctgcagatgctgcctgacacctggagcgtgcagctgctgtgccccttcctgatgggcgccatgagggacagcatccacgcccggaggaccatgcaggtggccctgggcctggcccggagtgaaaatctcatctacacctatgacaagatgaagctgaagggcagcagcatccagctgagtgacaagaagctgtgccagatctgccagaaccccttctgtgagcctgtgtttgtgcgctaccccaacggcggcctggtgcacacccactgtgccgccagccgccacaccaaccccagcagcagcagccctggcaccaggacatag

SEQ ID NO: 173703 - DNA, 1704 bp, Artificial Sequence
  Description of Artificial Sequence: Synthetic coding sequence
atgggccggggcctgctgcggggcctgtggcccctgcacatcgtgctgtggacccgcatcgccagcaccatcccccctcatgtgcagaagtctgtgaacaatgacatgattgtgacagacaacaacggggctgtgaagttcccccagctgtgcaagttctgtgatgtgcgcttcagcacctgtgacaaccagaagagctgcatgagcaactgcagcatcaccagcatctgtgagaagccccaggaggtgtgtgtggccgtgtggaggaagaatgatgagaacatcaccctggagaccgtgtgccacgaccccaagctgccctaccatgacttcatcctggaggatgctgccagccccaagtgcatcatgaaggagaagaagaagccaggagagaccttcttcatgtgcagctgcagcagtgatgagtgcaatgacaacatcatcttcagcgaggagtacaacaccagcaacccagacctgctgctggtgatcttccaggtgacaggcatcagcctgctgccccccctgggcgtggccatcagcgtcatcatcatcttctactgctacagagtgaaccggcagcagaagctgagcagcacctgggagaccgggaagaccaggaagctgatggagttcagcgagcactgtgccatcatcctggaggatgacagaagtgacatcagcagcacctgtgccaacaacatcaaccacaacacagagctgctgcccatcgagctggacaccctggtgggcaagggccgctttgctgaggtgtacaaggccaagctgaagcagaacaccagcgagcagtttgaaacagtggccgtgaagatcttcccctatgaggagtatgcctcctggaagacagagaaggacatcttcagtgacatcaacctgaagcatgagaacatcctgcagttcctgacagctgaggagaggaagacagagctgggcaagcagtactggctgatcacagccttccacgccaagggcaacctgcaggagtacctgaccaggcatgtgatctcctgggaggacctgaggaagctgggcagcagcctggcccggggcatcgcccacctgcacagcgaccacaccccctgtggccggcccaagatgcccatcgtgcaccgggacctgaagagcagcaacatcctggtgaagaatgacctgacctgctgcctgtgtgactttggcctgagcctgcggctggaccccaccctgtctgtggatgacctggccaacagcggccaggtgggcacagcccgctacatggcccctgaggtgctggagagcaggatgaacctggagaatgtggagagcttcaagcagacagatgtgtacagcatggccctggtgctgtgggagatgaccagccgctgcaatgctgtgggggaggtgaaggactatgagccccccttcggcagcaaggtgcgggagcacccctgtgtggagagcatgaaggacaacgtgctgcgggaccggggccggcctgagatccccagcttctggctgaaccaccagggcatccagatggtgtgtgagaccctgacagagtgctgggaccatgaccctgaggcccggctgacagcccagtgtgtggccgagcgcttcagcgagctggagcacctggaccggctgagcggccgcagctgcagcgaggagaagatcccagaagatggcagcctgaacaccaccaagtag

SEQ ID NO: 173704 - DNA, 1779 bp, Artificial Sequence
  Description of Artificial Sequence: Synthetic coding sequence
atgggccggggcctgctgcggggcctgtggcccctgcacatcgtgctgtggacccgcatcgccagcaccatcccccctcatgtgcagaagagtgatgtggagatggaggcccagaaggatgagatcatctgccccagctgcaacagaacagcccaccccctgcggcacatcaacaatgacatgattgtgacagacaacaatggagctgtgaagttcccccagctgtgcaagttctgtgatgtgcgcttcagcacctgtgacaaccagaagagctgcatgagcaactgcagcatcaccagcatctgtgagaagccccaggaggtgtgtgtggccgtgtggaggaagaatgatgagaacatcaccctggagaccgtgtgccacgaccccaagctgccctaccatgacttcatcctggaggatgctgccagccccaagtgcatcatgaaggagaagaagaagccaggagagaccttcttcatgtgcagctgcagcagtgatgaatgtaatgacaacatcatcttcagcgaggagtacaacaccagcaacccagacctgctgctggtgatcttccaggtgacaggcatcagcctgctgccccccctgggcgtggccatcagcgtcatcatcatcttctactgctacagagtgaaccggcagcagaagctgagcagcacctgggagaccgggaagaccaggaagctgatggagttcagcgagcactgtgccatcatcctggaggatgacagaagtgacatcagcagcacctgtgccaacaacatcaaccacaacacagagctgctgcccatcgagctggacaccctggtgggcaagggccgctttgctgaggtgtacaaggccaagctgaagcagaacaccagcgagcagtttgagaccgtggccgtgaagatcttcccctatgaggagtatgcctcctggaagacagagaaggacatcttcagtgacatcaacctgaagcatgagaacatcctgcagttcctgacagctgaggagaggaagacagagctgggcaagcagtactggctgatcacagccttccacgccaagggcaacctgcaggagtacctgaccaggcatgtgatctcctgggaggacctgaggaagctgggcagcagcctggcccggggcatcgcccacctgcacagcgaccacaccccctgtggccggcccaagatgcccatcgtgcaccgggacctgaagagcagcaacatcctggtgaagaatgacctgacctgctgcctgtgtgactttggcctgagcctgcggctggaccccaccctgtctgtggatgacctggccaacagcggccaggtgggcacagcccgctacatggcccctgaggtgctggagagcaggatgaacctggagaatgtggagagcttcaagcagacagatgtgtacagcatggccctggtgctgtgggagatgaccagccgctgcaatgctgtgggggaggtgaaggactatgagcccccatttggcagcaaggtgcgggagcacccctgtgtggagagcatgaaggacaacgtgctgcgggaccggggccggcctgagatccccagcttctggctgaaccaccagggcatccagatggtgtgtgagaccctgacagagtgctgggaccatgaccctgaggcccggctgacagcccagtgtgtggccgagcgcttcagcgagctggagcacctggaccggctgagcggccgcagctgcagcgaggagaagatcccagaagatggcagcctgaacaccaccaagtag

SEQ ID NO: 173705 - DNA, 339 bp, Artificial Sequence
  Description of Artificial Sequence: Synthetic coding sequence
atgtgcagctgcagcagtgatgagtgcaatgacaacatcatcttcagcgagggccgctgcaagatccgccacatcggcagcaacaaccggctgcagaggagcacctgccagaacacaggctgggagagcgcccacgtgatgaagaccccaggcttccgggagtacaacaccagcaacccagacctgctgctggtgatcttccaggtgacaggcatcagcctgctgccccccctgggcgtggccatcagcgtcatcatcatcttctactgctacagagtgaaccggcagcagaagctgagcagcacctgggagaccgggaagaccaggaagctgatgtag

SEQ ID NO: 173706 - DNA, 1194 bp, Artificial Sequence
  Description of Artificial Sequence: Synthetic coding sequence
atgtgcagctgcagcagtgatgagtgcaatgacaacatcatcttcagcgaggagtacaacaccagcaacccagacctgctgctggtgatcttccaggtgacaggcatcagcctgctgccccccctgggcgtggccatcagcgtcatcatcatcttctactgctacagagtgaaccggcagcagaagctgagcagcacctgggagaccgggaagaccaggaagctgatggagttcagcgagcactgtgccatcatcctggaggatgacagaagtgacatcagcagcacctgtgccaacaacatcaaccacaacacagagctgctgcccatcgagctggacaccctggtgggcaagggccgctttgctgaggtgtacaaggccaagctgaagcatgagaacatcctgcagttcctgacagctgaggagaggaagacagagctgggcaagcagtactggctgatcacagccttccacgccaagggcaacctgcaggagtacctgaccaggcatgtgatctcctgggaggacctgaggaagctgggcagcagcctggcccggggcatcgcccacctgcacagcgaccacaccccctgtggccggcccaagatgcccatcgtgcaccgggacctgaagagcagcaacatcctggtgaagaatgacctgacctgctgcctgtgtgactttggcctgagcctgcggctggaccccaccctgtctgtggatgacctggccaacagcggccaggtgggcacagcccgctacatggcccctgaggtgctggagagcaggatgaacctggagaatgtggagagcttcaagcagacagatgtgtacagcatggccctggtgctgtgggagatgaccagccgctgcaatgctgtgggggaggtgaaggactatgagccccccttcggcagcaaggtgcgggagcacccctgtgtggagagcatgaaggacaacgtgctgcgggaccggggccggcctgagatccccagcttctggctgaaccaccagggcatccagatggtgtgtgagaccctgacagagtgctgggaccatgaccctgaggcccggctgacagcccagtgtgtggccgagcgcttcagcgagctggagcacctggaccggctgagcggccgcagctgcagcgaggagaagatcccagaagatggcagcctgaacaccaccaagtag

SEQ ID NO: 173707 - DNA, 2244 bp, Artificial Sequence
  Description of Artificial Sequence: Synthetic coding sequence
atggctgatgaagctgccctggccctgcagcccggcggcagccccagcgctgctggagctgaccgggaggccgccagcagccctgctggggagcccctgaggaagaggcccaggagagatggccctggcctggagaggagccctggagagcctggaggagctgcccctgagcgggaggtgcctgctgctgcccggggctgccctggagctgctgctgctgccctgtggagggaggccgaggccgaggccgctgctgctggaggagagcaggaggcccaggccacagctgctgctggggagggggacaatggacctggcctgcagggccccagccgggagccccccctggccgacaacctgtatgatgaagatgatgatgatgaaggagaggaggaggaggaggccgctgctgctgccatcggctacagagacaacctgctgtttggagatgagatcatcaccaacggcttccacagctgtgagagtgatgaagaagatcgggccagccacgccagcagcagtgactggaccccccggccccgcatcggcccctacacctttgtgcagcagcacctgatgattggaacagaccccaggaccatcctgaaggacctgctgcctgagaccatccccccacctgagctggatgacatgaccctgtggcagatcgtcatcaacatcctgtctgagccccccaagaggaagaagaggaaggacatcaacaccattgaagatgctgtgaagctgctgcaggagtgcaagaagatcatcgtgctgaccggggccggcgtgtctgtgtcctgtggcatcccagacttccgcagcagagatggcatctatgcccggctggccgtggacttcccagacctgcctgacccccaggccatgtttgatattgagtacttcaggaaggacccccggcccttcttcaagtttgccaaggagatctacccaggccagttccagcccagcctgtgccacaagttcatcgccctgagtgacaaggagggcaagctgctgaggaactacacccagaacatcgacaccctggagcaggtggccggcatccagaggatcatccagtgccacggcagctttgccacagccagctgcctgatctgcaagtacaaggtggactgtgaggccgtgcggggggacatcttcaaccaggtggtgccccgctgcccccgctgcccagcagatgagcccctggccatcatgaagccagaaattgtgttcttcggggagaacctgcctgagcagttccaccgggccatgaagtatgacaaggatgaggtggacctgctgattgtgattggcagcagcctgaaggtgcggcctgtggccctgatccccagcagcatcccccatgaggtgccccagatcctgatcaaccgggagcccctgccccacctgcactttgatgtggagctgctgggggactgtgatgtgatcatcaatgagctgtgccaccggctgggcggggagtatgccaagctgtgctgcaaccctgtgaagctgtctgagatcacagagaagccacccaggacccagaaggagctggcctacctgtctgagctgccccccacccccctgcacgtgtctgaggacagcagcagccctgagaggaccagccccccagacagcagcgtcatcgtgaccctgctggaccaggccgccaagagcaatgatgacctggatgtgtctgagagcaagggctgcatggaggagaagccccaggaggtgcagaccagcagaaatgtggagagcattgctgagcagatggagaacccagacctgaagaatgtgggcagcagcactggagagaagaatgaaagaacatctgtggccggcaccgtgaggaagtgctggcccaacagagtggccaaggagcagatcagccggcggctggatggcaaccagtacctgttcctgccccccaaccgctacatcttccatggagctgaggtgtacagcgacagtgaagatgatgtgctgagcagcagcagctgtggcagcaacagcgacagcggcacctgccagagccccagcctggaggagcccatggaggatgaaagtgaaattgaggagttctacaacggcctggaggatgagccagatgtgcctgagcgggccggcggggccggctttggaacagatggagatgaccaggaggccatcaatgaggccatctctgtgaagcaggaggtgacagacatgaactaccccagcaacaagagctag

SEQ ID NO: 173708 - DNA, 2553 bp, Artificial Sequence
  Description of Artificial Sequence: Synthetic coding sequence
atgaccagccactacgtgattgccatctttgccctgatgagcagctgcctggccacagctggccctgagcccggggccctgtgtgagctgagccctgtgtctgccagccaccctgtgcaggccctgatggagagcttcaccgtgctgagcggctgtgccagccggggcaccaccggcctgccccaggaggtgcacgtgctgaacctgaggacagctggccagggccctggccagctgcagcgggaggtgaccctgcacctgaaccccatcagctctgtgcacatccaccacaagtctgtggtgttcctgctgaacagcccccaccccctggtgtggcacctgaagacagagcggctggccactggagtgtcccggctcttcctggtgtctgagggctctgtggtgcagttcagcagcgccaacttcagcctgacagctgagacagaggagaggaacttcccccatggaaatgagcacctgctgaactgggccaggaaggagtatggagctgtgaccagcttcacagagctgaagatcgccaggaacatctacatcaaggtgggggaggaccaggtgttcccccccaagtgcaacatcggcaagaacttcctgagcctgaactacctggccgagtacctgcagcccaaggctgctgagggctgtgtgatgagcagccagccccagaatgaggaggtgcacatcatcgagctgatcacccccaacagcaacccctacagcgccttccaggtggacatcaccatcgacatccggcccagccaggaggacctggaggtggtgaagaacctgatcctgatcctgaagtgcaagaagtctgtgaactgggtgatcaagagctttgatgtgaagggcagcctgaagatcatcgcccccaacagcatcggctttgggaaggagagcgagaggtccatgaccatgaccaagagcatcagagatgacatccccagcacccagggcaacctggtgaagtgggccctggacaatggctacagccccatcaccagctacaccatggcccctgtggccaaccgcttccacctgcggctggagaacaatgaggagatgggagatgaggaggtgcacaccatccccccagagctgcgcatcctgctggaccccggggccctgcctgccctgcagaacccccccatccggggcggggagggccagaatggaggcctgcccttccccttcccagacatcagcagaagagtgtggaatgaggagggagaagatggcctgccccggcccaaggaccccgtcatccccagcatccagctgtttcctggcctgcgggagcctgaggaggtgcagggctctgtggacatcgccctgtctgtgaagtgtgacaatgagaagatgattgtggccgtggagaaggacagcttccaggccagcggctacagcggcatggatgtgaccctgctggaccccacctgcaaggccaagatgaatggcacccactttgtgctggagagccccctgaatggctgcggcacccggccccgctggagcgccctggatggagtggtgtactacaacagcatcgtcatccaggtgcctgccctgggggacagcagcggctggccagatggctatgaggacctggagagcggggacaatggcttccctggggacatggatgaaggagatgccagcctcttcaccaggcctgagatcgtggtgttcaactgcagcctgcagcaggtgaggaaccccagcagcttccaggagcagccccacggcaacatcaccttcaacatggagctgtacaacacagacctcttcctggtgcccagccagggcgtcttctctgtgcctgaaaatggacatgtgtatgtggaggtgtctgtgaccaaggccgagcaggagctgggctttgccatccagacctgcttcatcagcccctacagcaacccagacaggatgagccactacaccatcatcgagaacatctgccccaaggatgagagcgtgaagttctacagccccaagagggtgcacttccccatcccccaggccgacatggacaagaagcgcttctcctttgtgttcaagcctgtgttcaacaccagcctgctcttcctgcagtgtgagctgaccctgtgcaccaagatggagaagcacccccagaagctgcccaagtgtgtgcccccagatgaggcctgcaccagcctggatgccagcatcatctgggccatgatgcagaacaagaagaccttcaccaagcccctggccgtcatccaccacgaggccgagagcaaggagaagggccccagcatgaaggagcccaaccccatcagcccccccatcttccacggcctggacaccctgactgtgatgggcatcgcctttgctgccttcgtcatcggggccctgctgactggagccctgtggtacatctacagccacactggagaaacagctggccggcagcaggtgcccaccagccccccagccagcgagaacagcagcgctgcccacagcatcggcagcacccagagcaccccctgcagcagcagcagcacagcctag

SEQ ID NO: 173709 - DNA, 108 bp, Artificial Sequence
  Description of Artificial Sequence: Synthetic coding sequence
atgaccagccactacgtgattgccatctttgccctgatgagcagctgcctggccacagctggccctgagcccggggccctgtgtgagctgagccctgtgtctgcctag

SEQ ID NO: 173710 - DNA, 2553 bp, Artificial Sequence; identical to SEQ ID NO: 173708
  Description of Artificial Sequence: Synthetic coding sequence

SEQ ID NO: 173711 - DNA, 2556 bp, Artificial Sequence
  Description of Artificial Sequence: Synthetic coding sequence
atgaccagccactacgtgattgccatctttgccctgatgagcagctgcctggccacagctggccctgagcccggggccctgtgtgagctgagccctgtgtctgccagccaccctgtgcaggccctgatggagagcttcaccgtgctgagcggctgtgccagccggggcaccaccggcctgccccaggaggtgcacgtgctgaacctgaggacagctggccagggccctggccagctgcagcgggaggtgaccctgcacctgaaccccatcagctctgtgcacatccaccacaagtctgtggtgttcctgctgaacagcccccaccccctggtgtggcacctgaagacagagcggctggccactggagtgtcccggctcttcctggtgtctgagggctctgtggtgcagttcagcagcgccaacttcagcctgacagctgagacagaggagaggaacttcccccatggaaatgagcacctgctgaactgggccaggaaggagtatggagctgtgaccagcttcacagagctgaagatcgccaggaacatctacatcaaggtgggggaggaccaggtgttcccccccaagtgcaacatcggcaagaacttcctgagcctgaactacctggccgagtacctgcagcccaaggctgctgagggctgtgtgatgagcagccagccccagaatgaggaggtgcacatcatcgagctgatcacccccaacagcaacccctacagcgccttccaggtggacatcaccatcgacatccggcccagccaggaggacctggaggtggtgaagaacctgatcctgatcctgaagtgcaagaagtctgtgaactgggtgatcaagagctttgatgtgaagggcagcctgaagatcatcgcccccaacagcatcggctttgggaaggagagcgagaggtccatgaccatgaccaagagcatcagagatgacatccccagcacccagggcaacctggtgaagtgggccctggacaatggctacagccccatcaccagctacaccatggcccctgtggccaaccgcttccacctgcggctggagaacaatgctgaggagatgggagatgaggaggtgcacaccatccccccagagctgcgcatcctgctggaccccggggccctgcctgccctgcagaacccccccatccggggcggggagggccagaatggaggcctgcccttccccttcccagacatcagccggcgggtgtggaatgaggagggggaggatggcctgccccggcccaaggaccctgtgatccccagcatccagctgtttcctggcctgcgggagcctgaggaggtgcagggctctgtggacatcgccctgtctgtgaagtgtgacaatgagaagatgattgtggccgtggagaaggacagcttccaggccagcggctacagcggcatggatgtgaccctgctggaccccacctgcaaggccaagatgaatggcacccactttgtgctggagagccccctgaatggctgcggcacccggccccgctggagcgccctggatggagtggtgtactacaacagcatcgtcatccaggtgcctgccctgggggacagcagcggctggccagatggctatgaggacctggagagcggggacaatggcttccctggggacatggatgaaggagatgccagcctcttcaccaggcctgagatcgtggtgttcaactgcagcctgcagcaggtgaggaaccccagcagcttccaggagcagccccacggcaacatcaccttcaacatggagctgtacaacacagacctcttcctggtgcccagccagggcgtcttctctgtgcctgaaaatggccacgtgtatgtggaggtgtctgtgaccaaggccgagcaggagctgggctttgccatccagacctgcttcatcagcccctacagcaacccagacaggatgagccactacaccatcatcgagaacatctgccccaaggatgaatctgtgaagttctacagccccaagagggtgcacttccccatcccccaggccgacatggacaagaagcgcttctcctttgtgttcaagcctgtgttcaacaccagcctgctcttcctgcagtgtgagctgaccctgtgcaccaagatggagaagcacccccagaagctgcccaagtgtgtgcccccagatgaggcctgcaccagcctggatgccagcatcatctgggccatgatgcagaacaagaagaccttcaccaagcccctggccgtcatccaccatgaagctgagagcaaggagaagggccccagcatgaaggagcccaaccccatcagcccccccatcttccacggcctggacaccctgactgtgatgggcatcgcctttgctgcctttgtgattggagccctgctgaccggggccctgtggtacatctacagccacactggagaaacagctggccggcagcaggtgcccaccagccccccagccagcgagaacagcagcgctgcccacagcatcggcagcacccagagcaccccctgcagcagcagcagcacagcctag

SEQ ID NO: 173712 - DNA, 2052 bp, Artificial Sequence
  Description of Artificial Sequence: Synthetic coding sequence
atggccctgtttgtgcggctgctggccctggccctggccctggccctgggccctgctgccaccctggccggccctgccaagagcccctaccagctggtgctgcagcacagccggctgcggggccggcagcacggccccaacgtgtgtgctgtgcagaaggtgattggcaccaacaggaagtacttcaccaactgcaagcagtggtaccagaggaagatctgtgggaagagcaccgtcatctcctatgagtgctgccccggctatgagaaggtgcctggagagaagggctgcccagctgccctgcccctgagcaacctgtatgagaccctgggcgtggtgggcagcaccaccacccagctgtacacagacagaacagagaagctgcggcctgagatggagggccctggcagcttcaccatctttgcccccagcaatgaggcctgggccagcctgcctgctgaggtgctggacagcctggtgtccaatgtgaacatcgagctgctgaatgccctgcgctaccacatggtgggccggcgggtgctgacagatgagctgaagcacggcatgaccctgacctccatgtaccagaacagcaacatccagatccaccactacccaaatggaattgtgacagtgaactgtgcccggctgctgaaggctgaccaccacgccaccaacggggtggtgcacctgattgacaaggtgatcagcaccatcaccaacaacatccagcagatcattgaaattgaggacacctttgagaccctgcgggctgctgtggccgccagcggcctgaacaccatgctggagggcaatggccagtacaccctgctggcccccaccaatgaggcctttgagaagatccccagcgagaccctgaaccgcatcctgggggaccctgaggccctgcgggacctgctgaacaaccacatcctgaagagcgccatgtgtgccgaggccatcgtggccggcctgtctgtggagaccctggagggcaccaccctggaggtgggctgcagcggggacatgctgaccatcaatggcaaggccatcatcagcaacaaggacatcctggccaccaatggagtcatccactacattgatgagctgctgatcccagattctgccaagaccctgtttgagctggccgctgagagtgatgtgtccacagccatcgacctcttccggcaggccggcctgggcaaccacctgagcggcagcgagcggctgaccctgctggcccccctgaacagcgtcttcaaggatggcaccccacccattgatgcccacaccaggaacctgctgaggaaccacatcatcaaggaccagctggccagcaagtacctgtaccacggccagaccctggagaccctgggcggcaagaagctgcgggtgtttgtgtacagaaacagcctgtgcatcgagaacagctgcatcgccgcccatgacaagaggggccgctatggcaccctcttcaccatggacagagtgctgaccccacccatgggcaccgtgatggatgtgctgaagggggacaaccgcttctccatgctggtggccgccatccagagcgctggcctgacagagaccctgaaccgggagggcgtgtacacagtgtttgcccccaccaatgaggccttccgggccctgcccccccgggagaggagccggctgctgggagatgccaaggagctggccaacatcctgaagtaccacatcggagatgagatcctggtgtctgggggcattggagccctggtgcggctgaagagcctgcagggcgacaagctggaggtgtccctgaagaacaacgtggtgtctgtgaacaaggagcctgtggccgagccagacatcatggccaccaacggggtggtgcacgtgatcaccaacgtgctgcagcccccagccaaccggccccaggagagaggagatgagctggccgacagcgccctggagatcttcaagcaggccagcgccttcagcaggcctgagcagccccaggtgctgtgcagccctgtgtaccagaagctgctggagaggatgaagcactag

SEQ ID NO: 173713 - DNA, 1251 bp, Artificial Sequence
  Description of Artificial Sequence: Synthetic coding sequence
atgctggagggcaatggccagtacaccctgctggcccccaccaatgaggcctttgagaagatccccagcgagaccctgaaccgcatcctgggggaccctgaggccctgcgggacctgctgaacaaccacatcctgaagagcgccatgtgtgccgaggccatcgtggccggcctgtctgtggagaccctggagggcaccaccctggaggtgggctgcagcggggacatgctgaccatcaacgggaaggccatcatcagcaacaaggacatcctggccaccaacggggtcatccactacattgatgagctgctgatcccagacagcgccaagaccctgtttgagctggccgctgagagtgatgtgtccacagccatcgacctcttccggcaggccggcctgggcaaccacctgagcggcagcgagcggctgaccctgctggcccccctgaacagcgtcttcaaggatggcaccccacccattgatgcccacaccaggaacctgctgaggaaccacatcatcaaggaccagctggccagcaagtacctgtaccacggccagaccctggagaccctgggcggcaagaagctgcgggtgtttgtgtacagaaacagcctgtgcatcgagaacagctgcatcgccgcccatgacaagaggggccgctatggcaccctcttcaccatggacagagtgctgaccccacccatgggcaccgtgatggatgtgctgaagggggacaaccgcttctccatgctggtggccgccatccagagcgctggcctgacagagaccctgaaccgggagggcgtgtacacagtgtttgcccccaccaatgaggccttccgggccctgcccccccgggagaggagccggctgctgggagatgccaaggagctggccaacatcctgaagtaccacatcggagatgagatcctggtgtctgggggcatcggggccctggtgcggctgaagagcctgcagggcgacaagctggaggtgtccctgaagaacaacgtggtgtctgtgaacaaggagcctgtggccgagccagacatcatggccaccaatggagtggtgcacgtgatcaccaacgtgctgcagcccccagccaaccggccccaggagagaggagatgagctggccgacagcgccctggagatcttcaagcaggccagcgccttcagccgggccagccagaggtctgtgcggctggcccctgtgtaccagaagctgctggagaggatgaagcactag

SEQ ID NO: 173714 - DNA, 2052 bp, Artificial Sequence
  Description of Artificial Sequence: Synthetic coding sequence
atggccctgtttgtgcggctgctggccctggccctggccctggccctgggccctgctgccaccctggccggccctgccaagagcccctaccagctggtgctgcagcacagccggctgcggggccggcagcacggccccaacgtgtgtgctgtgcagaaggtgattggcaccaacaggaagtacttcaccaactgcaagcagtggtaccagaggaagatctgtgggaagagcaccgtcatctcctatgagtgctgccccggctatgagaaggtgcctggagagaagggctgcccagctgccctgcccctgagcaacctgtatgagaccctgggcgtggtgggcagcaccaccacccagctgtacacagacagaacagagaagctgcggcctgagatggagggccctggcagcttcaccatctttgcccccagcaatgaggcctgggccagcctgcctgctgaggtgctggacagcctggtgtccaatgtgaacatcgagctgctgaatgccctgcgctaccacatggtgggccggcgggtgctgacagatgagctgaagcacggcatgaccctgacctccatgtaccagaacagcaacatccagatccaccactacccaaatggaattgtgacagtgaactgtgcccggctgctgaaggctgaccaccacgccaccaacggggtggtgcacctgattgacaaggtgatcagcaccatcaccaacaacatccagcagatcattgaaattgaggacacctttgagaccctgcgggctgctgtggccgccagcggcctgaacaccatgctggagggcaatggccagtacaccctgctggcccccaccaatgaggcctttgagaagatccccagcgagaccctgaaccgcatcctgggggaccctgaggccctgcgggacctgctgaacaaccacatcctgaagagcgccatgtgtgccgaggccatcgtggccggcctgtctgtggagaccctggagggcaccaccctggaggtgggctgcagcggggacatgctgaccatcaatggcaaggccatcatcagcaacaaggacatcctggccaccaatggagtcatccactacattgatgagctgctgatcccagattctgccaagaccctgtttgagctggccgctgagagtgatgtgtccacagccatcgacctcttccggcaggccggcctgggcaaccacctgagcggcagcgagcggctgaccctgctggcccccctgaacagcgtcttcaaggatggcaccccacccattgatgcccacaccaggaacctgctgaggaaccacatcatcaaggaccagctggccagcaagtacctgtaccacggccagaccctggagaccctgggcggcaagaagctgcgggtgtttgtgtacagaaacagcctgtgcatcgagaacagctgcatcgccgcccatgacaagaggggccgctatggcaccctcttcaccatggacagagtgctgaccccacccatgggcaccgtgatggatgtgctgaagggggacaaccgcttctccatgctggtggccgccatccagagcgctggcctgacagagaccctgaaccgggagggcgtgtacacagtgtttgcccccaccaatgaggccttccgggccctgcccccccgggagaggagccggctgctgggagatgccaaggagctggccaacatcctgaagtaccacatcggagatgagatcctggtgtctgggggcattggagccctggtgcggctgaagagcctgcagggcgacaagctggaggtgtccctgaagaacaacgtggtgtctgtgaacaaggagcctgtggccgagccagacatcatggccaccaacggggtggtgcacgtgatcaccaacgtgctgcagcccccagccaaccggccccaggagagaggagatgagctggccgacagcgccctggagatcttcaagcaggccagcgccttcagccgggccagccagaggtctgtgcggctggcccctgtgtaccagaagctgctggagaggatgaagcactag

SEQ ID NO: 173715 - DNA, 1188 bp, Artificial Sequence
  Description of Artificial Sequence: Synthetic coding sequence
atggccttcagcccctggcagatcctgagccctgtgcagtgggccaagtggacctggagcgctgtgcggggcggcgctgctggagaagatgaggccggcggccctgagggggaccctgaggaggaggacagccaggccgagaccaagagcctgtccttccgcagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggggagcctgaggaggacctggagtactttgaatgtagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173716 - DNA, 2418 bp, Artificial Sequence
  Description of Artificial Sequence: Synthetic coding sequence
atggccttcagcccctggcagatcctgagccctgtgcagtgggccaagtggacctggagcgctgtgcggggcggcgctgctggagaagatgaggccggcggccctgagggggaccctgaggaggaggacagccaggccgagaccaagagcctgtccttcagcagtgacagcgagggcaactttgagaccccagaggccgagacccccatccgcagccccttcaaggagagctgtgaccccagcctgggcctggccggccctggggccaagagccaggagagccaggaggctgatgagcagctggtggccgaggtggtggagaagtgcagcagcaagacctgcagcaagcccagtgaaaatgaggtgccccagcaggccatcgacagccacagcgtgaagaacttccgggaggagcctgagcatgacttcagcaagatcagcatcgtgcggcccttcagcattgagaccaaggacagcacagacatctctgctgtgctgggcaccaaggccgcccacggctgtgtgacagctgtgtctgggaaggccctgcccagcagccccccagatgccctgcaggatgaggccatgacagagggctccatgggcgtgaccctggaggccagcgctgaggccgacctgaaggccggcaacagctgcccagagctggtgcccagccgccgcagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgattctggagtggagctgggggaggagagccgcagcagccccctgaagctggagtttgacttcacagaggacaccggcaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccaccggcaaccacgtgaatgagatcctggagagccccaagaaggccaagagccgcctcatcaccagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggggagcctgaggaggacctggagtactttgaatgtagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173717 - DNA, 1140 bp, Artificial Sequence
  Description of Artificial Sequence: Synthetic coding sequence
atgggcggcagccacagccagaccccccggggccgggagcctgctggggagcggcacccccggcccacagaaacagccaccacagagcaggtgaagttcctgtgcttcctgctgagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggggagcctgaggaggacctggagtactttgaatgtagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173718 - DNA, 1104 bp, Artificial Sequence
  Description of Artificial Sequence: Synthetic coding sequence
atgggcggcagccacagccagaccccccggggccgggagcctgctggggagcggcacccccggcccacagaaacagccagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggggagcctgaggaggacctggagtactttgaatgtagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173719 - DNA, 2454 bp, Artificial Sequence
  Description of Artificial Sequence: Synthetic coding sequence
atggccttcagcccctggcagatcctgagccctgtgcagtgggccaagtggacctggagcgctgtgcggggcggcgctgctggagaagatgaggccggcggccctgagggggaccctgaggaggaggacagccaggccgagaccaagagcctgtccttcagcagtgacagcgagggcaactttgagaccccagaggccgagacccccatccgcagccccttcaaggagagctgtgaccccagcctgggcctggccggccctggggccaagagccaggagagccaggaggctgatgagcagctggtggccgaggtggtggagaagtgcagcagcaagacctgcagcaagcccagtgaaaatgaggtgccccagcaggccatcgacagccacagcgtgaagaacttccgggaggagcctgagcatgacttcagcaagatcagcatcgtgcggcccttcagcattgagaccaaggacagcacagacatctctgctgtgctgggcaccaaggccgcccacggctgtgtgacagctgtgtctgggaaggccctgcccagcagccccccagatgccctgcaggatgaggccatgacagagggctccatgggcgtgaccctggaggccagcgctgaggccgacctgaaggccggcaacagctgcccagagctggtgcccagccgccgcagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgattctggagtggagctgggggaggagagccgcagcagccccctgaagctggagtttgacttcacagaggacaccggcaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccaccggcaaccacgtgaatgagatcctggagagccccaagaaggccaagagccgcctcatcaccaccacagagcaggtgaagttcctgtgcttcctgctgagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggggagcctgaggaggacctggagtactttgaatgtagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173720 - DNA, 2379 bp, Artificial Sequence
  Description of Artificial Sequence: Synthetic coding sequence
atgcagaggcagaccatcaagggagctggagctggaggagctgccctgatggccttcagcccctggcagatcctgagccctgtgcagtgggccaagtggacctggagcgctgtgcggggcggcgctgctggagaagatgaggccggcggccctgagggggaccctgaggaggaggacagccaggccgagaccaagagcctgtccttcagcagtgacagcgagggcaactttgagaccccagaggccgagacccccatccgcagccccttcaaggagagctgtgaccccagcctgggcctggccggccctggggccaagagccaggagagccaggaggctgatgagcagctggtggccgaggtggtggagaagtgcagcagcaagacctgcagcaagcccagtgaaaatgaggtgccccagcaggccatcgacagccacagcgtgaagaacttccgggaggagcctgagcatgacttcagcaagatcagcatcgtgcggcccttcagcattgagaccaaggacagcacagacatctctgctgtgctgggcaccaaggccgcccacggctgtgtgacagctgtgtctgggaaggccctgcccagcagccccccagatgccctgcaggatgaggccatgacagagggctccatgggcgtgaccctggaggccagcgctgaggccgacctgaaggccggcaacagctgcccagagctggtgcccagccgccgcagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgattctggagtggagctgggggaggagagccgcagcagccccctgaagctggagtttgacttcacagaggacaccggcaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccaccggcaaccacgtgaatgagatcctggagagccccaagaaggccaagagccgcctcatcaccagcggctgcaaggtgaagaagcatgagacccagagcctggccctggatgcctgcagcagagatgaaggagctgtgatcagccagatcagtgacatcagcaacagagatggccacgccacagatgaggagaagctggccagcaccagctgtggccagaagtctgctggagctgaggtgaagggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttccgccgctatgagaacctgaagggcgtgctggagggcttcaagaagaatgaggaggccctgaagaagtgtgcccaggactacctggcccgggtgaagcaggaggagcagcgctaccaggccctgaagatccacgccgaggagaagctggacaaggccaatgaggagatcgcccaggtgaggaccaaggccaaggccgagagcgctgccctgcatgctggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173721 - DNA, 1431 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgacagcggcgtggagctgggggaggagagccgcagcagccccctgaagctggagtttgacttcacagaagatactggaaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccactggaaaccacgtgaatgagatcctggagagccccaagaaggccaagagccgcctcatcaccagcggctgcaaggtgaagaagcatgagacccagagcctggccctggatgcctgcagcagagatgagggcgctgtgatcagccagatcagtgacatcagcaacagagatggccacgccacagatgaggagaagctggccagcaccagctgtggccagaagtctgctggagctgaggtgaagggggagcctgaggaggacctggagtactttgagtgcagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtacttcaacaaggaggtgttccggggggacatctgccccaagcgcttcggcctgcagatccctgtgatcttcaagaagcagctgaccaccaagagcctgagcctgcaccgggtgacagtgaagaagctgatgtag

SEQ ID NO: 173722 - DNA, 2196 bp, Artificial Sequence
  Description of Artificial Sequence: Synthetic coding sequence
atgaacaacatcctgaagctgaagagcagtgacagcgagggcaactttgagaccccagaggccgagacccccatccgcagccccttcaaggagagctgtgaccccagcctgggcctggccggccctggggccaagagccaggagagccaggaggctgatgagcagctggtggccgaggtggtggagaagtgcagcagcaagacctgcagcaagcccagtgaaaatgaggtgccccagcaggccatcgacagccacagcgtgaagaacttccgggaggagcctgagcatgacttcagcaagatcagcatcgtgcggcccttcagcattgagaccaaggacagcacagacatctctgctgtgctgggcaccaaggccgcccacggctgtgtgacagctgtgtctgggaaggccctgcccagcagccccccagatgccctgcaggatgaggccatgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgacagcggcgtggagctgggggaggagagccgcagcagccccctgaagctggagtttgacttcacagaagatactggaaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccactggaaaccacgtgaatgagatcctggagagccccaagaaggccaagagccgcctcatcaccagcggctgcaaggtgaagaagcatgagacccagagcctggccctggatgcctgcagcagagatgagggcgctgtgatcagccagatcagtgacatcagcaacagagatggccacgccacagatgaggagaagctggccagcaccagctgtggccagaagtctgctggagctgaggtgaagggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173723 - DNA, 1833 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgacagcggcgtggagctgggggaggagagccgcagcagccccctgaagctggagtttgacttcacagaagatactggaaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccactggaaaccacgtgaatgagatcctggagagccccaagaaggccaagagccgcctcatcaccagcggctgcaaggtgaagaagcatgagacccagagcctggccctggatgcctgcagcagagatgagggcgctgtgatcagccagatcagtgacatcagcaacagagatggccacgccacagatgaggagaagctggccagcaccagctgtggccagaagtctgctggagctgaggtgaagggggagcctgaggaggacctggagtactttgagtgcagcaatgtgcctgtgtccaccatcaaccacgccttcagcagcagcgaggccggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttccgccgctatgagaacctgaagggcgtgctggagggcttcaagaagaatgaggaggccctgaagaagtgtgcccaggactacctggcccgggtgaagcaggaggagcagcgctaccaggccctgaagatccacgccgaggagaagctggacaaggccaatgaggagatcgcccaggtgaggaccaaggccaaggccgagagcgctgccctgcatgctggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173724 - DNA, 1746 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgacagcggcgtggagctgggggaggagagccgcagcagccccctgaagctggagtttgacttcacagaagatactggaaacatcgaggccaggaaggccctgcccaggaagctgggcaggaagctgggcagcaccctgacccccaagatccagaaggatggcatcagcaagtctgctggcctggagcagcccacagatcctgtggccagagatggccccctgagccagaccagcagcaagccagaccccagccagtgggagagccccagcttcaaccccttcggcagccacagcgtgctgcagaacagcccccccctgagcagcgagggcagctaccactttgatcctgacaactttgatgagagcatggaccccttcaagcccaccaccaccctgaccagcagtgacttctgcagccccactggaaaccacgtgaatgagatcctggagagccccaagaaggccaagagccgcctcatcaccagcggctgcaaggtgaagaagcatgagacccagagcctggccctggatgcctgcagcagagatgagggcgctgtgatcagccagatcagtgacatcagcaacagagatggccacgccacagatgaggagaagctggccagcaccagctgtggccagaagtctgctggagctgaggtgaagggcatcgagaaggagacctgccagaagatggaggaggatggcagcacagtgctgggcctgctggagagcagcgctgagaaggcccctgtgtctgtgtcctgtggcggggagagccccctggatggcatctgcctgtctgagagtgacaagacagctgtgctgaccctcatccgggaggagatcatcaccaaggagattgaggccaatgagtggaagaagaagtatgaggagacccggcaggaggtgctggagatgaggaagatcgtggccgagtatgagaagaccatcgcccagatgattgaagatgagcagaggacctccatgaccagccagaagagcttccagcagctgaccatggagaaggagcaggccctggccgacctgaacagcgtggagaggagcctgagtgacctcttcagaagatatgagaacctgaagggcgtgctggagggcttcaagaagaatgaggaggccctgaagaagtgtgcccaggactacctggcccgggtgaagcaggaggagcagcgctaccaggccctgaagatccatgctgaggagaagctggacaaggccaatgaggagatcgcccaggtgaggaccaaggccaaggccgagagcgctgccctgcacgccggcctgaggaaggagcagatgaaggtggagagcctggagcgggccctgcagcagaagaaccaggagattgaggagctgaccaagatctgtgatgagctgattgccaagctgggcaagacagactag

SEQ ID NO: 173725 - DNA, 93 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagctag

SEQ ID NO: 173726 - DNA, 417 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggcacccccctgcccaaggccagctaccacttcagccctgaggagctggatgagaacaccagccccctgctgggagatgcccgcttccagaagagccccccagacctgaaggagaccccaggcaccctgagcagtgacaccaatgacagcggcgtggagctgggggaggagagccgcagcagccccctgaagctggagtttgacttcacagaagatactggaaacatcgaggcctag

SEQ ID NO: 173727 - DNA, 186 bp, Artificial Sequence
  Description of Artificial Sequence: Synthetic coding sequence
atgacagagggctccatgggcgtgaccctggaggccagcgctgaggccgacctgaaggccggcaacagctgcccagagctggtgcccagcagaagaagcaagctgaggaagcccaagcctgtgcccctgaggaagaaggccatcggcggggagttcagtgacaccaatgctgctgtggagggctag

SEQ ID NO: 173728 - DNA, 390 bp, Artificial Sequence
  Description of Artificial Sequence: Synthetic coding sequence
atggccttcagcccctggcagatcctgagccctgtgcagtgggccaagtggacctggagcgctgtgcggggcggcgctgctggagaagatgaggccggcggccctgagggggaccctgaggaggaggacagccaggccgagaccaagagcctgtccttcagcagtgacagcgagggcaactttgagaccccagaggccgagacccccatccgcagccccttcaaggagagctgtgaccccagcctgggcctggccggccctggggccaagagccaggagagccaggaggctgatgagcagctggtggccgaggtggtggagaagtgcagcagcaagacctgcagcaagcccagtgaaaatgaggtgccccagcaggccatcgacagctag

SEQ ID NO: 173729 - DNA, 3081 bp, Artificial Sequence
  Description of Artificial Sequence: Synthetic coding sequence
atgggcggcagccagagcctgcagcctgccccagccagtgacctgaacctggaggccagcgaggccatgagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatcacagcccctgagggcagctttgccagcgcagatgccctgctgagccggctggcccaccctgtgtccctgtgtggggccctggactacctggagccagacctggccgagaagaacccccccctgtttgcccagaagctgcaggaggagctggagtttgccatcatgagaattgaggccctgaagctggcccggcagatcgccctggccagccgcagccaccaggatgccaagcgggaggccgcccaccccacagatgtgtccatcagcaagacagccctgtacagcagaattggaacagctgaggtggagaagccagctggcctgctcttccagcagcctgacctggacagcgccctgcagatcgcccgggcagagatcatcaccaaggagcgggaggtgtctgagtggaaggacaagtatgaggagagccggcgggaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttcagaagatatgagaagatgaaggaggtgctggagggcttcaggaagaatgaggaggtgctgaagagatgtgcccaggagtacctgagccgggtgaagaaggaggagcagcgctaccaggccctgaaggtgcatgctgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173730 - DNA, 8847 bp, Artificial Sequence
  Description of Artificial Sequence: Synthetic coding sequence
atgggaaatgaaaacagcaccagtgacaaccagaggaccctgagcgcccagacccccaggtctgcccagcccccaggcaacagccagaacatcaagaggaagcagcaggacaccccaggcagcccagaccacagagatgccagcagcatcggctctgtgggcctgggcggcttctgcacagccagcgagagcagcgccagcctggacccctgcctggtgtccccagaggtgacagagcccaggaaggacccccagggcgcccggggccctgagggcagcctgctgcccagccccccacccagccaggagcgggagcaccccagcagctccatgccctttgctgaatgtcctcctgagggctgcctggccagccctgctgctgccccagaagatggcccccagacccagagcccccggcgggagcccgccccaaatgcccctggggacattgctgctgccttccctgctgagcgggacagcagcaccccctaccaggagattgctgctgtgcccagcgctggccgggagcggcagcccaaggaggagggccagaagagcagcttctccttcagcagcggcatcgaccagagccctggcatgagccctgtgcccctgcgggagcccatgaaggcccccctgtgtggggagggggaccagcccggcggctttgagagccaggagaaggaggccgccggcggcttccccccagctgagagccggcagggcgtggcctctgtgcaggtgaccccagaggccccagctgctgcccagcagggcacagagagcagcgctgtgctggagaagagccccctgaagcccatggcccccatcccccaggaccctgccccccgggccagtgaccgggagcggggccagggcgaggccccaccccagtacctgacagatgacctggagttcctgcgggcctgccacctgcccaggagcaacagcggggccgcccctgaggccgaggtgaatgctgccagccaggagagctgccagcagcctgtgggcgcctacctgccccacgccgagctgccctggggcctgcccagccctgccctggtgcctgaggccggcggcagcggcaaggaggccctggacaccattgatgtgcagggccacccccagacaggcatgaggggcaccaagcccaaccaggtggtgtgtgtggccgccggcggccagcctgagggcggcctgcctgtgtccccagagcccagcctgctgacccccacagaggaggcccacccagccagcagcctggccagcttccctgctgcccagatccccatcgctgtggaggagcccggcagcagcagccgggagagcgtgtccaaggccggcatgcctgtgtctgcagatgctgccaaggaggtggtggatgctggcctggtgggcctggagcggcaggtgtctgacctgggcagcaagggggagcaccctgagggggaccccggggaggtgcctgcccccagcccccaggagcggggggagcacctgaacacagagcagagccatgaggtgcagcccggggtgcccccaccacccctgcccaaggagcagagccatgaggtgcagcccggggcccctcctccacccctgcccaaggcccccagcgagagcgcccggggccccccaggccccacagatggagccaaggtgcatgaggacagcaccagccctgctgtggccaaggagggcagccgcagccctggggacagccctgggggcaaggaggaggcccctgagcccccagatggaggagaccccggcaacctgcagggcgaggacagccaggccttcagcagcaagagggaccctgaggtgggcaaggatgagctgagcaagcccagcagtgatgctgagagccgggaccaccccagcagccacagcgcccagccccccaggaagggcggggccggccacacagatggcccccacagccagacagctgaggctgatgccagcggcctgccccacaagctgggggaggaggaccctgtgctgccccctgtgcctgatggagctggggagcccaccgtgcctgagggcgccatctgggagggcagcggcctgcagcccaagtgcccagacaccctgcagagccgggagggcctgggccgcatggagagcttcctgaccctggagagcgagaagagtgacttcccccccacccctgtggccgaggtggcccccaaggcccaggagggggagagcaccctggagatcaggaagatgggcagctgtgatggagagggcctgctgaccagcccagaccagccccggggccctgcctgtgatgccagccggcaggagttccacgccggcgtgccccaccccccccagggcgagaacctggccgctgacctgggcctgacagccctgatcctggaccaggaccagcagggcatccccagctgccctggagagggctggatcagaggagctgccagcgagtggcccctgctgagcagcgagaagcacctgcagcccagccaggcccagcctgagaccagcatctttgatgtgctgaaggagcaggcccagcccccagaaaatggcaaggagaccagccccagccaccctggcttcaaggaccagggcgctgacagcagccagatccacgtgcctgtggagccccaggaggacaacaacctgcccacccacggcggccaggagcaggccctgggcagcgagctgcagagccagctgcccaagggcaccctgagtgacacccccaccagcagccccacagacatggtgtgggagagcagcctgacagaggagagcgagctgagcgcccccacccggcagaagctgcctgccctgggggagaagaggcctgagggcgcctgtggagatggccagagcagccgggtgtccccacctgctgctgatgtgctgaaggacttcagcctggccggcaacttcagcaggaaggagacctgctgcaccggccagggccccaacaagagccagcaggccctggctgatgccctggaggagggcagccagcacgaggaggcctgccagaggcaccctggggccagcgaggccgcagatggctgcagccccctgtggggcctgagcaagcgggagatggccagcggcaacacaggagaggccccaccctgccagcctgacagcgtggccctgctggatgctgtgccctgcctgcctgccctggccccagccagccctggggtgacccccacccaggatgcccctgagacagaggcctgtgatgagacccaggagggccggcagcagcctgtgcctgccccccagcagaagatggagtgctgggccaccagtgatgctgagagccccaagctgctggccagcttccccagcgctggggagcagggcggggaggccggggctgctgagaccggcggcagcgctggggccggggaccccgggaagcagcaggcccctgagaagccaggagaggccaccctgagctgtggcctgctgcagacagagcactgcctgaccagcggggaggaggccagcaccagcgccctgcgggagagctgccaggccgagcaccccatggccagctgccaggatgccctgctgcctgcccgggagctgggcggcatccccaggagcaccatggacttcagcacccaccaggccgtgcctgaccccaaggagctgctgctgagcggccccccagaggtggccgccccagacaccccctacctgcacgtggacagcgctgcccagagaggagcagaagattctggagtgaaggctgtgagcagcgctgacccccgggcccctggagagagcccctgccctgtgggggagccccccctggccctggagaatgctgccagcctgaagctgtttgctggcagcctggcccccctgctgcagcctggagctgctggaggagagatcccagctgtgcaggccagcagcggcagccccaaggcccggaccacagagggccctgtggacagcatgccctgcctggacaggatgcccctgctggccaagggcaagcaggccaccggggaggagaaggccgccacagcccctggagctggggccaaggccagcggggagggcatggctggagatgctgctggggagacagagggctccatggagaggatgggagagcccagccaggaccccaagcagggcaccagcggaggagtggacaccagcagcgagcagatcgccaccctgaccggcttcccagacttccgggagcacatcgccaagatctttgagaagcctgtgctgggcgccctggccaccccaggagagaaggccggggccggccgctctgctgtgggcaaggacctgacccggcccctgggccctgagaagctgctggatggccccccaggagtggatgtgaccctgctgcctgcccccccagcccggctgcaggtggagaagaagcagcagctggccggggaggccgagatcagccacctggccctgcaggaccctgccagtgacaagctgctgggccctgctggcctgacctgggagaggaacctgcccggggccggcgtgggcaaggagatggccggcgtgccccccaccctgagagaagatgagaggcctgagggccctggggccgcctggccaggcctggagggccaggcctacagccagctggagaggagccggcaggagctggccagcggcctgcccagccctgctgccacccaggagctgcctgtggagagagctgctgccttccaggtggccccccacagccacggggaggaggccgtggcccaggaccgcatccccagcggcaagcagcaccaggagaccagcgcctgtgacagcccccacggggaggatggccctggggactttgcccacactggagtgcccggccacgtgcccaggagcacctgtgcccccagcccccagcgggaggtgctgactgtgcctgaggccaacagcgagccctggaccctggacaccctgggcggggagcggcggcctggggtgacagctggcatcctggagatgagaaatgccctgggcaaccagagcaccccagcccccccaactggagaggtggccgacacccccctggagcccgggaaggtggccggggccgccggggaggccgagggggacatcaccctgagcacagctgagacccaggcctgtgccagcggggacctgcctgaggccggcaccaccaggaccttctctgtggtggccggggacctggtgctgcccggcagctgccaggaccctgcctgcagcgacaaggcccctggcatggagggcacagctgccctgcatggagacagccctgcccggccccagcaggccaaggagcagcccggccctgagcggcccatcccagctggagatggcaaggtgtgtgtgagcagccccccagagccagatgagacccatgaccccaagctgcagcacctggcccctgaggagctgcacacagaccgggagagccccaggcctggccccagcatgctgcccagcgtgcccaagaaggatgccccccgggtgatggacaaggtgaccagtgatgagaccagaggagctgagggcacagagagcagccctgtggctgatgacatcatccagcctgctgccccagctgacctggagagccccaccctggccgccagcagctaccatggagatgtggtgggccaggtgtccacagacctgattgcccagagcatcagccctgctgctgcccacgccggcctgcccccatctgctgctgagcacatcgtgagccccagcgccccagctggggacagagtggaggccagcacccccagctgcccagaccctgccaaggacctgagccgcagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatcacagcccctgagggcagctttgccagcgcagatgccctgctgagccggctggcccaccctgtgtccctgtgtggggccctggactacctggagccagacctggccgagaagaacccccccctgtttgcccagaagctgcaggaggagctggagtttgccatcatgagaattgaggccctgaagctggcccggcagatcgccctggccagccgcagccaccaggatgccaagcgggaggccgcccaccccacagatgtgtccatcagcaagacagccctgtacagcagaattggaacagctgaggtggagaagccagctggcctgctcttccagcagcctgacctggacagcgccctgcagatcgcccgggcagagatcatcaccaaggagcgggaggtgtctgagtggaaggacaagtatgaggagagccggcgggaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttcagaagatatgagaagatgaaggaggtgctggagggcttcaggaagaatgaggaggtgctgaagagatgtgcccaggagtacctgagccgggtgaagaaggaggagcagcgctaccaggccctgaaggtgcatgctgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173731 - DNA, 8586 bp, Artificial Sequence
  Description of Artificial Sequence: Synthetic coding sequence
cagaggaccctgagcgcccagacccccaggtctgcccagcccccaggcaacagccagaacatcaagaggaagcagcaggacaccccaggcagcccagaccacagagatgccagcagcatcggctctgtgggcctgggcggcttctgcacagccagcgagagcagcgccagcctggacccctgcctggtgtccccagaggtgacagagcccaggaaggacccccagggcgcccggggccctgagggcagcctgctgcccagccccccacccagccaggagcgggagcaccccagcagctccatgccctttgctgaatgtcctcctgagggctgcctggccagccctgctgctgccccagaagatggcccccagacccagagcccccggcgggagcccgccccaaatgcccctggggacattgctgctgccttccctgctgagcgggacagcagcaccccctaccaggagattgctgctgtgcccagcgctggccgggagcggcagcccaaggaggagggccagaagagcagcttctccttcagcagcggcatcgaccagagccctggcatgagccctgtgcccctgcgggagcccatgaaggcccccctgtgtggggagggggaccagcccggcggctttgagagccaggagaaggaggccgccggcggcttccccccagctgagagccggcagggcgtggcctctgtgcaggtgaccccagaggccccagctgctgcccagcagggcacagagagcagcgctgtgctggagaagagccccctgaagcccatggcccccatcccccaggaccctgccccccgggccagtgaccgggagcggggccagggcgaggccccaccccagtacctgacagatgacctggagttcctgcgggcctgccacctgcccaggagcaacagcggggccgcccctgaggccgaggtgaatgctgccagccaggagagctgccagcagcctgtgggcgcctacctgccccacgccgagctgccctggggcctgcccagccctgccctggtgcctgaggccggcggcagcggcaaggaggccctggacaccattgatgtgcagggccacccccagacaggcatgaggggcaccaagcccaaccaggtggtgtgtgtggccgccggcggccagcctgagggcggcctgcctgtgtccccagagcccagcctgctgacccccacagaggaggcccacccagccagcagcctggccagcttccctgctgcccagatccccatcgctgtggaggagcccggcagcagcagccgggagagcgtgtccaaggccggcatgcctgtgtctgcagatgctgccaaggaggtggtggatgctggcctggtgggcctggagcggcaggtgtctgacctgggcagcaagggggagcaccctgagggggaccccggggaggtgcctgcccccagcccccaggagcggggggagcacctgaacacagagcagagccatgaggtgcagcccggggtgcccccaccacccctgcccaaggagcagagccatgaggtgcagcccggggcccctcctccacccctgcccaaggcccccagcgagagcgcccggggccccccaggccccacagatggagccaaggtgcatgaggacagcaccagccctgctgtggccaaggagggcagccgcagccctggggacagccctgggggcaaggaggaggcccctgagcccccagatggaggagaccccggcaacctgcagggcgaggacagccaggccttcagcagcaagagggaccctgaggtgggcaaggatgagctgagcaagcccagcagtgatgctgagagccgggaccaccccagcagccacagcgcccagccccccaggaagggcggggccggccacacagatggcccccacagccagacagctgaggctgatgccagcggcctgccccacaagctgggggaggaggaccctgtgctgccccctgtgcctgatggagctggggagcccaccgtgcctgagggcgccatctgggagggcagcggcctgcagcccaagtgcccagacaccctgcagagccgggagggcctgggccgcatggagagcttcctgaccctggagagcgagaagagtgacttcccccccacccctgtggccgaggtggcccccaaggcccaggagggggagagcaccctggagatcaggaagatgggcagctgtgatggagagggcctgctgaccagcccagaccagccccggggccctgcctgtgatgccagccggcaggagttccacgccggcgtgccccaccccccccagggcgagaacctggccgctgacctgggcctgacagccctgatcctggaccaggaccagcagggcatccccagctgccctggagagggctggatcagaggagctgccagcgagtggcccctgctgagcagcgagaagcacctgcagcccagccaggcccagcctgagaccagcatctttgatgtgctgaaggagcaggcccagcccccagaaaatggcaaggagaccagccccagccaccctggcttcaaggaccagggcgctgacagcagccagatccacgtgcctgtggagccccaggaggacaacaacctgcccacccacggcggccaggagcaggccctgggcagcgagctgcagagccagctgcccaagggcaccctgagtgacacccccaccagcagccccacagacatggtgtgggagagcagcctgacagaggagagcgagctgagcgcccccacccggcagaagctgcctgccctgggggagaagaggcctgagggcgcctgtggagatggccagagcagccgggtgtccccacctgctgctgatgtgctgaaggacttcagcctggccggcaacttcagcaggaaggagacctgctgcaccggccagggccccaacaagagccagcaggccctggctgatgccctggaggagggcagccagcacgaggaggcctgccagaggcaccctggggccagcgaggccgcagatggctgcagccccctgtggggcctgagcaagcgggagatggccagcggcaacacaggagaggccccaccctgccagcctgacagcgtggccctgctggatgctgtgccctgcctgcctgccctggccccagccagccctggggtgacccccacccaggatgcccctgagacagaggcctgtgatgagacccaggagggccggcagcagcctgtgcctgccccccagcagaagatggagtgctgggccaccagtgatgctgagagccccaagctgctggccagcttccccagcgctggggagcagggcggggaggccggggctgctgagaccggcggcagcgctggggccggggaccccgggaagcagcaggcccctgagaagccaggagaggccaccctgagctgtggcctgctgcagacagagcactgcctgaccagcggggaggaggccagcaccagcgccctgcgggagagctgccaggccgagcaccccatggccagctgccaggatgccctgctgcctgcccgggagctgggcggcatccccaggagcaccatggacttcagcacccaccaggccgtgcctgaccccaaggagctgctgctgagcggccccccagaggtggccgccccagacaccccctacctgcacgtggacagcgctgcccagagaggagcagaagattctggagtgaaggctgtgagcagcgctgacccccgggcccctggagagagcccctgccctgtgggggagccccccctggccctggagaatgctgccagcctgaagctgtttgctggcagcctggcccccctgctgcagcctggagctgctggaggagagatcccagctgtgcaggccagcagcggcagccccaaggcccggaccacagagggccctgtggacagcatgccctgcctggacaggatgcccctgctggccaagggcaagcaggccaccggggaggagaaggccgccacagcccctggagctggggccaaggccagcggggagggcatggctggagatgctgctggggagacagagggctccatggagaggatgggagagcccagccaggaccccaagcagggcaccagcggaggagtggacaccagcagcgagcagatcgccaccctgaccggcttcccagacttccgggagcacatcgccaagatctttgagaagcctgtgctgggcgccctggccaccccaggagagaaggccggggccggccgctctgctgtgggcaaggacctgacccggcccctgggccctgagaagctgctggatggccccccaggagtggatgtgaccctgctgcctgcccccccagcccggctgcaggtggagaagaagcagcagctggccggggaggccgagatcagccacctggccctgcaggaccctgccagtgacaagctgctgggccctgctggcctgacctgggagaggaacctgcccggggccggcgtgggcaaggagatggccggcgtgccccccaccctgagagaagatgagaggcctgagggccctggggccgcctggccaggcctggagggccaggcctacagccagctggagaggagccggcaggagctggccagcggcctgcccagccctgctgccacccaggagctgcctgtggagagagctgctgccttccaggtggccccccacagccacggggaggaggccgtggcccaggaccgcatccccagcggcaagcagcaccaggagaccagcgcctgtgacagcccccacggggaggatggccctggggactttgcccacactggagtgcccggccacgtgcccaggagcacctgtgcccccagcccccagcgggaggtgctgactgtgcctgaggccaacagcgagccctggaccctggacaccctgggcggggagcggcggcctggggtgacagctggcatcctggagatgagaaatgccctgggcaaccagagcaccccagcccccccaactggagaggtggccgacacccccctggagcccgggaaggtggccggggccgccggggaggccgagggggacatcaccctgagcacagctgagacccaggcctgtgccagcggggacctgcctgaggccggcaccaccaggaccttctctgtggtggccggggacctggtgctgcccggcagctgccaggaccctgcctgcagcgacaaggcccctggcatggagggcacagctgccctgcatggagacagccctgcccggccccagcaggccaaggagcagcccggccctgagcggcccatcccagctggagatggcaaggtgtgtgtgagcagccccccagagccagatgagacccatgaccccaagctgcagcacctggcccctgaggagctgcacacagaccgggagagccccaggcctggccccagcatgctgcccagcgtgcccaagaaggatgccccccgggtgatggacaaggtgaccagtgatgagaccagaggagctgagggcacagagagcagccctgtggctgatgacatcatccagcctgctgccccagctgacctggagagccccaccctggccgccagcagctaccatggagatgtggtgggccaggtgtccacagacctgattgcccagagcatcagccctgctgctgcccacgccggcctgcccccatctgctgctgagcacatcgtgagccccagcgccccagctggggacagagtggaggccagcacccccagctgcccagaccctgccaaggacctgagccgcagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatccgggaggccgcccaccccacagatgtgtccatcagcaagacagccctgtacagccgcatcggcacagctgaggtggagaagccagctggcctgctcttccagcagcctgacctggacagcgccctgcagatcgcccgggcagagatcatcaccaaggagcgggaggtgtctgagtggaaggacaagtatgaggagagcagaagagaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttccgccgctatgagaagatgaaggaggtgctggagggcttcaggaagaatgaggaggtgctgaagagatgtgcccaggagtacctgagccgggtgaagaaggaggagcagcgctaccaggccctgaaggtgcacgccgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173732 - DNA, 3285 bp, Artificial Sequence
  Description of Artificial Sequence: Synthetic coding sequence
atgggaaatgaaaacagcaccagtgacaaccagaggaccctgagcgcccagacccccaggtctgcccagcccccaggcaacagccagaacatcaagaggaagcagcaggacaccccaggcagcccagaccacagagatgccagcagcagccctgtggctgatgacatcatccagcctgctgccccagctgacctggagagccccaccctggccgccagcagctaccatggagatgtggtgggccaggtgtccacagacctgattgcccagaggagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatcacagcccctgagggcagctttgccagcgcagatgccctgctgagccggctggcccaccctgtgtccctgtgtggggccctggactacctggagccagacctggccgagaagaacccccccctgtttgcccagaagctgcaggaggagctggagtttgccatcatgagaattgaggccctgaagctggcccggcagatcgccctggccagccgcagccaccaggatgccaagcgggaggccgcccaccccacagatgtgtccatcagcaagacagccctgtacagcagaattggaacagctgaggtggagaagccagctggcctgctcttccagcagcctgacctggacagcgccctgcagatcgcccgggcagagatcatcaccaaggagcgggaggtgtctgagtggaaggacaagtatgaggagagccggcgggaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttcagaagatatgagaagatgaaggaggtgctggagggcttcaggaagaatgaggaggtgctgaagagatgtgcccaggagtacctgagccgggtgaagaaggaggagcagcgctaccaggccctgaaggtgcatgctgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173733 - DNA, 2991 bp, Artificial Sequence
  Description of Artificial Sequence: Synthetic coding sequence
atgggcggcagccagagcctgcagcctgccccagccagtgacctgaacctggaggccagcgaggccatgagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatcacagcccctgagggcagctttgccagcgcagatgccctgctgagccggctggcccaccctgtgtccctgtgtggggccctggactacctggagccagacctggccgagaagaacccccccctgtttgcccagaagctgcagcgggaggccgcccaccccacagatgtgtccatcagcaagacagccctgtacagcagaattggaacagctgaggtggagaagccagctggcctgctcttccagcagcctgacctggacagcgccctgcagatcgcccgggcagagatcatcaccaaggagcgggaggtgtctgagtggaaggacaagtatgaggagagccggcgggaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttcagaagatatgagaagatgaaggaggtgctggagggcttcaggaagaatgaggaggtgctgaagagatgtgcccaggagtacctgagccgggtgaagaaggaggagcagcgctaccaggccctgaaggtgcatgctgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173734 - DNA, 1716 bp, Artificial Sequence
  Description of Artificial Sequence: Synthetic coding sequence
atgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatccgggaggccgcccaccccacagatgtgtccatcagcaagacagccctgtacagccgcatcggcacagctgaggtggagaagccagctggcctgctcttccagcagcctgacctggacagcgccctgcagatcgcccgggcagagatcatcaccaaggagcgggaggtgtctgagtggaaggacaagtatgaggagagcagaagagaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttccgccgctatgagaagatgaaggaggtgctggagggcttcaggaagaatgaggaggtgctgaagagatgtgcccaggagtacctgagccgggtgaagaaggaggagcagcgctaccaggccctgaaggtgcacgccgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173735 - DNA, 8847 bp, Artificial Sequence; identical to SEQ ID NO: 173730
  Description of Artificial Sequence: Synthetic coding sequence

SEQ ID NO: 173736 - DNA, 8628 bp, Artificial Sequence
  Description of Artificial Sequence: Synthetic coding sequence
atgggaaatgaaaacagcaccagtgacaaccagaggaccctgagcgcccagacccccaggtctgcccagcccccaggcaacagccagaacatcaagaggaagcagcaggacaccccaggcagcccagaccacagagatgccagcagcatcggctctgtgggcctgggcggcttctgcacagccagcgagagcagcgccagcctggacccctgcctggtgtccccagaggtgacagagcccaggaaggacccccagggcgcccggggccctgagggcagcctgctgcccagccccccacccagccaggagcgggagcaccccagcagctccatgccctttgctgaatgtcctcctgagggctgcctggccagccctgctgctgccccagaagatggcccccagacccagagcccccggcgggagcccgccccaaatgcccctggggacattgctgctgccttccctgctgagcgggacagcagcaccccctaccaggagattgctgctgtgcccagcgctggccgggagcggcagcccaaggaggagggccagaagagcagcttctccttcagcagcggcatcgaccagagccctggcatgagccctgtgcccctgcgggagcccatgaaggcccccctgtgtggggagggggaccagcccggcggctttgagagccaggagaaggaggccgccggcggcttccccccagctgagagccggcagggcgtggcctctgtgcaggtgaccccagaggccccagctgctgcccagcagggcacagagagcagcgctgtgctggagaagagccccctgaagcccatggcccccatcccccaggaccctgccccccgggccagtgaccgggagcggggccagggcgaggccccaccccagtacctgacagatgacctggagttcctgcgggcctgccacctgcccaggagcaacagcggggccgcccctgaggccgaggtgaatgctgccagccaggagagctgccagcagcctgtgggcgcctacctgccccacgccgagctgccctggggcctgcccagccctgccctggtgcctgaggccggcggcagcggcaaggaggccctggacaccattgatgtgcagggccacccccagacaggcatgaggggcaccaagcccaaccaggtggtgtgtgtggccgccggcggccagcctgagggcggcctgcctgtgtccccagagcccagcctgctgacccccacagaggaggcccacccagccagcagcctggccagcttccctgctgcccagatccccatcgctgtggaggagcccggcagcagcagccgggagagcgtgtccaaggccggcatgcctgtgtctgcagatgctgccaaggaggtggtggatgctggcctggtgggcctggagcggcaggtgtctgacctgggcagcaagggggagcaccctgagggggaccccggggaggtgcctgcccccagcccccaggagcggggggagcacctgaacacagagcagagccatgaggtgcagcccggggtgcccccaccacccctgcccaaggagcagagccatgaggtgcagcccggggcccctcctccacccctgcccaaggcccccagcgagagcgcccggggccccccaggccccacagatggagccaaggtgcatgaggacagcaccagccctgctgtggccaaggagggcagccgcagccctggggacagccctgggggcaaggaggaggcccctgagcccccagatggaggagaccccggcaacctgcagggcgaggacagccaggccttcagcagcaagagggaccctgaggtgggcaaggatgagctgagcaagcccagcagtgatgctgagagccgggaccaccccagcagccacagcgcccagccccccaggaagggcggggccggccacacagatggcccccacagccagacagctgaggctgatgccagcggcctgccccacaagctgggggaggaggaccctgtgctgccccctgtgcctgatggagctggggagcccaccgtgcctgagggcgccatctgggagggcagcggcctgcagcccaagtgcccagacaccctgcagagccgggagggcctgggccgcatggagagcttcctgaccctggagagcgagaagagtgacttcccccccacccctgtggccgaggtggcccccaaggcccaggagggggagagcaccctggagatcaggaagatgggcagctgtgatggagagggcctgctgaccagcccagaccagccccggggccctgcctgtgatgccagccggcaggagttccacgccggcgtgccccaccccccccagggcgagaacctggccgctgacctgggcctgacagccctgatcctggaccaggaccagcagggcatccccagctgccctggagagggctggatcagaggagctgccagcgagtggcccctgctgagcagcgagaagcacctgcagcccagccaggcccagcctgagaccagcatctttgatgtgctgaaggagcaggcccagcccccagaaaatggcaaggagaccagccccagccaccctggcttcaaggaccagggcgctgacagcagccagatccacgtgcctgtggagccccaggaggacaacaacctgcccacccacggcggccaggagcaggccctgggcagcgagctgcagagccagctgcccaagggcaccctgagtgacacccccaccagcagccccacagacatggtgtgggagagcagcctgacagaggagagcgagctgagcgcccccacccggcagaagctgcctgccctgggggagaagaggcctgagggcgcctgtggagatggccagagcagccgggtgtccccacctgctgctgatgtgctgaaggacttcagcctggccggcaacttcagcaggaaggagacctgctgcaccggccagggccccaacaagagccagcaggccctggctgatgccctggaggagggcagccagcacgaggaggcctgccagaggcaccctggggccagcgaggccgcagatggctgcagccccctgtggggcctgagcaagcgggagatggccagcggcaacacaggagaggccccaccctgccagcctgacagcgtggccctgctggatgctgtgccctgcctgcctgccctggccccagccagccctggggtgacccccacccaggatgcccctgagacagaggcctgtgatgagacccaggagggccggcagcagcctgtgcctgccccccagcagaagatggagtgctgggccaccagtgatgctgagagccccaagctgctggccagcttccccagcgctggggagcagggcggggaggccggggctgctgagaccggcggcagcgctggggccggggaccccgggaagcagcaggcccctgagaagccaggagaggccaccctgagctgtggcctgctgcagacagagcactgcctgaccagcggggaggaggccagcaccagcgccctgcgggagagctgccaggccgagcaccccatggccagctgccaggatgccctgctgcctgcccgggagctgggcggcatccccaggagcaccatggacttcagcacccaccaggccgtgcctgaccccaaggagctgctgctgagcggccccccagaggtggccgccccagacaccccctacctgcacgtggacagcgctgcccagagaggagcagaagattctggagtgaaggctgtgagcagcgctgacccccgggcccctggagagagcccctgccctgtgggggagccccccctggccctggagaatgctgccagcctgaagctgtttgctggcagcctggcccccctgctgcagcctggagctgctggaggagagatcccagctgtgcaggccagcagcggcagccccaaggcccggaccacagagggccctgtggacagcatgccctgcctggacaggatgcccctgctggccaagggcaagcaggccaccggggaggagaaggccgccacagcccctggagctggggccaaggccagcggggagggcatggctggagatgctgctggggagacagagggctccatggagaggatgggagagcccagccaggaccccaagcagggcaccagcggaggagtggacaccagcagcgagcagatcgccaccctgaccggcttcccagacttccgggagcacatcgccaagatctttgagaagcctgtgctgggcgccctggccaccccaggagagaaggccggggccggccgctctgctgtgggcaaggacctgacccggcccctgggccctgagaagctgctggatggccccccaggagtggatgtgaccctgctgcctgcccccccagcccggctgcaggtggagaagaagcagcagctggccggggaggccgagatcagccacctggccctgcaggaccctgccagtgacaagctgctgggccctgctggcctgacctgggagaggaacctgcccggggccggcgtgggcaaggagatggccggcgtgccccccaccctgagagaagatgagaggcctgagggccctggggccgcctggccaggcctggagggccaggcctacagccagctggagaggagccggcaggagctggccagcggcctgcccagccctgctgccacccaggagctgcctgtggagagagctgctgccttccaggtggccccccacagccacggggaggaggccgtggcccaggaccgcatccccagcggcaagcagcaccaggagaccagcgcctgtgacagcccccacggggaggatggccctggggactttgcccacactggagtgcccggccacgtgcccaggagcacctgtgcccccagcccccagcgggaggtgctgactgtgcctgaggccaacagcgagccctggaccctggacaccctgggcggggagcggcggcctggggtgacagctggcatcctggagatgagaaatgccctgggcaaccagagcaccccagcccccccaactggagaggtggccgacacccccctggagcccgggaaggtggccggggccgccggggaggccgagggggacatcaccctgagcacagctgagacccaggcctgtgccagcggggacctgcctgaggccggcaccaccaggaccttctctgtggtggccggggacctggtgctgcccggcagctgccaggaccctgcctgcagcgacaaggcccctggcatggagggcacagctgccctgcatggagacagccctgcccggccccagcaggccaaggagcagcccggccctgagcggcccatcccagctggagatggcaaggtgtgtgtgagcagccccccagagccagatgagacccatgaccccaagctgcagcacctggcccctgaggagctgcacacagaccgggagagccccaggcctggccccagcatgctgcccagcgtgcccaagaaggatgccccccgggtgatggacaaggtgaccagtgatgagaccagaggagctgagggcacagagaggtctgccaaggacatcggcctgtggaaggccatgatgcccagcctggacacagacaccctggatgtgctggagaggagagtggtgctgatccagcacgagttcctgcacaagaaggaggccaacggccacagccgcttcatgtacagcagccctgtggctgatgacatcatccagcctgctgccccagctgacctggagagccccaccctggccgccagcagctaccatggagatgtggtgggccaggtgtccacagacctgattgcccagaggagcagtgacagcgaggaggcctttgagaccccagagagcaccacccctgtgaaggcccccccagcccctcctcctcctcctcctgaggtgattcctgagcctgaggtgtccacccagcccccacctgaggagcccggctgcggcagcgagaccgtgcctgtgcctgatggccccaggagtgacagcgtggagggcagccccttccggccccccagccacagcttctctgctgtgtttgatgaggacaagcccatcgccagcagcggcacctacaacctggactttgacaacatcgagctggtggacaccttccagaccctggagccccgggccagtgatgccaagaaccaggagggcaaggtgaacaccaggaggaagagcacagattctgtgcccatcagcaagagcaccctgagccgcagcctgagcctgcaggccagtgactttgatggagccagcagcagcggcaaccctgaggccgtggccctggccccagatgcctacagcacaggcagcagcagcgccagcagcaccctgaagaggaccaagaagccccggccccccagcctgaagaagaagcagaccaccaagaagcccacagagaccccacctgtgaaggagacccagcaggagccagatgaggagagcctggtgcccagcggggagaacctggccagcgagaccaagacagaaagtgccaagacagagggccccagccctgccctgctggaggagacccccctggagcctgctgtgggccccaaggccgcctgccccctggacagcgagagcgctgagggcgtggtgcccccagccagcggcggcggccgggtgcagaacagcccccctgtgggcaggaagaccctgcccctgaccacagcccctgaggccggggaggtgacccccagcgacagcggcggccaggaggacagccctgccaagggcctgtctgtgcggctggagtttgactacagcgaggacaagagctcctgggacaaccagcaggagaaccccccacccaccaagaagattggcaagaagcctgtggccaagatgcccctgcggcggcccaagatgaagaagaccccagagaagctggacaacaccccagccagcccccccaggagccctgctgagcccaatgacatccccatcgccaagggcacctacacctttgatattgacaagtgggatgaccccaacttcaaccccttcagcagcaccagcaagatgcaggagagccccaagctgccccagcagagctacaactttgatcctgacacctgtgatgaatctgtggaccccttcaagaccagcagcaagacccccagcagccccagcaagagccctgccagctttgagatcccagccagcgccatggaggccaacggggtggatggagatggcctgaacaagccagccaagaagaagaagacccccctgaagacagacaccttccgggtgaagaagagccccaagaggagccccctgagtgacccccccagccaggaccccaccccagctgccaccccagagaccccacctgtgatctctgctgtggtgcacgccacagatgaggagaagctggccgtgaccaaccagaagtggacctgcatgacagtggacctggaggccgacaagcaggactacccccagcccagcgacctgagcacctttgtgaatgagaccaagttcagcagccccacagaggagctggactacagaaacagctatgaaattgagtacatggagaagattggcagcagcctgccccaggatgatgatgcccccaagaagcaggccctgtacctgatgtttgacaccagccaggagagccctgtgaagagcagccctgtgaggatgtctgagagccccaccccctgcagcggcagcagctttgaggagacagaggccctggtgaacacagctgccaagaaccagcaccctgtgccccggggcctggcccccaaccaggagagccacctgcaggtgcctgagaagagcagccagaaggagctggaggccatgggcctgggcaccccatctgaggccatcgagatccgggaggccgcccaccccacagatgtgtccatcagcaagacagccctgtacagccgcatcggcacagctgaggtggagaagccagctggcctgctcttccagcagcctgacctggacagcgccctgcagatcgcccgggcagagatcatcaccaaggagcgggaggtgtctgagtggaaggacaagtatgaggagagcagaagagaggtgatggagatgaggaagatcgtggccgagtatgagaagaccatcgcccagatgattgaagatgagcagcgggagaagtctgtgagccaccagacagtgcagcagctggtgctggagaaggagcaggccctggccgacctgaacagcgtggagaagagcctggccgacctcttccgccgctatgagaagatgaaggaggtgctggagggcttcaggaagaatgaggaggtgctgaagagatgtgcccaggagtacctgagccgggtgaagaaggaggagcagcgctaccaggccctgaaggtgcacgccgaggagaagctggaccgggccaatgctgagatcgcccaggtgcggggcaaggcccagcaggagcaggccgcccaccaggccagcctgaggaaggagcagctgcgggtggatgccctggagaggaccctggagcagaagaacaaggagattgaggagctgaccaagatctgtgatgagctgattgccaagatgggcaagagctag

SEQ ID NO: 173737 - DNA, 3285 bp, Artificial Sequence; identical to SEQ ID NO: 173732
  Description of Artificial Sequence: Synthetic coding sequence

SEQ ID NO: 173738 - DNA, 2517 bp, Artificial Sequence
  Description of Artificial Sequence: Synthetic coding sequence
atgagcctgcaggtgctgaatgacaagaatgtgtccaatgagaagaacacagagaactgtgacttcctgttcagccccccagaggtgacaggccgcagctctgtgctgcgggtgtcccagaaggaaaatgtgccccccaagaacctggccaaggccatgaaggtgaccttccagacccccctgcgggacccccagacccaccgcatcctgagccccagcatggccagcaagctggaggcccccttcacccaggatgacaccctgggcctggagaacagccaccctgtgtggacccagaaggagaaccagcagctgatcaaggaggtggatgccaagaccacccacggcatcctgcagaagcctgtggaggccgacacagacctgctgggagatgccagccctgccttcggcagcggcagcagcagcgagagcggccctggggccctggccgacctggactgcagcagcagcagccagagccctggcagcagcgagaaccagatggtgtccccaggcaaggtgtctggcagccctgagcaggccgtggaggagaacctgagcagctacagcctggacagaagagtgaccccagccagcgagaccctggaggacccctgcaggacagagagccagcacaaggccgagaccccccacggggctgaggaggagtgcaaggccgagaccccccacggggctgaggaggagtgccgccacggcggcgtgtgtgccccagctgctgtggccaccagccccccaggggccatccccaaggaggcctgtggcggggcccccctgcagggcctgcctggagaggccctgggctgcccagctggggtgggcacccctgtgcctgcagatggcacccagaccctgacctgtgcccacaccagcgcccctgagagcacagcccccaccaaccacctggtggccggccgggccatgaccctgagcccccaggaggaggtggccgccggccagatggccagcagcagccgcagcggccctgtgaagctggagtttgatgtgtctgatggagccaccagcaagagggcccccccaccccggcggctgggggagaggagcggcctgaagccacccctgaggaaggctgctgtgcggcagcagaaggccccccaggaggtggaggaggatgatggccgcagcggggccggggaggacccccccatgcctgccagccggggcagctaccacctggactgggacaagatggatgaccccaacttcatcccctttggaggagacaccaagagcggctgcagcgaggcccagcccccagagagccctgagacccggctgggccagcctgctgctgagcagctgcatgctggccctgccacagaggagcccggcccctgcctgagccagcagctgcacagcgccagcgctgaggacacccctgtggtgcagctggccgctgagacccccacagctgagagcaaggagcgggccctgaacagcgccagcaccagcctgcccaccagctgccccggcagcgagcctgtgcccacccaccagcagggccagcctgccctggagctgaaggaggagagcttccgggaccctgctgaggtgctgggcaccggggctgaggtggactacctggagcagtttggcaccagcagcttcaaggagagcgccctgaggaagcagagcctgtacctgaagtttgaccccctgctgcgggacagccctggccggcctgtgcctgtggccacagagaccagctccatgcatggagccaatgagacccccagcggccggccccgggaggccaagctggtggagtttgacttcctgggcgccctggacatccctgtgcccggccccccacctggggtgcctgcccctgggggcccccccctgagcacaggccccatcgtggacctgctgcagtacagccagaaggacctggatgctgtggtgaaggccacccaggaggagaaccgggagctgcggagccgctgtgaggagctgcacggcaagaacctggagctgggcaagatcatggacagatttgaggaggtggtgtaccaggccatggaggaggtgcagaagcagaaggagctgagcaaggccgagatccagaaggtgctgaaggagaaggaccagctgaccacagacctgaacagcatggagaagagcttcagtgacctcttcaagagatttgagaagcagaaggaggtgattgagggctacaggaagaatgaggagagcctgaagaagtgtgtggaggactacctggcccgcatcacccaggagggccagcgctaccaggccctgaaggcccatgctgaggagaagctgcagctggccaatgaggagatcgcccaggtgcgcagcaaggcccaggccgaggccctggccctgcaggccagcctgaggaaggagcagatgaggatccagagcctggagaagacagtggagcagaagaccaaggaaaatgaggagctgacccgcatctgtgatgacctgatcagcaagatggagaagatctag

SEQ ID NO: 173739 - DNA, 438 bp, Artificial Sequence
  Description of Artificial Sequence: Synthetic coding sequence
atgagcctgcaggtgctgaatgacaagaatgtgtccaatgagaagaacacagagaactgtgacttcctgttcagccccccagaggtgacaggccgcagctctgtgctgcgggtgtcccagaaggaaaatgtgccccccaagaacctggccaaggccatgaaggtgaccttccagacccccctgcgggacccccagacccaccgcatcctgagccccagcatggccagcaagctggaggcccccttcacccaggatgacaccctgggcctggagaacagccaccctgtgtggacccagaaggagaaggccgccgccttcagcctgagcggcggccacgcctgtggggctgtgggcagccgggaccccaacagccgggagcagggcgagagcctggagctgtgccagcacctggccagccacaagctgagccggcagtag

SEQ ID NO: 173740 - DNA, 666 bp, Artificial Sequence
  Description of Artificial Sequence: Synthetic coding sequence
atgagcctgcaggtgctgaatgacaagaatgtgtccaatgagaagaacacagagaactgtgacttcctgttcagccccccagaggtgacaggccgcagctctgtgctgcgggtgtcccagaaggaaaatgtgccccccaagaacctggccaaggccatgaaggtgaccttccagacccccctgcgggacccccagacccaccgcatcctgagccccagcatggccagcaagctggaggcccccttcacccaggatgacaccctgggcctggagaacagccaccctgtgtggacccagaaggagaaccagcagctgatcaaggaggtggatgccaagaccacccacggcatcctgcagaagcctgtggaggccgacacagacctgctgggagatgccagccctgccttcggcagcggcagcagcagcgagagcggccctggggccctggccgacctggactgcagcagcagcagccagagccctggcagcagcgagaaccagatggtgtccccaggcaaggtgtctggcagccctgagcaggccgtggaggagaacctgagcagctacagcctggacagaagagtgaccccagccagcgagaccctggaggacccctgcaggacagagagccagcacaaggccgagaccccccacggggctgagtag

SEQ ID NO: 173741 - DNA, 696 bp, Artificial Sequence
  Description of Artificial Sequence: Synthetic coding sequence
atgagcctgcaggtgctgaatgacaagaatgtgtccaatgagaagaacacagagaactgtgacttcctgttcagccccccagaggtgacaggccgcagctctgtgctgcgggtgtcccagaaggaaaatgtgccccccaagaacctggccaaggccatgaaggtgaccttccagacccccctgcgggacccccagacccaccgcatcctgagccccagcatggccagcaagctggaggcccccttcacccaggatgacaccctgggcctggagaacagccaccctgtgtggacccagaaggagaaccagcagctgatcaaggaggtggatgccaagaccacccacggcatcctgcagaagcctgtggaggccgacacagacctgctgggagatgccagccctgccttcggcagcggcagcagcagcgagagcggccctggggccctggccgacctggactgcagcagcagcagccagagccctggcagcagcgagaaccagatggtgtccccaggcaaggtgtctggcagccctgagcaggccgtggaggagaacctgagcagctacagcctggacagaagagtgaccccagccagcgagaccctggaggacccctgcaggacagagagccagcacaaggccgagaccccccacggggctgaggaggagtgcaaggccgagaccccccacggctag

SEQ ID NO: 173742 - DNA, 606 bp, Artificial Sequence
  Description of Artificial Sequence: Synthetic coding sequence
atggccaacaagggccccagctatggcatgagccgggaggtgcagagcaagattgagaagaagtatgatgaggagctggaggagcggctggtggagtggatcatcgtgcagtgtggcccagatgtgggccgcccagaccggggccgcctgggcttccaggtgtggctgaagaatggagtcatcctgagcaagctggtgaacagcctgtacccagatggcagcaagcctgtgaaggtgcctgaaaatcctccttccatggtgttcaagcagatggagcaggtggcccagttcctgaaggctgctgaggactatggagtcatcaagacagacatgttccagacagtggacctgtttgagggcaaggacatggctgctgtgcagaggaccctgatggccctgggcagcctggccgtgaccaagaatgatggccactacagaggagaccccaactggttcatgaagaaggcccaggagcacaagcgggagttcacagagagccagctgcaggagggcaagcacgtgattggcctgcagatgggcagcaacagaggagccagccaggccggcatgacaggctacggccggccccggcagatcatctcctag

SEQ ID NO: 173743 - DNA, 108 bp, Artificial Sequence
  Description of Artificial Sequence: Synthetic coding sequence
atggccaacaagggccccagctatggcatgagccgggaggtgcagcccagccggctggcctgcctgacccacaccagggtggtgcccagcgccctggccaagctgtag

SEQ ID NO: 173744 - DNA, 606 bp, Artificial Sequence; identical to SEQ ID NO: 173742
  Description of Artificial Sequence: Synthetic coding sequence

SEQ ID NO: 173745 - DNA, 606 bp, Artificial Sequence; identical to SEQ ID NO: 173742
  Description of Artificial Sequence: Synthetic coding sequence

SEQ ID NO: 173746 - DNA, 276 bp, Artificial Sequence
  Description of Artificial Sequence: Synthetic coding sequence
atggccaacaagggccccagctatggcatgagccgggaggtgcagagcaagattgagaagaagtatgatgaggagctggaggagcggctggtggagtggatcatcgtgcagtgtggcccagatgtgggccgcccagaccggggccgcctgggcttccaggtgtggctgaagaatggagtcatcctgagcaagctggtgaacagcctgtacccagatggcagcaagcctgtgaaggtgcctgaaaatcctccttccatggtgttcaagcagatgtag

SEQ ID NO: 173747 - DNA, 606 bp, Artificial Sequence; identical to SEQ ID NO: 173742
  Description of Artificial Sequence: Synthetic coding sequence

SEQ ID NO: 173748 - DNA, 606 bp, Artificial Sequence; identical to SEQ ID NO: 173742
  Description of Artificial Sequence: Synthetic coding sequence

SEQ ID NO: 173749 - DNA, 600 bp, Artificial Sequence
  Description of Artificial Sequence: Synthetic coding sequence
atggccaacagaggccctgcctacggcctgagccgggaggtgcagcagaagattgagaagcagtatgatgctgacctggagcagatcctgatccagtggatcaccacccagtgcaggaaggatgtgggccggccccagcccggccgggagaacttccagaactggctgaaggatggcaccgtgctgtgtgagctgatcaatgccctgtacccagagggccaggcccctgtgaagaagatccaggccagcaccatggccttcaagcagatggagcagatcagccagttcctgcaggccgctgagagatatggcatcaacaccacagacatcttccagacagtggacctgtgggagggcaagaacatggcctgtgtgcagaggaccctgatgaacctgggcggcctggccgtggccagagatgatggcctcttcagcggggaccccaactggttccccaagaagagcaaagaaaaccccaggaacttcagtgacaaccagctgcaggagggcaagaatgtcatcggcctgcagatgggcaccaacagaggagccagccaggccggcatgacaggctacggcatgccccggcagatcctgtag

SEQ ID NO: 173750 - DNA, 663 bp, Artificial Sequence
  Description of Artificial Sequence: Synthetic coding sequence
atgtctgccttcagcctggccctggccctggtgagcagcccccagcccccaccacccatcggcatggccaacagaggccctgcctacggcctgagccgggaggtgcagcagaagattgagaagcagtatgatgctgacctggagcagatcctgatccagtggatcaccacccagtgcaggaaggatgtgggccggccccagcccggccgggagaacttccagaactggctgaaggatggcaccgtgctgtgtgagctgatcaatgccctgtacccagagggccaggcccctgtgaagaagatccaggccagcaccatggccttcaagcagatggagcagatcagccagttcctgcaggccgctgagagatatggcatcaacaccacagacatcttccagacagtggacctgtgggagggcaagaacatggcctgtgtgcagaggaccctgatgaacctgggcggcctggccgtggccagagatgatggcctcttcagcggggaccccaactggttccccaagaagagcaaggagaaccccaggaacttcagtgacaaccagctgcaggagggcaagaatgtgattggcctgcagatgggcaccaacagaggagccagccaggccggcatgacaggctacggcatgccccggcagatcctgtag

SEQ ID NO: 173751 - DNA, 600 bp, Artificial Sequence; identical to SEQ ID NO: 173749
  Description of Artificial Sequence: Synthetic coding sequence

SEQ ID NO: 173752 - DNA, 564 bp, Artificial Sequence
  Description of Artificial Sequence: Synthetic coding sequence
atggccaacagaggccctgcctacggcctgagccgggaggtgcagcagaagattgagaagcagtatgatgctgacctggagcagatcctgatccagtggatcaccacccagtgcaggaaggatgtgggccggccccagcccggccgggagaacttccagaactggctgaaggatggcaccgtgctgtgtgagctgatcaatgccctgtacccagagggccaggcccctgtgaagaagatccaggccagcaccatggccttcaagcagatggagcagatcagccagttcctgcaggccgctgagagatatggcatcaacaccacagacatcttccagacagtggacctgtgggagggcaagaacatggcctgtgtgcagaggaccctgatgaacctgggcggcctggccgtggccagagatgatggcctcttcagcggggaccccaactggttccccaagaagagcaaagaaaaccccaggaacttcagtgacaaccagctgcaggagggcaagaatgtcatcggcctgcagatgggcaccaacagaggagccagccaggcctag

SEQ ID NO: 173753 - DNA, 3861 bp, Artificial Sequence
  Description of Artificial Sequence: Synthetic coding sequence
atgagccacctggtggaccccaccagcggggacctgcctgtgcgggacattgatgccatccccctggtgctgcctgccagcaagggcaagaacatgaagacccagccccccctgagcaggatgaaccgggaggagctggaggacagcttcttccggctgcgggaggaccacatgctggtgaaggagctgtcctggaagcagcaggatgagatcaagaggctgcggaccaccctgctgcggctgacagctgctggccgggacctgcgggtggccgaggaggccgcccccctgtctgaaacagcccggcggggccagaaggccggctggaggcagaggctgtccatgcaccagaggccccagatgcaccggctgcagggccacttccactgtgtgggccctgccagcccccggcgggcccagccccgggtgcaggtgggccaccggcagctgcacacagctggggcccctgtgcctgagaagcccaagaggggcccccgggaccggctgagctacacagccccacccagcttcaaggagcacgccaccaatgaaaatagaggagaggtggccagcaagcccagcgagctggtgtctggcagcaacagcatcatctccttcagcagcgtcatctccatggccaagcccatcggcctgtgcatgcccaacagcgcccacatcatggccagcaacaccatgcaggtggaggagccccccaagagccctgagaagatgtggcccaaggatgaaaattttgagcagaggagcagcctggagtgtgcccagaaggctgctgagctgcgggccagcatcaaggagaaggtggagctgatccggctgaagaagctgctgcacgagagaaatgccagcctggtgatgaccaaggcccagctgacagaggtgcaggaggcctgcaccttcctgctgacccagaaccagggcatcctgtctgctgcccacgaggccctgctgaagcaggtgaatgagctgcgggcagagctgaaggaggagagcaagaaggctgtgtccctgaagagccagctggaggatgtgtccatcctgcagatgaccctgaaggagttccaggagcgggtggaggacctggagaaggagaggaagctgctgaatgacaactatgacaagctgctggagagcatgctggacagcagtgacagcagcagccagccccactggagcaatgagctgattgctgagcagctgcagcagcaggtgtcccagctgcaggaccagctggatgctgagctggaggacaagaggaaggtgctgctggagctgagccgggagaaggcccagaatgaagacctgaagctggaggtgaccaacatcctgcagaagcacaagcaggaggtggagctgctgcagaatgctgccaccatcagccagcccccagaccggcagagcgagcccgccacccaccctgctgtgctgcaggagaacacccagatcgagcccagcgagcccaagaaccaggaggagaagaagctgagccaggtgctgaatgagctgcaggtgtcccatgctgagaccaccctggagctggagaagacccgggacatgctgatcctgcagaggaagatcaacgtgtgctaccaggaggagctggaggccatgatgaccaaggctgacaatgacaacagagaccacaaggagaagctggagcggctgacccggctgctggacctgaagaacaaccgcatcaagcagctggagggcatcctgcggagccatgacctgcccaccagcgagcagctgaaggatgtggcctacggcacccggcccctgagcctgtgcctggagaccctgcctgcccatggagatgaggacaaggtggacatcagcctgctgcaccagggcgagaacctgtttgagctgcacatccaccaggccttcctgaccagcgctgccctggcccaggccggggacacccagcccaccaccttctgcacctacagcttctatgactttgagacccactgcacccccctgtctgtgggcccccagcccctgtatgacttcaccagccagtatgtgatggagacagacagcctcttcctgcactacctgcaggaggccagcgcccggctggacatccaccaggccatggccagcgagcacagcaccctggccgccggctggatctgctttgacagagtgctggagaccgtggagaaggtgcacggcctggccaccctcatcggggccggcggggaggagtttggagtgctggagtactggatgaggctgcgcttccccatcaagcccagcctgcaggcctgcaacaagaggaagaaggcccaggtgtacctgagcacagatgtgctgggcggcaggaaggcccaggaggaggagttccgctctgagagctgggagccccagaatgagctgtggattgagatcaccaagtgctgcggcctgcggagccgctggctgggcacccagcccagcccctatgctgtgtaccgcttcttcaccttcagtgaccatgacacagccatcatcccagccagcaacaacccctacttccgggaccaggcccgcttccctgtgctggtgaccagtgacctggaccactacctgcggcgggaggccctgagcatccacgtgtttgatgatgaggacctggagcccggcagctacctgggccgggcccgggtgcccctgctgcccctggccaagaatgaaagcatcaagggggacttcaacctgacagatcctgctgagaagcccaacggcagcatccaggtgcagctggactggaagttcccctacatccccccagagagcttcctgaagccagaggcccagaccaagggcaaggacaccaaggacagcagcaagatcagcagcgaggaggagaaggccagcttccccagccaggaccagatggccagccctgaggtgcccattgaagctggccagtaccgcagcaagaggaagccaccccacggcggggagaggaaggagaaggagcaccaggtggtgtcctacagcaggaggaagcacggcaagagaattggagtgcagggcaagaacaggatggagtacctgagcctgaacatcctgaatggaaacaccccagagcaggtgaactacacagagtggaagttcagcgagaccaacagcttcatcggagatggcttcaagaaccagcacgaggaggaggagatgaccctgagccacagcgccctgaagcagaaggagcccctgcaccctgtgaatgacaaggagagcagcgagcagggcagcgaggtgtctgaggcccagaccacagacagtgatgatgtgattgtgccccccatgagccagaagtaccccaaggctgacagcgagaagatgtgcatcgagatcgtgtccctggccttctacccagaggccgaggtgatgtctgatgagaacatcaagcaggtgtatgtggagtacaagttctatgacctgcccctgtctgaaacagagacccctgtgtccctgaggaagcccagggctggggaggagatccacttccacttcagcaaggtgattgacctggacccccaggagcagcagggcagaagacgcttcctgtttgacatgctgaatggccaggaccctgaccagggccacctgaagttcaccgtggtgtctgaccccctggatgaggagaagaaggaatgtgaggaggtgggctacgcctacctgcagctgtggcagatcctggagagcggccgggacatcctggagcaggagctggacatcgtgtccccagaggacctggccacccccatcggccgcctgaaggtgtccctgcaggccgctgctgtgctgcacgccatctacaaggagatgacagaggacctcttctcctag

SEQ ID NO: 173754 - DNA, 1128 bp, Artificial Sequence
  Description of Artificial Sequence: Synthetic coding sequence
atgaagaggccagacctgcccagcggctttgatggctggcaggtggtggatgccaccccccaggagaccagcagcggcatcttctgctgcggcccctgcagcgtggagagcatcaagaatggcctggtgtacatgaagtatgacacccccttcatctttgctgaggtgaacagcgacaaggtgtactggcagaggcaggatgatggcagcttcaagatcgtgtatgtggaggagaaggccatcggcaccctgattgtgaccaaggccatcagcagcaacatgagggaggacatcacctacctgtacaagcaccctgagggcagtgatgctgagaggaaggctgtggagacagctgctgcccacggcagcaagcccaacgtgtatgccaacagaggcagcgcagaagatgtggccatgcaggtggaggcccaggatgctgtgatgggccaggacctgatggtgtctgtgatgctgatcaaccacagcagcagcagaagaacagtgaagctgcacctgtacctgtctgtgaccttctacacaggagtgtctggcaccatcttcaaggagaccaagaaggaggtggagctggcccctggggccagtgacagagtgaccatgcctgtggcctacaaggagtaccggccccacctggtggaccagggcgccatgctgctgaatgtgtctggccacgtgaaggagagcggccaggtgctggccaagcagcacaccttccggctgcggaccccagacctgagcctgaccctgctgggcgctgctgtggtgggccaggagtgtgaggtgcagatcgtgttcaagaaccccctgcctgtgaccctgaccaacgtggtgttccggctggagggcagcggcctgcagaggcccaagatcctgaatgtgggggacatcggcggcaatgaaacagtgaccctgcggcagagctttgtgcctgtgcggcccggcccccggcagctgattgccagcctggacagcccccagctgagccaggtgcatggagtcatccaggtggatgtggccccagcccctggagatggcggcttcttcagtgatgctggaggagacagccacctgggggagaccatccccatggccagcagaggaggagcctag

SEQ ID NO: 173755 - DNA, 408 bp, Artificial Sequence
  Description of Artificial Sequence: Synthetic coding sequence
atgatggatggccccaggagtgatgtgggccgctggggcggcaaccccctgcagccccccaccacccccagccctgagcctgagcctgagccagatggccgcagccggcggggcggcggccgctccttctgggcccgctgctgcggctgctgcagctgcagaaatgctgctgatgatgactggggccctgagcccagcgacagccggggccggggcagcagcagcggcacccggcggcccggcagccggggcagtgacagccggcggcctgtgtcccggggcagcggcgtgaatgctgctggagatggcaccatccgggagggcatgctggtggtgaatggagtggacctgctgagcagcagaagtgaccagaacagaagagagcaccacacagatgaatatgaatag

SEQ ID NO: 173756 - DNA, 129 bp, Artificial Sequence
  Description of Artificial Sequence: Synthetic coding sequence
atgatggatggccccaggagtgatgtgggccgctggggcggcaaccccctgcagccccccaccacccccagccctgagcctgagcctgagccagatggccgcagccggcggggcggcggccgctcctag

SEQ ID NO: 173757 - DNA, 198 bp, Artificial Sequence
  Description of Artificial Sequence: Synthetic coding sequence
atgatggatggccccaggagtgatgtgggccgctggggcggcaaccccctgcagccccccaccacccccagccctgagcctgagcctgagccagatggccgcagccggcggggcggcggccgctccttctgggcccgctgctgcggctgctgcagctgcagaaatgctgctgatgatgactggggccctgagccctag

SEQ ID NO: 173758 - DNA, 153 bp, Artificial Sequence
  Description of Artificial Sequence: Synthetic coding sequence
atgatggatggccccaggagtgatgtgggccgctggggcggcaaccccctgcagccccccaccacccccagccctgagcctgagcctgagccagatggccgcagccggcggggcggcggccgctccttctgggcccgctgctgcggctgctag

SEQ ID NO: 173759 - DNA, 30 bp, Artificial Sequence
  Description of Artificial Sequence: Synthetic coding sequence
atgatggatggccccaggagtgatgtgtag

SEQ ID NO: 173760 - DNA, 2064 bp, Artificial Sequence
  Description of Artificial Sequence: Synthetic coding sequence
atggccgaggagctggtgctggagcgctgtgacctggagctggagaccaacggccgggaccaccacacagctgacctgtgccgggagaagctggtggtgcggcggggccagcccttctggctgaccctgcactttgagggcaggaactatgaggcctctgtggacagcctgaccttctctgtggtgactggacctgcccccagccaggaggccggcaccaaggcccgcttccccctgagagatgctgtggaggagggggactggacagccaccgtggtggaccagcaggactgcaccctgagcctgcagctgaccaccccagccaatgcccccatcggcctgtaccgcctgagcctggaggccagcacaggctaccagggcagcagctttgtgctgggccacttcatcctgctcttcaatgcctggtgcccagcagatgctgtgtacctggacagcgaggaggagcggcaggagtatgtgctgacccagcagggcttcatctaccagggcagcgccaagttcatcaagaacatcccctggaactttggccagtttgaagatggcatcctggacatctgcctgatcctgctggatgtgaaccccaagttcctgaagaatgccggccgggactgcagcagaagaagcagccctgtgtatgtgggccgggtggtgtctggcatggtgaactgcaatgatgaccagggcgtgctgctgggccgctgggacaacaactatggagatggagtgagccccatgtcctggattggctctgtggacatcctgcggcgctggaagaaccacggctgccagagggtgaagtatggccagtgctgggtgtttgctgctgtggcctgcaccgtgctgcgctgcctgggcatccccaccagggtggtgaccaactacaacagcgcccatgaccagaacagcaacctgctgattgagtacttcagaaatgaatttggagagatccagggcgacaagtctgagatgatctggaacttccactgctgggtggagagctggatgaccaggccagacctgcagcccggctatgagggctggcaggccctggaccccaccccccaggagaagtctgagggcacctactgctgcggccctgtgcctgtgcgggccatcaaggagggggacctgagcaccaagtatgatgccccctttgtgtttgctgaggtgaatgctgatgtggtggactggatccagcaggatgatggctctgtgcacaagagcatcaacagaagcctgattgtgggcctgaagatcagcaccaagtctgtgggcagagatgaaagagaggacatcacccacacctacaagtacccagagggcagcagcgaggagcgggaggccttcacccgggccaaccacctgaacaagctggccgagaaggaggagaccggcatggccatgaggatccgggtgggccagagcatgaacatgggcagtgactttgatgtgtttgcccacatcaccaacaacacagctgaggagtatgtgtgccgcctgctgctgtgtgccaggacagtgtcctacaacggcatcctgggcccagaatgtggcaccaagtacctgctgaacctgaacctggagcccttcagcgagaagtctgtgcccctgtgcatcctgtatgagaagtacagagactgcctgacagagagcaacctgatcaaggtgcgggccctgctggtggagcccgtcatcaacagctacctgctggccgagcgggacctgtacctggagaaccctgagatcaagatccgcatcctgggggagcccaagcagaagaggaagctggtggccgaggtgtccctgcagaaccccctgcctgtggccctggagggctgcaccttcaccgtggagggcgccggcctgacagaggagcagaagacagtggagatcccagaccctgtggaggccggggaggaggtgaaggtgaggatggacctgctgcccctgcacatgggcctgcacaagctggtggtgaactttgaaagtgacaagctgaaggctgtgaagggcttcagaaatgtcatcatcggccctgcctag

SEQ ID NO: 173761 - DNA, 846 bp, Artificial Sequence
  Description of Artificial Sequence: Synthetic coding sequence
atggccgaggagctggtgctggagcgctgtgacctggagctggagaccaacggccgggaccaccacacagctgacctgtgccgggagaagctggtggtgcggcggggccagcccttctggctgaccctgcactttgagggcaggaactatgaggcctctgtggacagcctgaccttctctgtggtgactggacctgcccccagccaggaggccggcaccaaggcccgcttccccctgagagatgctgtggaggagggggactggacagccaccgtggtggaccagcaggactgcaccctgagcctgcagctgaccaccccagccaatgcccccatcggcctgtaccgcctgagcctggaggccagcacaggctaccagggcagcagctttgtgctgggccacttcatcctgctcttcaatgcctggtgcccagcagatgctgtgtacctggacagcgaggaggagcggcaggagtatgtgctgacccagcagggcttcatctaccagggcagcgccaagttcatcaagaacatcccctggaactttggccagtttgaagatggcatcctggacatctgcctgatcctgctggatgtgaaccccaagttcctgaagaatgccggccgggactgcagcagaagaagcagccctgtgtatgtgggccgggtggtgtctggcatggtgaactgcaatgatgaccagggcgtgctgctgggccgctgggacaacaactatggagatggagtgagccccatgtcctggattggctctgtggacatcctgcggcgctggaagaaccacggctgccagagggtgaagtatggccagtgctgggtgtttgcctag

SEQ ID NO: 173762 - DNA, 483 bp, Artificial Sequence
  Description of Artificial Sequence: Synthetic coding sequence
atggccgaggagctggtgctggagcgctgtgacctggagctggagaccaacggccgggaccaccacacagctgacctgtgccgggagaagctggtggtgcggcggggccagcccttctggctgaccctgcactttgagggcaggaactatgaggcctctgtggacagcctgaccttctctgtggtgactggacctgcccccagccaggaggccggcaccaaggcccgcttccccctgagagatgctgtggaggagggggactggacagccaccgtggtggaccagcaggactgcaccctgagcctgcagctgaccaccccagccaatgcccccatcggcctgtaccgcctgagcctggaggccagcacaggctaccagggcagcagctttgtgctgggccacttcatcctgctcttcaatgcctggtgcccagcagatgctgtgtacctggacagcgaggaggagcggcaggagtatgtgtag

SEQ ID NO: 173763 - DNA, 1821 bp, Artificial Sequence
  Description of Artificial Sequence: Synthetic coding sequence
atggccgaggagctggtgctggagcgctgtgacctggagctggagaccaacggccgggaccaccacacagctgacctgtgccgggagaagctggtggtgcggcggggccagcccttctggctgaccctgcactttgagggcaggaactatgaggcctctgtggacagcctgaccttctctgtggtgacagcagatgctgtgtacctggacagcgaggaggagcggcaggagtatgtgctgacccagcagggcttcatctaccagggcagcgccaagttcatcaagaacatcccctggaactttggccagtttgaagatggcatcctggacatctgcctgatcctgctggatgtgaaccccaagttcctgaagaatgccggccgggactgcagccgccgcagcagccctgtgtatgtgggccgggtggtgtctggcatggtgaactgcaatgatgaccagggcgtgctgctgggccgctgggacaacaactatggagatggagtgagccccatgtcctggattggctctgtggacatcctgcggcgctggaagaaccacggctgccagagggtgaagtatggccagtgctgggtgtttgctgctgtggcctgcaccgtgctgcgctgcctgggcatccccaccagggtggtgaccaactacaacagcgcccatgaccagaacagcaacctgctgattgagtacttcagaaatgaatttggagagatccagggcgacaagtctgagatgatctggaacttccactgctgggtggagagctggatgaccaggccagacctgcagcccggctatgagggctggcaggccctggaccccaccccccaggagaagtctgagggcacctactgctgcggccctgtgcctgtgcgggccatcaaggagggggacctgagcaccaagtatgatgccccctttgtgtttgctgaggtgaatgctgatgtggtggactggatccagcaggatgatggctctgtgcacaagagcatcaacagaagcctcatcgtgggcctgaagatcagcaccaagtctgtgggcagagatgagcgggaggacatcacccacacctacaagtacccagagggcagcagcgaggagcgggaggccttcacccgggccaaccacctgaacaagctggccgagaaggaggagaccggcatggccatgaggatccgggtgggccagagcatgaacatgggcagtgactttgatgtgtttgcccacatcaccaacaacacagctgaggagtatgtgtgccgcctgctgctgtgtgccaggacagtgtcctacaacggcatcctgggcccagaatgtggcaccaagtacctgctgaacctgaacctggagcccttcagcgagaagtctgtgcccctgtgcatcctgtatgagaagtacagagactgcctgacagagagcaacctgatcaaggtgcgggccctgctggtggagcctgtgatcaacagctacctgctggccgagcgggacctgtacctggagaaccctgagatcaagatccgcatcctgggggagcccaagcagaagaggaagctggtggccgaggtgtccctgcagaaccccctgcctgtggccctggagggctgcaccttcaccgtggagggcgccggcctgacagaggagcagaagacagtggagatcccagaccctgtggaggccggggaggaggtgaaggtgaggatggacctgctgcccctgcacatgggcctgcacaagctggtggtgaactttgaaagtgacaagctgaaggctgtgaagggcttcagaaatgtcatcatcggccctgcctag

SEQ ID NO: 173764 - DNA, 1884 bp, Artificial Sequence
  Description of Artificial Sequence: Synthetic coding sequence
atggccgagggccctgcccccagccaggaggccggcaccaaggcccgcttccccctgagagatgctgtggaggagggggactggacagccaccgtggtggaccagcaggactgcaccctgagcctgcagctgaccaccccagccaatgcccccatcggcctgtaccgcctgagcctggaggccagcacaggctaccagggcagcagctttgtgctgggccacttcatcctgctcttcaatgcctggtgcccagcagatgctgtgtacctggacagcgaggaggagcggcaggagtatgtgctgacccagcagggcttcatctaccagggcagcgccaagttcatcaagaacatcccctggaactttggccagtttgaagatggcatcctggacatctgcctgatcctgctggatgtgaaccccaagttcctgaagaatgccggccgggactgcagcagaagaagcagccctgtgtatgtgggccgggtggtgtctggcatggtgaactgcaatgatgaccagggcgtgctgctgggccgctgggacaacaactatggagatggagtgagccccatgtcctggattggctctgtggacatcctgcggcgctggaagaaccacggctgccagagggtgaagtatggccagtgctgggtgtttgctgctgtggcctgcaccgtgctgcgctgcctgggcatccccaccagggtggtgaccaactacaacagcgcccatgaccagaacagcaacctgctgattgagtacttcagaaatgaatttggagagatccagggcgacaagtctgagatgatctggaacttccactgctgggtggagagctggatgaccaggccagacctgcagcccggctatgagggctggcaggccctggaccccaccccccaggagaagtctgagggcacctactgctgcggccctgtgcctgtgcgggccatcaaggagggggacctgagcaccaagtatgatgccccctttgtgtttgctgaggtgaatgctgatgtggtggactggatccagcaggatgatggctctgtgcacaagagcatcaacagaagcctgattgtgggcctgaagatcagcaccaagtctgtgggcagagatgaaagagaggacatcacccacacctacaagtacccagagggcagcagcgaggagcgggaggccttcacccgggccaaccacctgaacaagctggccgagaaggaggagaccggcatggccatgaggatccgggtgggccagagcatgaacatgggcagtgactttgatgtgtttgcccacatcaccaacaacacagctgaggagtatgtgtgccgcctgctgctgtgtgccaggacagtgtcctacaacggcatcctgggcccagaatgtggcaccaagtacctgctgaacctgaacctggagcccttcagcgagaagtctgtgcccctgtgcatcctgtatgagaagtacagagactgcctgacagagagcaacctgatcaaggtgcgggccctgctggtggagcccgtcatcaacagctacctgctggccgagcgggacctgtacctggagaaccctgagatcaagatccgcatcctgggggagcccaagcagaagaggaagctggtggccgaggtgtccctgcagaaccccctgcctgtggccctggagggctgcaccttcaccgtggagggcgccggcctgacagaggagcagaagacagtggagatcccagaccctgtggaggccggggaggaggtgaaggtgaggatggacctgctgcccctgcacatgggcctgcacaagctggtggtgaactttgaaagtgacaagctgaaggctgtgaagggcttcagaaatgtcatcatcggccctgcctag

SEQ ID NO: 173765 - DNA, 2082 bp, Artificial Sequence
  Description of Artificial Sequence: Synthetic coding sequence
atggccgccctgggcgtgcagagcatcaactggcagacagccttcaaccggcaggcccaccacacagacaagttcagcagccaggagctgatcctgcggcggggccagaacttccaggtgctgatgatcatgaacaagggcctgggcagcaatgaaaggctggagttcatcgtgtccacaggcccctaccccagcgagagcgccatgaccaaggctgtgttccccctgagcaatggcagcagcggcggctggagcgctgtgctgcaggccagcaatggaaacaccctgaccatcagcatcagcagccctgccagcgcccccatcggccgctacaccatggccctgcagatcttcagccagggcggcatcagctctgtgaagctgggcaccttcatcctgctcttcaacccctggctgaatgtggacagcgtcttcatgggcaaccacgccgagcgggaggagtatgtgcaggaggatgctggcatcatctttgtgggcagcaccaacagaattggcatgattggctggaactttggccagtttgaggaggacatcctgagcatctgcctgagcatcctggacaggagcctgaacttcagaagagatgctgccacagatgtggccagcagaaatgaccccaagtatgtgggccgggtgctgagcgccatgatcaacagcaatgatgacaacggggtgctggccggcaactggagcggcacctacacaggaggccgggaccccaggtcctggaatggatctgtggagatcctgaagaactggaagaagagcggcttcagccctgtgcgctatggccagtgctgggtgtttgctggcaccctgaacacagccctgcggagcctgggcatccccagcagggtcatcaccaacttcaacagcgcccatgacacagacaggaacctgtctgtggatgtgtactatgaccccatgggcaaccccctggacaagggcagtgacagcgtgtggaacttccacgtgtggaatgaaggctggtttgtgcggagtgacctgggccccagctatggaggctggcaggtgctggatgccaccccccaggagaggagccagggcgtcttccagtgtggccctgcctctgtgattggagtgcgggagggagatgtgcagctgaactttgacatgcccttcatctttgctgaggtgaatgctgaccgcatcacctggctgtatgacaacaccaccgggaagcagtggaagaacagcgtgaacagccacaccatcggccgctacatcagcaccaaggctgtgggcagcaatgccaggatggatgtgacagacaagtacaagtacccagagggcagtgaccaggagcggcaggtgttccagaaggccctgggcaagctgaagcccaacaccccatttgctgccaccagctccatgggcctggagacagaggagcaggagcccagcatcatcggcaagctgaaggtggccggcatgctggccgtgggcaaggaggtgaacctggtgctgctgctgaagaacctgagccgggacaccaagacagtgacagtgaacatgacagcctggaccatcatctacaacggcaccctggtgcatgaggtgtggaaggacagcgccaccatgagcctggaccctgaggaggaggccgagcaccccatcaagatctcctatgcccagtatgagaagtacctgaagagtgacaacatgatccgcatcacagctgtgtgcaaggtgcctgatgagagcgaggtggtggtggagcgggacatcatcctggacaaccccaccctgaccctggaggtgctgaatgaggcccgggtgaggaagcctgtgaatgtgcagatgctgttcagcaaccccctggatgagcctgtgcgggactgtgtgctgatggtggagggcagcggcctgctgctgggcaacctgaagattgatgtgcccaccctgggccccaaggagggcagccgggtgcgctttgacatcctgcccagccgcagcggcaccaagcagctgctggccgacttcagctgcaacaagtttcctgccatcaaggccatgctgagcattgatgtggccgagtag

SEQ ID NO: 173766 - DNA, 1602 bp, Artificial Sequence
  Description of Artificial Sequence: Synthetic coding sequence
atggccgccctgggcgtgcagagcatcaactggcagacagccttcaaccggcaggcccaccacacagacaagttcagcagccaggagctgatcctgcggcggggccagaacttccaggtgctgatgatcatgaacaagggcctgggcagcaatgaaaggctggagttcatcgtgtccacaggcccctaccccagcgagagcgccatgaccaaggctgtgttccccctgagcaatggcagcagcggcggctggagcgctgtgctgcaggccagcaatggaaacaccctgaccatcagcatcagcagccctgccagcgcccccatcggccgctacaccatggccctgcagatcttcagccagggcggcatcagctctgtgaagctgggcaccttcatcctgctcttcaacccctggctgaatgtggacagcgtcttcatgggcaaccacgccgagcgggaggagtatgtgcaggaggatgctggcatcatctttgtgggcagcaccaacagaattggcatgattggctggaactttggccagtttgaggaggacatcctgagcatctgcctgagcatcctggacaggagcctgaacttcagaagagatgctgccacagatgtggccagcagaaatgaccccaagtatgtgggccgggtgctgagcgccatgatcaacagcaatgatgacaacggggtgctggccggcaactggagcggcacctacacaggaggccgggaccccaggtcctggaatggatctgtggagatcctgaagaactggaagaagagcggcttcagccctgtgcgctatggccagtgctgggtgtttgctggcaccctgaacacagccctgcggagcctgggcatccccagcagggtcatcaccaacttcaacagcgcccatgacacagacaggaacctgtctgtggatgtgtactatgaccccatgggcaaccccctggacaagggcagtgacagcgtgtggaacttccacgtgtggaatgaaggctggtttgtgcggagtgacctgggccccagctatggaggctggcaggtgctggatgccaccccccaggagaggagccagggcgtcttccagtgtggccctgcctctgtgattggagtgcgggagggagatgtgcagctgaactttgacatgcccttcatctttgctgaggtgaatgctgaccgcatcacctggctgtatgacaacaccaccgggaagcagtggaagaacagcgtgaacagccacaccatcggccgctacatcagcaccaaggctgtgggcagcaatgccaggatggatgtgacagacaagtacaagtacccagagggcagtgaccaggagcggcaggtgttccagaaggccctgggcaagctgaagcccaacaccccatttgctgccaccagctccatgggcctggagacagaggagcaggagcccagcatcatcggcaagctgaaggtggccggcatgctggccgtgggcaaggaggtgaacctggtgctgctgctgatcccccacgccctgcagtgctgcaggatggactggcccctgacccagggcctgagcaagagggacaccggggagaagctggtgtag

SEQ ID NO: 173767 - DNA, 2055 bp, Artificial Sequence
  Description of Artificial Sequence: Synthetic coding sequence
atgatggatgccagcaaggagctgcaggtgctgcacatcgacttcctgaaccaggacaatgctgtgagccaccacacctgggagttccagaccagcagccctgtgttcagaagaggccaggtgttccacctgcggctggtgctgaaccagcccctgcagagctaccaccagctgaagctggagttcagcacaggccccaaccccagcatcgccaagcacaccctggtggtgctggaccccaggacccccagcgaccactacaactggcaggccaccctgcagaatgaaagtggcaaggaggtgacagtggccgtgaccagcagccccaatgccatcctgggcaagtaccagctgaatgtgaagacaggcaaccacatcctgaagtctgaggagaacatcctgtacctgctcttcaacccctggtgcaaggaggacatggtgttcatgccagatgaagatgagaggaaggagtacatcctgaatgacaccggctgccactacgtgggcgccgcccggagcatcaagtgcaagccctggaactttggccagtttgagaagaatgtgctggactgctgcatcagcctgctgacagagagcagcctgaagcccacagaccggcgggaccctgtgctggtgtgccgggccatgtgtgccatgatgagctttgagaagggccagggcgtgctgattggcaactggacaggagactatgaaggaggaacagccccctacaagtggacaggcagcgcccccatcctgcagcagtactacaacaccaagcaggccgtgtgcttcggccagtgctgggtgtttgctggcatcctgaccaccgtgctgcgggccctgggcatcccagcccggtctgtgacaggctttgacagcgcccatgacacagagaggaacctgactgtggacacctacgtgaatgaaaatggagagaagatcacctccatgacccatgacagcgtgtggaacttccacgtgtggacagatgcctggatgaagaggccagacctgcccaagggctatgatggctggcaggccgtggatgccaccccccaggagaggagccagggcgtcttctgctgcggccccagccccctgacagccatcagaaaaggagacatcttcatcgtgtatgacaccaggtttgtgttttctgaggtgaatggagacaggctcatctggctggtgaagatggtgaatggccaggaggagctgcacgtgatctccatggagaccaccagcatcggcaagaacatcagcaccaaggctgtgggccaggacagaagaagagacatcacctatgagtacaagtacccagagggcagcagcgaggagcggcaggtgatggaccacgccttcctgctgctgagcagcgagcgggagcacagaagacctgtgaaggagaacttcctgcacatgtctgtgcagagtgatgatgtgctgctgggcaacagcgtgaacttcaccgtcatcctgaagaggaagacagctgccctgcagaatgtgaacatcctgggcagctttgagctgcagctgtacaccgggaagaagatggccaagctgtgtgacctgaacaagaccagccagatccagggccaggtgtctgaggtgaccctgaccctggacagcaagacctacatcaacagcctggccatcctggatgatgagcctgtgatccggggcttcatcatcgccgagatcgtggagagcaaggagatcatggccagcgaggtgttcaccagcttccagtacccagagttcagcattgagctgcccaacacaggaagaattggccagctgctggtgtgcaactgcatcttcaagaacaccctggccatccccctgacagatgtgaagttcagcctggagagcctgggcatcagcagcctgcagaccagtgaccatggaacagtgcagcccggggagaccatccagagccagatcaagtgcacccccatcaagacaggccccaagaagttcatcgtgaagctgagcagcaagcaggtgaaggagatcaatgcccagaagatcgtgctgatcaccaagtag

SEQ ID NO: 173768 - DNA, 1626 bp, Artificial Sequence
  Description of Artificial Sequence: Synthetic coding sequence
atgttctcctggatgggccggcaggccggcggccgggagagagctggaggagcagatgctgtgcagacagtgactggaggcctgcggagcctgtacctgaggaaggtgctgcccctggaggaggcctaccgcttccacgagttccacagccctgccctggaggatgctgactttgagaacaagcccatgatcctgctggtgggccagtacagcacaggcaagaccaccttcatccgctacctgctggagcaggacttccctggcatgagaattggccctgagcccaccacagacagcttcatcgctgtgatgtatggagaaacagagggcagcaccccaggaaatgccctggtggtggaccccaagaagcccttcaggaagctgagcagatttggaaatgccttcctgaaccgcttcatgtgcagccagctgcccaaccaggtgctgaagagcatctctgtgattgacagccctggcatcctgagcggggagaagcagaggatcagccggggctatgacttctgccaggtgctgcagtggtttgctgagcgggtggaccgcatcatcctgctgtttgatgcccacaagctggacatcagtgatgagttcagcgaggccatcaaggccttccggggccaggatgacaagatccgggtggtgctgaacaaggctgaccaggtggacacccagcagctgatgagggtgtatggagccctgatgtggagcctgggcaaggtgatcaacaccccagaggtgctgcgggtgtacatcggcagcttctgggcccagcccctgcagaacacagacaacagaagactctttgaggccgaggcccaggacctcttccgggacatccagagcctgccccagaaggctgctgtgaggaagctgaatgacctgatcaagagggcccggctggccaaggtgcacgcctacatcatctcctacctgaagaaggagatgcccagcgtgtttgggaaggagaacaagaagcgggagctgatcagccggctgcctgagatctacatccagctgcagcgggagtaccagatctctgctggggacttccctgaggtgaaggccatgcaggagcagctggagaactatgacttcaccaagttccacagcctgaagcccaagctgattgaggccgtggacaacatgctgagcaacaagatcagccccctgatgaacctgatcagccaggaggagaccagcacccccacccagctggtgcagggcggggcctttgatggcaccacagagggccccttcaaccagggctatggagagggcgccaaggagggcgcagatgaggaggagtgggtggtggccaaggacaagcctgtgtatgatgagctgttctacaccctgagccccatcaacgggaagatcagcggcgtgaatgccaagaaggagatggtgaccagcaagctgcccaacagcgtgctgggcaagatctggaagctggccgactgtgactgtgatggcatgctggatgaggaggagtttgccctggccaagcacctgatcaagatcaagctggatggctatgagctgcccagcagcctgcccccccacctggtgccccccagccacaggaagagcctgcccaaggctgactag

SEQ ID NO: 173769 - DNA, 1917 bp, Artificial Sequence
  Description of Artificial Sequence: Synthetic coding sequence
atggcccagggcctggaggtggccctgacagacctgcagagcagcaggaacaacgtgcgccaccacacagaggagatcaccgtggaccacctgctggtgcggcggggccaggccttcaacctgaccctgtacttcaggaacagaagcttccagcccggcctggacaacatcatctttgtggtggagacagaagatgctgtgtacctggacagcgagccccagaggcaggagtatgtgatgaatgactatggcttcatctaccagggcagcaagaactggatccggccctgcccctggaactacggccagtttgaggacaagatcatcgacatctgcctgaagctgctggacaagagcctgcacttccagacagatcctgccacagactgtgccctgcggggcagccctgtgtatgtgtcccgggtggtgtgtgccatgatcaacagcaatgatgacaatggagtgctgaatggaaactggagcgagaactacacagatggagccaacccagctgagtggacaggctctgtggccatcctgaagcagtggaatgccaccggctgccagcctgtgcgctatggccagtgctgggtgtttgctgctgtgatgtgcaccgtgatgcgctgcctgggcatccccaccagggtcatcaccaactttgacagcggccatgacacagatggcaacctgatcattgatgagtactatgacaacacaggccgcatcctgggcaacaagaagaaggacaccatctggaacttccacgtgtggaatgaatgctggatggccaggaaggacctgcccccagcctatggaggctggcaggtgctggatgccaccccccaggagatgagcaatggagtgtactgctgcggccctgcctctgtgcgggccatcaaggagggggaggtggacctgaactatgacaccccatttgtgttctccatggtgaatgctgactgcatgtcctggctggtgcagggcggcaaggagcagaagctgcaccaggacaccagctctgtgggcaacttcatcagcaccaagagcatccagagtgatgaaagagatgacatcacagagaactacaagtatgaggagggcagcctgcaggagcggcaggtgttcctgaaggccctgcagaagctgaaggcccggagcttccacggcagccagagaggagctgagctgcagcccagccggcccaccagcctgagccaggacagccccaggagcctgcacacccccagcctgcggcccagtgatgtggtgcaggtgtccctgaagttcaagctgctggacccccccaacatgggccaggacatctgctttgtgctgctggccctgaacatgagcagccagttcaaggacctgaaggtgaacctgagcgcccagagcctgctgcatgatggcagccccctgagccccttctggcaggacacagccttcatcaccctgagccccaaggaggccaagacctacccctgcaagatctcctacagccagtacagccagtacctgagcacagacaagctgatccgcatcagcgccctgggggaggagaagagcagccctgagaagatcctggtgaacaagatcatcaccctgagctaccccagcatcaccatcaacgtgctgggcgctgctgtggtgaaccagcccctgagcatccaggtgatcttcagcaaccccctgtctgagcaggtggaggactgtgtgctgactgtggagggcagcggcctcttcaagaagcagcagaaggtgttcctgggcgtgctgaagccccagcaccaggccagcatcatcctggagaccgtgcccttcaagagcggccagaggcagatccaggccaacatgaggagcaacaagttcaaggacatcaagggctacagaaatgtgtatgtggactttgccctgtag

SEQ ID NO: 173770 - DNA, 2160 bp, Artificial Sequence
  Description of Artificial Sequence: Synthetic coding sequence
gcccagggcctggaggtggccctgacagacctgcagagcagcagaaataatgtgcgccaccacacagaggagatcaccgtggaccacctgctggtgagaagaggccaggccttcaacctgaccctgtacttcaggaacagaagcttccagcccggcctggacaacatcatctttgtggtggagaccggccccctgcctgacctggccctgggcaccagggctgtgttcagcctggcccggcaccacagccccagcccctggatcgcctggctggagaccaacggggccaccagcacagaggtgtccctgtgtgccccacccacagctgctgtgggccgctacctgctgaagatccacatcgacagcttccagggctctgtgacagcctaccagctgggggagttcatcctgctcttcaacccctggtgcccagaagatgctgtgtacctggacagcgagccccagaggcaggagtatgtgatgaatgactatggcttcatctaccagggcagcaagaactggatccggccctgcccctggaactacggccagtttgaggacaagatcatcgacatctgcctgaagctgctggacaagagcctgcacttccagacagatcctgccacagactgtgccctgcggggcagccctgtgtatgtgtcccgggtggtgtgtgccatgatcaacagcaatgatgacaacggggtgctgaatggaaactggagcgagaactacacagatggagccaacccagctgagtggacaggctctgtggccatcctgaagcagtggaatgccaccggctgccagcctgtgcgctatggccagtgctgggtgtttgctgctgtgatgtgcaccgtgatgcgctgcctgggcatccccaccagggtcatcaccaactttgattctggccatgacacagatggcaacctgatcattgatgagtactatgacaacacaggccgcatcctgggcaacaagaagaaggacaccatctggaacttccacgtgtggaatgaatgctggatggccaggaaggacctgcccccagcctacggcggctggcaggtgctggatgccaccccccaggagatgagcaatggagtgtactgctgcggccctgcctctgtgcgggccatcaaggagggggaggtggacctgaactatgacaccccatttgtgttctccatggtgaatgctgactgcatgtcctggctggtgcagggcggcaaggagcagaagctgcaccaggacaccagctctgtgggcaacttcatcagcaccaagagcatccagagtgatgaaagagatgacatcacagagaactacaagtatgaggagggcagcctgcaggagcggcaggtgttcctgaaggccctgcagaagctgaaggcccgctccttccacggcagccagagaggagctgagctgcagcccagccggcccaccagcctgagccaggacagccccaggagcctgcacacccccagcctgcggcccagtgatgtggtgcaggtgtccctgaagttcaagctgctggacccccccaacatgggccaggacatctgctttgtgctgctggccctgaacatgagcagccagttcaaggacctgaaggtgaacctgagcgcccagagcctgctgcatgatggcagccccctgagccccttctggcaggacacagccttcatcaccctgagccccaaggaggccaagacctacccctgcaagatctcctacagccagtacagccagtacctgagcacagacaagctgatccgcatcagcgccctgggggaggagaagagcagccctgagaagatcctggtgaacaagatcatcaccctgagctaccccagcatcaccatcaacgtgctgggcgctgctgtggtgaaccagcccctgagcatccaggtgatcttcagcaaccccctgtctgagcaggtggaggactgtgtgctgactgtggagggcagcggcctcttcaagaagcagcagaaggtgttcctgggcgtgctgaagccccagcaccaggccagcatcatcctggagaccgtgcccttcaagagcggccagaggcagatccaggccaacatgaggagcaacaagttcaaggacatcaagggctacagaaatgtgtatgtggactttgccctgtag

SEQ ID NO: 173771 - DNA, 2121 bp, Artificial Sequence
  Description of Artificial Sequence: Synthetic coding sequence
atggccggcatccgggtgaccaaggtggactggcagaggagcagaaatggagctgcccaccacacccaggagtacccctgcccagagctggtggtgagaagaggccagagcttcagcctgaccctggagctgagccgggccctggactgtgaggagatcctgatcttcaccatggagaccggcccccgggccagcgaggccctgcacaccaaggctgtgttccagaccagcgagctggagcggggggagggctggacagctgcccgggaggcccagatggagaagaccctgactgtgtccctggccagcccccccagcgctgtgattggccgctacctgctgagcatccggctgagcagccacaggaagcacagcaacagaaggctgggggagtttgtgctgctcttcaacccctggtgtgccgaggatgatgtgttcctggccagcgaggaggagcggcaggagtatgtgctgagtgacagcggcatcatcttccggggcgtggagaagcacatccgggcccagggctggaactacggccagtttgaggaggacatcctgaacatctgcctgagcatcctggacaggagccctggccaccagaacaacccagccacagatgtgtcctgccgccacaaccccatctacgtgaccagggtcatcagcgccatggtgaacagcaacaatgaccggggcgtggtgcagggccagtggcagggcaagtatggaggcggcaccagccccctgcactggaggggctctgtggccatcctgcagaagtggctgaagggccgctacaagcctgtgaagtatggccagtgctgggtgtttgctggggtgctgtgcaccgtgctgcgctgcctgggcatcgccaccagggtggtgagcaacttcaacagcgcccatgacacagaccagaacctgtctgtggacaagtatgtggacagctttggaagaaccctggaggacctgacagaggacagcatgtggaacttccacgtgtggaatgaatcctggtttgcccggcaggacctgggccccagctacaacggctggcaggtgctggatgccaccccccaggaggagagcgagggcgtcttccgctgtggccctgcctctgtgacagccatccgggagggagatgtgcacctggcccatgatggcccctttgtgtttgctgaggtgaatgctgactacatcacctggctgtggcatgaagatgagagccgggagcgggtgtacagcaacaccaagaagattggccgctgcatcagcaccaaggctgtgggcagtgacagccgggtggacatcacagacctgtacaagtacccagagggcagcaggaaggagcggcaggtgtacagcaaggctgtgaacagactctttggagtggaggccagcggccgccgcatctggatccggcgggccggcggccgctgcctgtggagagatgacctgctggagcccgccaccaagcccagcattgctgggaagttcaaggtgctggagccccccatgctgggccatgacctgcggctggccctgtgcctggccaacctgaccagccgggcccagagggtgcgggtgaacctgagcggggccaccatcctgtacaccaggaagcctgtggccgagatcctgcacgagagccatgctgtgcggctgggcccccaggaggagaagaggatccccatcaccatctcctacagcaagtacaaggaggacctgacagaggacaagaagatcctgctggccgccatgtgcctggtgaccaagggggagaagctgctggtggagaaggacatcaccctggaggacttcatcaccatcaaggtgctgggccctgccatggtgggcgtggccgtgacagtggaggtgacagtggtgaaccccctgattgagcgggtgaaggactgtgccctgatggtggagggcagcggcctgctgcaggagcagctgagcattgatgtgcccaccctggagccccaggagcgggcctctgtgcagtttgacatcacccccagcaagagcggcccccggcagctgcaggtggacctggtgagcccccacttcccagacatcaagggctttgtgattgtgcacgtggccacagccaagtag

SEQ ID NO: 173772 - DNA, 1878 bp, Artificial Sequence
  Description of Artificial Sequence: Synthetic coding sequence
atggccggcatccgggtgaccaaggtggactggcagaggagcagaaatggagctgcccaccacacccaggagtacccctgcccagagctggtggtgagaagaggccagagcttcagcctgaccctggagctgagccgggccctggactgtgaggagatcctgatcttcaccatggagaccggcccccgggccagcgaggccctgcacaccaaggctgtgttccagaccagcgagctggagcggggggagggctggacagctgcccgggaggcccagatggagaagaccctgactgtgtccctggccagcccccccagcgctgtgattggccgctacctgctgagcatccggctgagcagccacaggaagcacagcaacagaaggctgggggagtttgtgctgctcttcaacccctggtgtgccgaggatgatgtgttcctggccagcgaggaggagcggcaggagtatgtgctgagtgacagcggcatcatcttccggggcgtggagaagcacatccgggcccagggctggaactacggccagtttgaggaggacatcctgaacatctgcctgagcatcctggacaggagccctggccaccagaacaacccagccacagatgtgtcctgccgccacaaccccatctacgtgaccagggtcatcagcgccatggtgaacagcaacaatgaccggggcgtggtgcagggccagtggcagggcaagtatggaggcggcaccagccccctgcactggaggggctctgtggccatcctgcagaagtggctgaagggccgctacaagcctgtgaagtatggccagtgctgggtgtttgctggggtgctgtgcaccgtgctgcgctgcctgggcatcgccaccagggtggtgagcaacttcaacagcgcccatgacacagaccagaacctgtctgtggacaagtatgtggacagctttggaagaaccctggaggacctgacagaggacagcatgtggaacttccacgtgtggaatgaatcctggtttgcccggcaggacctgggccccagctacaacggctggcaggtgctggatgccaccccccaggaggagagcgagggcgtcttccgctgtggccctgcctctgtgacagccatccgggagggagatgtgcacctggcccatgatggcccctttgtgtttgctgaggtgaatgctgactacatcacctggctgtggcatgaagatgagagccgggagcgggtgtacagcaacaccaagaagattggccgctgcatcagcaccaaggctgtgggcagtgacagccgggtggacatcacagacctgtacaagtacccagagggcagcaggaaggagcggcaggtgtacagcaaggctgtgaacagactctttggagtggaggccagcggccgccgcatctggatccggcgggccggcggccgctgcctgtggagagatgacctgctggagcccgccaccaagcccagcattgctgggaagttcaaggtgctggagccccccatgctgggccatgacctgcggctggccctgtgcctggccaacctgaccagccgggcccagagggtgcgggtgaacctgagcggggccaccatcctgtacaccaggaagcctgtggccgagatcctgcacgagagccatgctgtgcggctgggcccccaggaggagaagaggatccccatcaccatctcctacagcaagtacaaggaggacctgacagaggacaagaagatcctgctggccgccatgtgcctggtgaccaagggggagaagctgctggtggagaaggacatcaccctggaggacttcatcaccatcaagagggcctacccaggggccagcggggagggcctgagccctgtgtag

SEQ ID NO: 173773 - DNA, 2133 bp, Artificial Sequence
  Description of Artificial Sequence: Synthetic coding sequence
atggaccaggtggccaccctgcggctggagagcgtggacctgcagagcagcaggaacaacaaggagcaccacacccaggagatgggcgtgaagaggctgactgtgcggcggggccagcccttctacctgcggctgtccttcagccggcccttccagagccagaatgaccacatcacctttgtggccgagaccggccccaagcccagcgagctgctgggcacccgggccaccttcttcctgaccagggtgcagcctggaaatgtgtggagcgccagtgacttcaccatcgacagcaacagcctgcaggtgtccctcttcaccccagccaatgctgtgattggccactacaccctgaagattgagatcagccagggccagggccacagcgtgacctaccccctgggcaccttcatcctgctcttcaacccctggagcccagaagatgatgtgtacctgcccagcgagatcctgctgcaggagtacatcatgagggactatggctttgtgtacaagggccacgagcgcttcatcacctcctggccctggaactacggccagtttgaggaggacatcatcgacatctgctttgagatcctgaacaagagcctgtaccacctgaagaacccagccaaggactgcagccagagaaatgatgtggtgtatgtgtgccgggtggtgtctgccatgatcaacagcaatgatgacaacggggtgctgcagggcaactggggcgaggactacagcaaaggagtgagccccctggagtggaagggctctgtggccatcctgcagcagtggagcgcccggggcggccagcctgtgaagtatggccagtgctgggtgtttgcctctgtgatgtgcaccgtgatgcgctgcctgggcgtgcccaccagggtggtgagcaacttccgcagcgcccacaacgtggacaggaacctgaccatcgacacctactatgacagaaatgctgagatgctgagcacccagaagagggacaagatctggaacttccacgtgtggaatgaatgctggatgatcaggaaggacctgcccccaggctacaacggctggcaggtgctggaccccaccccccagcagaccagcagcggcctcttctgctgcggccctgcctctgtgaaggccatccgggagggagatgtgcacctggcctatgacaccccatttgtgtatgcagaggtgaatgctgatgaagtcatctggctgctgggagatggccaggcccaggagatcctggcccacaacaccagcagcatcggcaaggagatcagcaccaagatggtgggcagtgaccagaggcagagcatcaccagcagctacaagtacccagagggcagccctgaggagagagctgtgttcatgaaggccagcaggaagatgctgggcccccagagggccagcctgcccttcctggacctgctggagagcggcggcctgcgggaccagcctgcccagctgcagctgcacctggcccgcatccctgagtggggccaggacctgcagctgctgctgcgcatccagagggtgcctgacagcacccacccccggggccccatcggcctggtggtgcgcttctgtgcccaggccctgctgcacggcggcggcacccagaagcccttctggaggcacacagtgaggatgaacctggactttgggaaggagacccagtggcccctgctgctgccctacagcaactacagaaacaagctgacagatgagaagctgatccgggtgtctggaattgctgaggtggaggagaccggccgctccatgctggtgctgaaggacatctgcctggagcccccccacctgagcattgaggtgtctgagcgggcagaggtgggcaaggccctgcgggtgcacgtgaccctgaccaacaccctgatggtggccctgagcagctgcaccatggtgctggagggcagcggcctcatcaatggccagatcgccaaggacctgggcaccctggtggccggccacaccctgcagatccagctggacctgtaccccaccaaggccggcccccggcagctgcaggtgctgatcagcagcaatgaggtgaaggagatcaagggctacaaggacatctttgtgacagtggccggggccccctag

SEQ ID NO: 173774 - DNA, 846 bp, Artificial Sequence
  Description of Artificial Sequence: Synthetic coding sequence
atgagatttgtggtggccctggtgctgctgaatgtggccgctgctggagctgtgcccctgctggccacagaatctgtgaagcaggaggaggccggcgtgcggcccagcgctggaaatgtgtccacccaccccagcctgagccagaggcctgggggcagcaccaagagccaccctgagccccagacccccaaggacagccccagcaagagcagcagcgaggcccagaccaccaaggatgtgcccaacaagagcggggctgatggccagacccccaaggatggcagcagcaagagcggggctgaggaccagacccccaaggatgtgcccaacaagagcggggctgagaagcagacccccaaggatggcagcaacaagagcggggctgaggagcagggccccattgatggccccagcaagagcggggctgaggagcagaccagcaaggacagccccaacaaggaggaggtgaagagcagcgagcccacagaagatgtggagcccaaggaggctgaagatgatgacaccggccctgaggagggcagcccccccaaggaggagaaggagaagatgagcggcagcgccagcagtgaaaatcgggagggcaccctgagtgacagcactggaagtgagaaggatgacctgtacccaaatggaagtggaaatggatctgctgagagcagccacttctttgcctacctggtgacagctgccatcctggtggccgtgctgtacatcgcccaccacaacaagaggaagatcatcgcctttgtgctggagggcaagaggagcaaggtgacccggcggcccaaggccagtgactaccagaggctggaccagaagagctag

SEQ ID NO: 173775 - DNA, 1314 bp, Artificial Sequence
  Description of Artificial Sequence: Synthetic coding sequence
atgagatttgtggtggccctggtgctgctgaatgtggccgctgctggagctgtgcccctgctggccacagaatctgtgaagcaggaggaggccggcgtgcggcccagcgctggaaatgtgtccacccaccccagcctgagccagaggcctgggggcagcaccaagagccaccctgagccccagacccccaaggacagccccagcaagagcagcgctgaggcccagaccccagaggacacccccaacaagagcggggctgaggccaagacccagaaggacagcagcaacaagagcggggctgaggccaagacccagaagggcagcaccagcaagagcggcagcgaggcccagaccaccaaggacagcaccagcaagagccaccctgagctgcagacccccaaggacagcacaggcaagagcggggctgaggcccagaccccagaggacagccccaacagaagtggagctgaggccaagacccagaaggacagccccagcaagagcggcagcgaggcccagaccaccaaggatgtgcccaacaagagcggggctgatggccagacccccaaggatggcagcagcaagagcggggctgaggaccagacccccaaggatgtgcccaacaagagcggggctgagaagcagacccccaaggatggcagcaacaagagcggggctgaggagcagggccccattgatggccccagcaagagcggggctgaggagcagaccagcaaggacagccccaacaaggtggtgcctgagcagcccagcaggaaggaccacagcaagcccatcagcaaccccagcgacaacaaggagctgcccaaggctgacaccaaccagctggccgacaagggcaagctgagcccccacgccttcaagacagagagcggggaggagacagacctgatcagccccccccaggaggaggtgaagagcagcgagcccacagaagatgtggagcccaaggaggctgaagatgatgacaccggccctgaggagggcagcccccccaaggaggagaaggagaagatgagcggcagcgccagcagtgaaaatcgggagggcaccctgagtgacagcactggaagtgagaaggatgacctgtacccaaatggaagtggaaatggatctgctgagagcagccacttctttgcctacctggtgacagctgccatcctggtggccgtgctgtacatcgcccaccacaacaagaggaagatcatcgcctttgtgctggagggcaagaggagcaaggtgacccggcggcccaaggccagtgactaccagaggctggaccagaagagctag

SEQ ID NO: 173776 - DNA, 1140 bp, Artificial Sequence
  Description of Artificial Sequence: Synthetic coding sequence
atgagatttgtggtggccctggtgctgctgaatgtggccgctgctggagctgtgcccctgctggccacagaatctgtgaagcaggaggaggccggcgtgcggcccagcgctggaaatgtgtccacccaccccagcctgagccagaggcctgggggcagcaccaagagccaccctgagccccagacccccaaggacagccccagcaagagcagcgctgaggcccagaccccagaggacacccccaacaagagcggggctgaggccaagacccagaaggacagcagcaacaagagcggggctgaggccaagacccagaagggcagcaccagcaagagcggcagcgaggcccagaccaccaaggacagcaccagcaagagccaccctgagctgcagacccccaaggacagcacaggcaagagcggggctgaggcccagaccccagaggacagccccaacagaagtggagctgaggccaagacccagaaggacagccccagcaagagcggcagcgaggcccagaccaccaaggatgtgcccaacaagagcggggctgatggccagacccccaaggatggcagcagcaagagcggggctgaggaccagacccccaaggatgtgcccaacaagagcggggctgagaagcagacccccaaggatggcagcaacaagagcggggctgaggagcagggccccattgatggccccagcaagagcggggctgaggagcagaccagcaaggacagccccaacaaggaggaggtgaagagcagcgagcccacagaagatgtggagcccaaggaggctgaagatgatgacaccggccctgaggagggcagcccccccaaggaggagaaggagaagatgagcggcagcgccagcagtgaaaatcgggagggcaccctgagtgacagcactggaagtgagaaggatgacctgtacccaaatggaagtggaaatggatctgctgagagcagccacttctttgcctacctggtgacagctgccatcctggtggccgtgctgtacatcgcccaccacaacaagaggaagatcatcgcctttgtgctggagggcaagaggagcaaggtgacccggcggcccaaggccagtgactaccagaggctggaccagaagagctag

SEQ ID NO: 173777 - DNA, 1362 bp, Artificial Sequence
  Description of Artificial Sequence: Synthetic coding sequence
atgagatttgtggtggccctggtgctgctgaatgtggccgctgctggagctgtgcccctgctggccacagaatctgtgaagcaggaggaggccggcgtgcggcccagcgctggaaatgtgtccacccaccccagcctgagccagaggcctgggggcagcaccaagagccaccctgagccccagacccccaaggacagccccagcaagagcagcgctgaggcccagaccccagaggacacccccaacaagagcggggctgaggccaagacccagaaggacagcagcaacaagagcggggctgaggccaagacccagaagggcagcaccagcaagagcggcagcgaggcccagaccaccaaggacagcaccagcaagagccaccctgagctgcagacccccaaggacagcacaggcaagagcggggctgaggcccagaccccagaggacagccccaacagaagtggagctgaggccaagacccagaaggacagccccagcaagagcggcagcgaggcccagaccaccaaggatgtgcccaacaagagcggggctgatggccagacccccaaggatggcagcagcaagagcggggctgaggaccagacccccaaggatgtgcccaacaagagcggggctgagaagcagacccccaaggatggcagcaacaagagcggggctgaggagcagggccccattgatggccccagcaagagcggggctgaggagcagaccagcaaggacagccccaacaaggtggtgcctgagcagcccagcaggaaggaccacagcaagcccatcagcaaccccagcgacaacaaggagctgcccaaggctgacaccaaccagctggccgacaagggcaagctgagcccccacgccttcaagacagagagcggggaggagacagacctgatcagccccccccaggaggaggtgaagagcagcgagcccacagaagatgtggagcccaaggaggctgaagatgatgacaccggccctgaggagggcagcccccccaaggaggagaaggagaagatgagcggcagcgccagcagtgaaaatcgggagggcaccctgagtgacagcactggaagtgagaaggatgacctgtacccaaatggaagtggaaatggatctgctgagagcagccacttctttgcctacctggtgacagctgccatcctggtggccgtgctgtacatcgcccaccacaacaagaggaagatcatcgcctttgtgctggagggcaagaggagcaaggtgacccggcggcccaaggccagtgactaccagaggctggaccagaagatcttcttccccctgagccccaacaggatggtgtacagcagcggcaagaggtag

SEQ ID NO: 173778 - DNA, 693 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacaccagaattggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggctag

SEQ ID NO: 173779 - DNA, 2520 bp, Artificial Sequence
  Description of Artificial Sequence: Synthetic coding sequence
atgaagaagtggagcagcacagacctgggcgctgctgctgaccccctgcagaaggacacctgcccagaccccctggatggagaccccaacagcaggcctcctccagccaagccccagctgagcacagccaagagcaggacccggctgtttgggaagggggacagcgaggaggccttccctgtggactgcccccatgaggagggggagctggacagctgccccaccatcaccgtgtcccctgtgatcaccatccagaggcctggagatggccccaccggggcccggctgctgagccaggacagcgtggccgccagcacagagaagaccctgcggctgtatgacagaagaagcatctttgaagctgtggcccagaacaactgccaggacctggagagcctgctgctcttcctgcagaagagcaagaagcacctgacagacaatgagttcaaggaccctgagaccgggaagacctgcctgctgaaggccatgctgaacctgcatgatggccagaacaccaccatccccctgctgctggagatcgcccggcagacagacagcctgaaggagctggtgaatgccagctacacagacagctactacaagggccagacagccctgcacatcgccatcgagaggaggaacatggccctggtgaccctgctggtggagaatggagcagatgtgcaggccgccgcccatggagacttcttcaagaagaccaagggccggcccggcttctactttggagagctgcccctgagcctggccgcctgcaccaaccagctgggcatcgtgaagttcctgctgcagaacagctggcagacagctgacatcagcgcccgggacagcgtgggcaacacagtgctgcacgccctggtggaggtggccgacaacacagctgacaacaccaagtttgtgacctccatgtacaatgagatcctgatgctgggcgccaagctgcaccccaccctgaagctggaggagctgaccaacaagaagggcatgacccccctggccctggccgccggcaccgggaagattggagtgctggcctacatcctgcagcgggagatccaggagcctgagtgccgccacctgagcaggaagttcacagagtgggcctacggccctgtgcacagcagcctgtatgacctgagctgcatcgacacctgtgagaagaacagcgtgctggaggtgattgcctacagcagcagcgagacccccaacagacatgacatgctgctggtggagcccctgaaccggctgctgcaggacaagtgggacagatttgtgaagaggatcttctacttcaacttcctggtgtactgcctgtacatgatcatcttcaccatggccgcctactacagacctgtggatggcctgccccccttcaagatggagaagacaggagactacttccgggtgactggagagatcctgtctgtgctgggcggcgtgtacttcttcttccggggcatccagtacttcctgcagaggcggcccagcatgaagaccctgtttgtggacagctacagcgagatgctgttcttcctgcagagcctcttcatgctggccaccgtggtgctgtacttcagccacctgaaggagtatgtggcctccatggtgttcagcctggccctgggctggaccaacatgctgtactacacccggggcttccagcagatgggcatctatgctgtgatgattgagaagatgatcctgcgggacctgtgccgcttcatgtttgtgtacatcgtgttcctgtttggcttcagcacagctgtggtgaccctgattgaagatggcaagaatgacagcctgcccagcgagagcaccagccaccgctggaggggccctgcctgccggcccccagacagcagctacaacagcctgtacagcacctgcctggagctgttcaagttcaccatcggcatgggagacctggagttcacagagaactatgacttcaaggctgtgttcatcatcctgctgctggcctacgtgatcctgacctacatcctgctgctgaacatgctgattgccctgatgggagagaccgtgaacaagatcgcccaggagagcaagaacatctggaagctgcagagggccatcaccatcctggacacagagaagagcttcctgaagtgcatgaggaaggccttccgcagcggcaagctgctgcaggtgggctacaccccagatggcaaggatgactaccgctggtgcttccgggtggatgaggtgaactggaccacctggaacaccaacgtgggcatcatcaatgaagaccccggcaactgtgaaggagtgaagaggaccctgtccttcagcctgcggagcagccgggtgtctggccgccactggaagaactttgccctggtgcccctgctgcgggaggccagcgcccgggaccggcagagcgcccagcctgaggaggtgtacctgcggcagttcagcggcagcctgaagccagaagatgctgaggtgttcaagagccctgctgccagcggggagaagtag

SEQ ID NO: 173780 - DNA, 2373 bp, Artificial Sequence
  Description of Artificial Sequence: Synthetic coding sequence
atgaaggcccaccccaaggagatggtgcccctgatgggcaagagggtggccgcccccagcggcaacccagccatcctgcctgagaagaggcctgctgagatcacccccaccaagaagagcgcccacttcttcctggagattgagggctttgagcccaaccccaccgtggccaagaccagcccccctgtgttcagcaagcccatggacagcaacatccggcagtgcatcagcggcaactgtgatgacatggacagcccccagagcccccaggatgatgtgacagagacccccagcaaccccaacagccccagcgcccagctggccaaggaggagcagaggaggaagaagaggcggctgaagaagaggatctttgctgctgtgtctgagggctgtgtggaggagctggtggagctgctggtggagctgcaggagctgtgcagaagaagacatgatgaagatgtgcctgacttcctgatgcacaagctgacagccagtgacaccgggaagacctgcctgatgaaggccctgctgaacatcaaccccaacaccaaggagatcgtgcgcatcctgctggcctttgctgaggagaatgacatcctgggccgcttcatcaatgctgagtacacagaggaggcctatgagggccagacagccctgaacatcgccattgaaagacggcagggcgacattgctgccctgctgattgctgctggagcagatgtgaatgcccacgccaagggggccttcttcaaccccaagtaccagcacgagggcttctactttggagagacccccctggccctggccgcctgcaccaaccagcctgagatcgtgcagctgctgatggagcacgagcagacagacatcaccagccgggacagccggggcaacaacatcctgcacgccctggtgacagtggccgaggacttcaagacccagaatgactttgtgaagaggatgtatgacatgatcctgctgcggagcggcaactgggagctggagaccaccagaaataatgatggcctgacccccctgcagctggccgccaagatgggcaaggccgagatcctgaagtacatcctgagccgggagatcaaggagaagaggctgcggagcctgagcaggaagttcacagactgggcctacggccctgtgagcagcagcctgtatgacctgaccaacgtggacaccaccacagacaacagcgtgctggagatcaccgtgtacaacaccaacatcgacaacagacatgagatgctgaccctggagcccctgcacaccctgctgcacatgaagtggaagaagtttgccaagcacatgttcttcctgtccttctgcttctacttcttctacaacatcaccctgaccctggtgtcctactaccggccccgggaggaggaggccatcccccaccccctggccctgacccacaagatgggctggctgcagctgctgggccgcatgtttgtgctgatctgggccatgtgcatctctgtgaaggagggcatcgccatcttcctgctgcggcccagcgacctgcagagcatcctgagtgatgcctggttccactttgtgttcttcatccaggccgtgctggtgatcctgagcgtcttcctgtacctgtttgcctacaaggagtacctggcctgcctggtgctggccatggccctgggctgggccaacatgctgtactacacccggggcttccagagcatgggcatgtacagcgtgatgatccagaaggtgatcctgcatgatgtgctgaagttcctgtttgtgtacatcgtgttcctgctgggctttggagtggccctggccagcctgattgaaaaatgtcccaaggacaacaaggactgcagcagctatggcagcttcagtgatgctgtgctggagctgttcaagctgaccatcggcctgggggacctgaacatccagcagaacagcaagtaccccatcctcttcctgttcctgctgatcacctacgtgatcctgacctttgtgctgctgctgaacatgctgattgccctgatgggagagaccgtggagaatgtgtccaaggagagcgagcgcatctggaggctgcagagggcccggaccatcctggagtttgagaagatgctgcctgagtggctgcggagccgcttcaggatgggagagctgtgcaaggtggctgaagatgacttccggctgtgcctgcgcatcaatgaggtgaagtggacagagtggaagacccacgtgtccttcctgaatgaagatcctggccctgtgagaagaacagacttcaacaagatccaggacagcagcaggaacaacagcaagaccaccctgaatgcctttgaggaggtggaggagttccctgagacctctgtgtag

SEQ ID NO: 173781 - DNA, 3360 bp, Artificial Sequence
  Description of Artificial Sequence: Synthetic coding sequence
atgaagaggagcctgaggaagatgtggaggcctggagagaagaaggagccccagggcgtggtgtatgaagatgtgcctgatgacacagaggacttcaaggagagcctgaaggtggtgtttgagggcagcgcctacggcctgcagaacttcaacaagcagaagaagctgaagagatgtgatgacatggacaccttcttcctgcactacgccgctgctgagggccagatcgagctgatggagaagatcacccgggacagcagcctggaggtgctgcacgagatggatgattatggcaacacccccctgcactgtgctgtggagaagaaccagattgaatctgtgaagttcctgctgagcagaggagccaaccccaacctgaggaacttcaacatgatggcccccctgcacatcgctgtgcagggcatgaacaatgaggtgatgaaggtgctgctggagcacaggaccattgatgtgaacctggagggagaaaatggaaacacagctgtgatcatcgcctgcaccaccaacaacagcgaggccctgcagatcctgctgaagaagggggccaagccctgcaagagcaacaagtggggctgcttccccatccaccaggccgccttcagcggcagcaaggagtgcatggagatcatcctgcgctttggagaggagcacggctacagccggcagctgcacatcaacttcatgaacaacgggaaggccacccccctgcacctggccgtgcagaatggagacctggagatgatcaagatgtgcctggacaatggagcccagattgatcctgtggagaagggccgctgcacagccatccactttgctgccacccagggcgccacagaaattgtgaagctgatgatcagcagctacagcggctctgtggacatcgtgaacaccacagatggctgccacgagaccatgctgcaccgggccagcctgtttgaccaccacgagctggccgactacctgatctctgtgggcgctgacatcaacaagattgacagcgagggccgcagccccctcatcctggccacagccagcgcctcctggaacatcgtgaacctgctgctgagcaagggggcccaggtggacatcaaggacaactttggaagaaacttcctgcacctgactgtgcagcagccctacggcctgaagaacctgcggcctgagttcatgcagatgcagcagatcaaggagctggtgatggatgaagataatgatggctgcacccccctgcactacgcctgccggcagggcggccctggctctgtgaacaacctgctgggcttcaacgtgtccatccacagcaagagcaaggacaagaagagccccctgcactttgctgccagctatggccgcatcaacacctgccagaggctgctgcaggacatcagtgacacccggctgctgaatgaaggagacctgcacggcatgacccccctgcacctggccgccaagaatggacatgacaaggtggtgcagctgctgctgaagaagggggccctcttcctgagtgaccacaacggctggacagccctgcaccacgcctccatgggcggctacacccagaccatgaaggtgatcctggacaccaacctgaagtgcacagaccggctggatgaagatggcaacacagccctgcactttgctgcccgggagggccacgccaaggctgtggccctgctgctgagccacaatgctgacatcgtgctgaacaagcagcaggccagcttcctgcacctggccctgcacaacaagaggaaggaggtggtgctgaccatcatccgcagcaagcgctgggatgaatgtctgaagatcttcagccacaacagccctggcaacaagtgccccatcacagagatgattgagtacctgcctgagtgcatgaaggtgctgctggacttctgcatgctgcacagcacagaggacaagagctgccgggactactacatcgagtacaacttcaagtacctgcagtgccccctggagttcaccaagaagacccccacccaggatgtgatctatgagcccctgacagccctgaatgccatggtgcagaacaacagaattgagctgctgaaccaccctgtgtgcaaggagtacctgctgatgaagtggctggcctacggcttccgggcccacatgatgaacctgggcagctactgcctgggcctcatccccatgaccatcctggtggtgaacatcaagccaggcatggccttcaacagcacaggcatcatcaatgagaccagtgaccacagcgagatcctggacaccaccaacagctacctgatcaagacctgcatgatcctggtgttcctgagcagcatcttcggctactgcaaggaggccggccagatcttccagcagaagaggaactacttcatggacatcagcaatgtgctggagtggatcatctacaccaccggcatcatctttgtgctgcccctgtttgtggagatcccagcccacctgcagtggcagtgtggggccatcgctgtgtacttctactggatgaacttcctgctgtacctgcagagatttgagaactgtggcatcttcatcgtgatgctggaggtgatcctgaagaccctgctgcggagcacagtggtgttcatcttcctgctgctggccttcggcctgtccttctacatcctgctgaacctgcaggaccccttcagcagccccctgctgagcatcatccagaccttctccatgatgctgggggacatcaactaccgggagagcttcctggagccctacctgagaaatgagctggcccaccctgtgctgagctttgcccagctggtgtccttcaccatctttgtgcccatcgtgctgatgaacctgctgattggcctggccgtgggggacattgctgaggtgcagaagcacgccagcctgaagagaattgccatgcaggtggagctgcacaccagcctggagaagaagctgcccctgtggttcctgaggaaggtggaccagaagagcaccatcgtgtaccccaacaagcccaggtctgggggcatgctgttccacatcttctgcttcctgttctgcaccggggagatccggcaggagatccccaatgctgacaagagcctggagatggagatcctgaagcagaagtaccgcctgaaggacctgaccttcctgctggagaagcagcacgagctgatcaagctgatcatccagaagatggagatcatcagcgagacagaagatgatgacagccactgcagcttccaggaccgcttcaagaaggagcagatggagcagaggaacagccgctggaacacagtgctgcgggctgtgaaggccaagacccaccacctggagccctag

SEQ ID NO: 173782 - DNA, 2280 bp, Artificial Sequence
  Description of Artificial Sequence: Synthetic coding sequence
atgatggccgccctgtaccccagcacagacctgagcggggccagcagcagcagcctgcccagcagccccagcagcagcagccccaatgaggtgatggccctgaaggatgtgcgggaggtgaaggaggagaacaccctgaatgagaagctgttcctgctggcctgtgacaagggggactactacatggtgaagaagatcctggaggagaacagcagcggggacctgaacatcaactgtgtggatgtgctgggcagaaatgctgtgaccatcaccattgaaaatgaaaacctggacatcctgcagctgctgctggactatggctgccagaagctgatggagcgcatccagaaccctgagtacagcaccaccatggatgtggcccctgtgatcctggccgcccacaggaacaactatgagatcctgaccatgctgctgaagcaggatgtgtccctgcccaagccccatgctgtgggctgtgagtgcaccctgtgcagcgccaagaacaagaaggacagcctgcggcacagccgcttccggctggacatctaccgctgcctggccagccctgccctgatcatgctgacagaggaggaccccatcctgcgggcctttgagctgtctgctgacctgaaggagctgagcctggtggaggtggagttcagaaatgactatgaggagctggcccggcagtgcaagatgtttgccaaggacctgctggcccaggccaggaacagccgggagctggaggtgatcctgaaccacaccagcagtgatgagcccctggacaagaggggcctgctggaggagaggatgaacctgagccggctgaagctggccatcaagtacaaccagaaggagtttgtgtcccagagcaactgccagcagttcctgaacacagtgtggtttggccagatgagcggctacagaaggaagcccacctgcaagaagatcatgacagtgctgactgtgggcatcttctggcctgtgctgagcctgtgctacctgattgcccccaagagccagtttggccgcatcatccacacccccttcatgaagttcatcatccacggggccagctacttcaccttcctgctgctgctgaacctgtacagcctggtgtacaatgaagacaagaagaacaccatgggccctgccctggagagaattgactacctgctgatcctgtggatcatcggcatgatctggagcgacatcaagaggctgtggtatgagggcctggaggacttcctggaggagagcaggaaccagctgagctttgtgatgaacagcctgtacctggccacctttgccctgaaggtggtggcccacaacaagttccatgactttgctgacaggaaggactgggatgccttccaccccaccctggtggccgagggcctgtttgcctttgccaacgtgctgagctacctgcggctcttcttcatgtacaccaccagcagcatcctgggccccctgcagatctccatgggccagatgctgcaggactttgggaagttcctgggcatgttcctgctggtgctcttctccttcaccatcggcctgacccagctgtatgacaagggctacaccagcaaggagcagaaggactgtgtgggcatcttctgtgagcagcagagcaatgacaccttccacagcttcatcggcacctgctttgccctcttctggtacatcttcagcctggcccacgtggccatctttgtgacccgcttctcctatggagaggagctgcagagctttgtgggcgctgtgattgtgggcacctacaacgtggtggtggtgattgtgctgaccaagctgctggtggccatgctgcacaagagcttccagctgattgccaaccacgaggacaaggagtggaagtttgcccgggccaagctgtggctgagctactttgatgacaagtgcaccctgcccccacccttcaacatcatccccagccccaagaccatctgctacatgatcagcagcctgagcaagtggatctgcagccacaccagcaagggcaaggtgaagaggcagaacagcctgaaggagtggaggaacctgaagcagaagagagatgagaactaccagaaggtgatgtgctgcctggtgcaccgctacctgacctccatgaggcagaagatgcagagcacagaccaggccaccgtggagaacctgaatgagctgcggcaggacctgagcaagttcagaaatgagatccgggacctgctgggcttccgcaccagcaaatatgccatgttctaccccaggaactag

SEQ ID NO: 173783 - DNA, 435 bp, Artificial Sequence
  Description of Artificial Sequence: Synthetic coding sequence
atgatctggagcgacatcaagaggctgtggtatgagggcctggaggacttcctggaggagagcaggaaccagctgagctttgtgatgaacagcctgtacctggccacctttgccctgaaggtggtggcccacaacaagatctccatgggccagatgctgcaggactttgggaagttcctgggcatgttcctgctggtgctcttctccttcaccatcggcctgacccagctgtatgacaagggctacaccagcaaggagcagaaggactgtgtgggcatcttctgtgagcagcagagcaatgacaccttccacagcttcatcggcacctgctttgccctcttctggtacatcttcagcctggcccacgtggccatctttgtgacccgcttctcctatggagaggagctgcagagctttgtgggcgccgtcatctag

SEQ ID NO: 173784 - DNA, 2382 bp, Artificial Sequence
  Description of Artificial Sequence: Synthetic coding sequence
atgatggccgccctgtaccccagcacagacctgagcggggccagcagcagcagcctgcccagcagccccagcagcagcagccccaatgaggtgatggccctgaaggatgtgcgggaggtgaaggaggagaacaccctgaatgagaagctgttcctgctggcctgtgacaagggggactactacatggtgaagaagatcctggaggagaacagcagcggggacctgaacatcaactgtgtggatgtgctgggcagaaatgctgtgaccatcaccattgaaaatgaaaacctggacatcctgcagctgctgctggactatggctgccagagcgcagatgccctgctggtggccatcgacagcgaggtggtgggcgctgtggacatcctgctgaaccaccggcccaagaggagcagccggcccaccatcgtgaagctgatggagcgcatccagaaccctgagtacagcaccaccatggatgtggcccctgtgatcctggccgcccacaggaacaactatgagatcctgaccatgctgctgaagcaggatgtgtccctgcccaagccccatgctgtgggctgtgagtgcaccctgtgcagcgccaagaacaagaaggacagcctgcggcacagccgcttccggctggacatctaccgctgcctggccagccctgccctgatcatgctgacagaggaggaccccatcctgcgggcctttgagctgtctgctgacctgaaggagctgagcctggtggaggtggagttcagaaatgactatgaggagctggcccggcagtgcaagatgtttgccaaggacctgctggcccaggccaggaacagccgggagctggaggtgatcctgaaccacaccagcagtgatgagcccctggacaagaggggcctgctggaggagaggatgaacctgagccggctgaagctggccatcaagtacaaccagaaggagtttgtgtcccagagcaactgccagcagttcctgaacacagtgtggtttggccagatgagcggctacagaaggaagcccacctgcaagaagatcatgacagtgctgactgtgggcatcttctggcctgtgctgagcctgtgctacctgattgcccccaagagccagtttggccgcatcatccacacccccttcatgaagttcatcatccacggggccagctacttcaccttcctgctgctgctgaacctgtacagcctggtgtacaatgaagacaagaagaacaccatgggccctgccctggagagaattgactacctgctgatcctgtggatcatcggcatgatctggagcgacatcaagaggctgtggtatgagggcctggaggacttcctggaggagagcaggaaccagctgagctttgtgatgaacagcctgtacctggccacctttgccctgaaggtggtggcccacaacaagttccatgactttgctgacaggaaggactgggatgccttccaccccaccctggtggccgagggcctgtttgcctttgccaacgtgctgagctacctgcggctcttcttcatgtacaccaccagcagcatcctgggccccctgcagatctccatgggccagatgctgcaggactttgggaagttcctgggcatgttcctgctggtgctcttctccttcaccatcggcctgacccagctgtatgacaagggctacaccagcaaggagcagaaggactgtgtgggcatcttctgtgagcagcagagcaatgacaccttccacagcttcatcggcacctgctttgccctcttctggtacatcttcagcctggcccacgtggccatctttgtgacccgcttctcctatggagaggagctgcagagctttgtgggcgctgtgattgtgggcacctacaacgtggtggtggtgattgtgctgaccaagctgctggtggccatgctgcacaagagcttccagctgattgccaaccacgaggacaaggagtggaagtttgcccgggccaagctgtggctgagctactttgatgacaagtgcaccctgcccccacccttcaacatcatccccagccccaagaccatctgctacatgatcagcagcctgagcaagtggatctgcagccacaccagcaagggcaaggtgaagaggcagaacagcctgaaggagtggaggaacctgaagcagaagagagatgagaactaccagaaggtgatgtgctgcctggtgcaccgctacctgacctccatgaggcagaagatgcagagcacagaccaggccaccgtggagaacctgaatgagctgcggcaggacctgagcaagttcagaaatgagatccgggacctgctgggcttccgcaccagcaaatatgccatgttctaccccaggaactag

SEQ ID NO: 173785 - DNA, 2415 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcagtttgtggcccagcccaactgccagcagctgctggccagccgctggtatgatgagttccctggctggaggcggcggcactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgctgaccacgccgacatcgagtggaagtttgcccggaccaagctgtggatgagctactttgaggagggcggcaccctgcccacccccttcaacgtcatccccagccccaagagcctgtggtacctgatcaagtggatctggacccacctgtgcaagaagaagatgaggaggaagccagagagctttggcaccatcggcagaagagctgctgacaacctgcggcggcaccaccagtaccaggaggtgatgaggaacctggtgaagcgctacgtggccgccatgatcagagatgccaagacagaggagggcctgacagaggagaacttcaaggagctgaagcaggacatcagcagcttccgctttgaggtgctgggcctgctgcggggcagcaagctgagcaccatccagagcgccaatgccagcaaggagagcagcaacagcgctgacagtgatgagaagagtgacagcgagggcaacagcaaggacaagaagaagaacttcagcctgtttgacctgaccaccctcatccaccccaggtctgctgccatcgccagcgagcggcacaacatcagcaatggcagcgccctggtggtgcaggagcccccccgggagaagcagaggaaggtgaactttgtgacagacatcaagaactttggcctcttccacagaagaagcaagcagaatgctgctgagcagaatgccaaccagatcttctctgtgtctgaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaagattatgtgaccacccggctgtag

SEQ ID NO: 173786 - DNA, 2511 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgctgaccatgctgacatcgagtggaagtttgcccggaccaagctgtggatgagctactttgaggagggcggcaccctgcccacccccttcaacgtcatccccagccccaagagcctgtggtacctgatcaagtggatctggacccacctgtgcaagaagaagatgaggaggaagccagagagctttggcaccatcggccggcgggctgctgacaacctgcggcggcaccaccagtaccaggaggtgatgaggaacctggtgaagagatatgtggccgccatgatcagagatgccaagacagaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaagattatgtgaccacccggctgtag

SEQ ID NO: 173787 - DNA, 2682 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgctgaccatgctgacatcgagtggaagtttgcccggaccaagctgtggatgagctactttgaggagggcggcaccctgcccacccccttcaacgtcatccccagccccaagagcctgtggtacctgatcaagtggatctggacccacctgtgcaagaagaagatgaggaggaagccagagagctttggcaccatcggccggcgggctgctgacaacctgcggcggcaccaccagtaccaggaggtgatgaggaacctggtgaagagatatgtggccgccatgatcagagatgccaagacagaggagggcctgacagaggagaacttcaaggagctgaagcaggacatcagcagcttccgctttgaggtgctgggcctgctgcggggcagcaagctgagcaccatccagagcgccaatgccagcaaggagagcagcaacagcgctgacagtgatgagaagagtgacagcgaggaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaggactatgtgaccacccggctgtag

SEQ ID NO: 173788 - DNA, 2487 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgccaggagagctgctgacaacctgcggcggcaccaccagtaccaggaggtgatgaggaacctggtgaagcgctacgtggccgccatgatcagagatgccaagacagaggagggcctgacagaggagaacttcaaggagctgaagcaggacatcagcagcttccgctttgaggtgctgggcctgctgcggggcagcaagctgagcaccatccagagcgccaatgccagcaaggagagcagcaacagcgctgacagtgatgagaagagtgacagcgaggaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaagattatgtgaccacccggctgtag

SEQ ID NO: 173789 - DNA, 2415 bp, Artificial Sequence; identical to SEQ ID NO: 173785
  Description of Artificial Sequence: Synthetic coding sequence

SEQ ID NO: 173790 - DNA, 2949 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgctgaccatgctgacatcgagtggaagtttgcccggaccaagctgtggatgagctactttgaggagggcggcaccctgcccacccccttcaacgtcatccccagccccaagagcctgtggtacctgatcaagtggatctggacccacctgtgcaagaagaagatgaggaggaagccagagagctttggcaccatcggcgtgaggacccagcacagaagagctgctgacaacctgcggcggcaccaccagtaccaggaggtgatgaggaacctggtgaagcgctacgtggccgccatgatcagagatgccaagacagaggagggcctgacagaggagaacttcaaggagctgaagcaggacatcagcagcttccgctttgaggtgctgggcctgctgcggggcagcaagctgagcaccatccagagcgccaatgccagcaaggagagcagcaacagcgctgacagtgatgagaagagtgacagcgagggcaacagcaaggacaagaagaagaacttcagcctgtttgacctgaccaccctcatccaccccaggtctgctgccatcgccagcgagcggcacaacatcagcaatggcagcgccctggtggtgcaggagcccccccgggagaagcagaggaaggtgaactttgtgacagacatcaagaactttggcctcttccacagaagaagcaagcagaatgctgctgagcagaatgccaaccagatcttctctgtgtctgaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaagattatgtgaccacccggctgtag

SEQ ID NO: 173791 - DNA, 2934 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaagtacagcgccctgaacccccgggagagctgggacatgtggcaccccaccctggtggccgaggccctgtttgccatcgccaacatcttcagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgaggagaccaagggcctgacctgcaagggcatccgctgtgagaagcagaacaatgccttcagcaccctgtttgagaccctgcagagcctcttctggagcatcttcggcctcatcaacctgtatgtgaccaacgtgaaggcccagcacgagttcacagaatttgtgggcgccaccatgtttggcacctacaacgtcatcagcctggtggtgctgctgaacatgctgattgccatgatgaacaacagctaccagctgattgctgaccatgctgacatcgagtggaagtttgcccggaccaagctgtggatgagctactttgaggagggcggcaccctgcccacccccttcaacgtcatccccagccccaagagcctgtggtacctgatcaagtggatctggacccacctgtgcaagaagaagatgaggaggaagccagagagctttggcaccatcggccggcgggctgctgacaacctgcggcggcaccaccagtaccaggaggtgatgaggaacctggtgaagagatatgtggccgccatgatcagagatgccaagacagaggagggcctgacagaggagaacttcaaggagctgaagcaggacatcagcagcttccgctttgaggtgctgggcctgctgcggggcagcaagctgagcaccatccagagcgccaatgccagcaaggagagcagcaacagcgctgacagtgatgagaagagtgacagcgagggcaacagcaaggacaagaagaagaacttcagcctgtttgacctgaccaccctcatccaccccaggtctgctgccatcgccagcgagcggcacaacatcagcaatggaagtgccctggtggtgcaggagcccccccgggagaagcagaggaaggtgaactttgtgacagacatcaagaactttggcctcttccaccggcgcagcaagcagaatgctgctgagcagaatgccaaccagatcttctctgtgtctgaggaggtggcccggcagcaggccgccggccccctggagaggaacatccagctggagagccggggcctggccagcagaggagacctgagcatccctggcctgtctgagcagtgtgtgctggtggaccaccgggagaggaacacagacaccctgggcctgcaggtgggcaagagggtgtgccccttcaagtctgagaaggtggtggtggaggacacagtgcccatcatccccaaggagaagcacgccaaggaggaggacagcagcattgattatgacctgaacctgcctgacacagtgacccatgaggactatgtgaccacccggctgtag

SEQ ID NO: 173792 - DNA, 1383 bp, Artificial Sequence
  Description of Artificial Sequence: Synthetic coding sequence
atggcccagttctactacaagagaaatgtgaatgccccctacagagaccgcatccccctgcgcatcgtgcgggcagagagcgagctgagccccagcgagaaggcctacctgaatgctgtggagaagggggactatgcctctgtgaagaagagcctggaggaggccgagatctacttcaagatcaacatcaactgcatcgaccccctgggccgcacagccctgctgattgccattgaaaatgaaaacctggagctgattgagctgctgctgtccttcaacgtgtatgtgggagatgccctgctgcacgccatcaggaaggaggtggtgggcgctgtggagctgctgctgaaccacaagaagcccagcggggagaagcaggtgccccccatcctgctggacaagcagttcagcgagttcaccccagacatcacccccatcatcctggccgcccacaccaacaactatgagatcatcaagctgctggtgcagaagggcgtgtctgtgccccggccccatgaggtgcgctgcaactgtgtggagtgtgtgagcagcagtgatgtggacagcctgcggcacagccgcagccggctgaacatctacaaggccctggccagccccagcctgattgccctgagcagcgaggaccccttcctgacagccttccagctgtcctgggagctgcaggagctgagcaaggtggagaatgagttcaagtcagaatatgaggagctgagccggcagtgcaagcagtttgccaaggacctgctggaccagaccaggagcagccgggagctggagatcatcctgaactacagagatgacaacagcctcatcgaggagcagagcggaaatgacctggcccggctgaagctggccatcaagtaccggcagaaggagtttgtggcccagcccaactgccagcagctgctggccagccgctggtatgatgagttccctggctggaggagaagacactgggccgtgaagatggtgacctgcttcatcatcggcctgctcttccctgtgttttctgtgtgctacctgattgcccccaagagccccctgggcctcttcatcaggaagcccttcatcaagttcatctgccacacagccagctacctgaccttcctgttcctgctgctgctggccagccagcacatcgacagaagtgacctgaaccggcagggccccccacccaccatcgtggagtggatgatcctgccctgggtgctgggcttcatctggggcgagatcaagcagatgtgggatggcggcctgcaggactacatccatgactggtggaacctgatggactttgtgatgaacagcctgtacctggccaccatcagcctgaagatcgtggcctttgtgaaggtgatctag

SEQ ID NO: 173793 - DNA, 2511 bp, Artificial Sequence; identical to SEQ ID NO: 173786
  Description of Artificial Sequence: Synthetic coding sequence

SEQ ID NO: 173794 - DNA, 2394 bp, Artificial Sequence
  Description of Artificial Sequence: Synthetic coding sequence
atggctgctgcccctgtggccgccggcagcggggccggccggggccgccgctctgctgccaccgtggccgcctggggcggctggggcggccggccccggcccggcaacatcctgctgcagctgcggcagggccagctgaccggccggggcctggtgcgggctgtgcagttcacagagaccttcctgacagagcgggacaagcagagcaagtggagcggcatcccccagctgctgctgaagctgcacaccaccagccacctgcacagcgactttgtggagtgccagaacatcctgaaggagatcagccccctgctgtccatggaggccatggcctttgtgacagaggagaggaagctgacccaggagaccacctaccccaacacctacatctttgacctgtttggaggagtggacctgctggtggagatcctgatgaggcccaccatcagcatccggggccagaagctgaagatcagtgatgagatgagcaaggactgcctgagcatcctgtacaacacctgtgtgtgcacagaaggagtgaccaagaggctggccgagaagaatgactttgtgatcttcctgttcaccctgatgaccagcaagaagaccttcctgcagacagccaccctgattgaggacatcctgggcgtgaagaaggagatgatccggctggatgaggtgcccaacctgagcagcctggtgagcaactttgaccagcagcagctggccaacttctgccgcatcctggccgtgaccatcagcgagatggacacaggaaatgatgacaagcacaccctgctggccaagaatgcccagcagaagaagagcctgagcctgggccccagcgctgctgagatcaaccaggccgccctgctgagcatccctggctttgtggagcggctgtgcaagctggccaccaggaaggtgtctgagagcactggaacagccagcttcctgcaggagctggaggagtggtacacctggctggacaatgccctggtgctggatgccctgatgagggtggccaatgaggagagcgagcacaaccaggccagcatcgtgttccccccacctggggcctctgaagaaaatggcctgccccacaccagcgcccggacccagctgccccagagcatgaagatcatgcatgagatcatgtacaagctggaggtgctgtatgtgctgtgtgtgctgctgatgggccggcagaggaaccaggtgcacaggatgattgctgagttcaagctgatccctggcctgaacaacctgtttgacaagctgatctggaggaagcacagcgccagcgccctggtgctgcacggccacaaccagaactgtgactgcagcccagacatcaccctgaagatccagttcctgcggctgctgcagagcttcagtgaccaccacgagaacaagtacctgctgctgaacaaccaggagctgaatgagctgagcgccatcagcctgaaggccaacatccctgaggtggaggccgtgctgaacacagacaggagcctggtgtgtgatggcaagaggggcctgctgacccggctgctgcaggtgatgaagaaggagcctgctgagagcagcttccgcttctggcaggcccgggctgtggagagcttcctgcggggcaccaccagctatgctgaccagatgttcctgctgaagaggggcctgctggagcacatcctgtactgcatcgtggacagcgagtgcaagagcagagatgtgctgcagagctactttgacctgctgggggagctgatgaagttcaacgtggatgccttcaagcgcttcaacaagtacatcaacacagatgccaagttccaggtgttcctgaagcagatcaacagcagcctggtggacagcaacatgctggtgcgctgtgtgaccctgagcctggacagatttgagaaccaggtggacatgaaggtggccgaggtgctgtctgagtgccgcctgctggcctacatcagccaggtgcccacccagatgtccttcctgttccgcctcatcaacatcatccacgtgcagaccctgacccaggagaatgtgtcctgcctgaacaccagcctggtgatcctgatgctggcccggaggaaggagcggctgcccctgtacctgcggctgctgcagaggatggagcacagcaagaagtacccaggcttcctgctgaacaacttccacaacctgctgcgcttctggcagcagcactacctgcacaaggacaaggacagcacctgcctggagaacagcagctgcatctccttctcctactggaaggagaccgtgtccatcctgctgaacccagaccggcagagccccagcgccctggtgtcctacatcgaggagccctacatggacatcgaccgggacttcacagaggagtag

SEQ ID NO: 173795 - DNA, 2277 bp, Artificial Sequence
  Description of Artificial Sequence: Synthetic coding sequence
atggctgctgcccctgtggccgccggcagcggggccggccggggccgccgctctgctgccaccgtggccgcctggggcggctggggcggccggccccggcccggcaacatcctgctgcagctgcggcagggccagctgaccggccggggcctggtgcgggctgtgcagttcacagagaccttcctgacagagcgggacaagcagagcaagtggagcggcatcccccagctgctgctgaagctgcacaccaccagccacctgcacagcgactttgtggagtgccagaacatcctgaagctgctggtggagatcctgatgaggcccaccatcagcatccggggccagaagctgaagatcagtgatgagatgagcaaggactgcctgagcatcctgtacaacacctgtgtgtgcacagagggcgtgaccaagaggctggccgagaagaatgactttgtgatcttcctgttcaccctgatgaccagcaagaagaccttcctgcagacagccaccctgattgaggacatcctgggcgtgaagaaggagatgatccggctggatgaggtgcccaacctgagcagcctggtgagcaactttgaccagcagcagctggccaacttctgccgcatcctggccgtgaccatcagcgagatggacacaggaaatgatgacaagcacaccctgctggccaagaatgcccagcagaagaagagcctgagcctgggccccagcgctgctgagatcaaccaggccgccctgctgagcatccctggctttgtggagcggctgtgcaagctggccaccaggaaggtgtctgagagcactggaacagccagcttcctgcaggagctggaggagtggtacacctggctggacaatgccctggtgctggatgccctgatgagggtggccaatgaggagagcgagcacaaccaggccagcatcgtgtttcctcctcctggggccagcgaggagaatggcctgccccacaccagcgcccggacccagctgccccagagcatgaagatcatgcatgagatcatgtacaagctggaggtgctgtatgtgctgtgtgtgctgctgatgggccggcagaggaaccaggtgcacaggatgattgctgagttcaagctgatccctggcctgaacaacctgtttgacaagctgatctggaggaagcacagcgccagcgccctggtgctgcacggccacaaccagaactgtgactgcagcccagacatcaccctgaagatccagttcctgcggctgctgcagagcttcagtgaccaccacgagaacaagtacctgctgctgaacaaccaggagctgaatgagctgagcgccatcagcctgaaggccaacatccctgaggtggaggccgtgctgaacacagacaggagcctggtgtgtgatggcaagaggggcctgctgacccggctgctgcaggtgatgaagaaggagcctgctgagagcagcttccgcttctggcaggcccgggctgtggagagcttcctgcggggcaccaccagctatgctgaccagatgttcctgctgaagaggggcctgctggagcacatcctgtactgcatcgtggacagcgagtgcaagagcagagatgtgctgcagagctactttgacctgctgggggagctgatgaagttcaacgtggatgccttcaagcgcttcaacaagtacatcaacacagatgccaagttccaggtgttcctgaagcagatcaacagcagcctggtggacagcaacatgctggtgcgctgtgtgaccctgagcctggacagatttgagaaccaggtggacatgaaggtggccgaggtgctgtctgaatgtcggctgctggcctacatcagccaggtgcccacccagatgtccttcctgttccgcctcatcaacatcatccacgtgcagaccctgacccaggagaatgtgtcctgcctgaacaccagcctggtgatcctgatgctggcccggaggaaggagcggctgcccctgtacctgcggctgctgcagaggatggagcacagcaagaagtacccaggcttcctgctgaacaacttccacaacctgctgcgcttctggcagcagcactacctgcacaaggacaaggacagcacctgcctggagaacagcagctgcatctccttctcctactggaaggagaccgtgtccatcctgctgaacccagaccggcagagccccagcgccctggtgtcctacatcgaggagccctacatggacatcgaccgggacttcacagaggagtag

SEQ ID NO: 173796 - DNA, 2370 bp, Artificial Sequence
  Description of Artificial Sequence: Synthetic coding sequence
atggctgctgcccctgtggccgccggcagcggggccggccggggccgccgctctgctgccaccgtggccgcctggggcggctggggcggccggccccggcccggcaacatcctgctgcagctgcggcagggccagctgaccggccggggcctggtgcgggctgtgcagttcacagagaccttcctgacagagcgggacaagcagagcaagtggagcggcatcccccagctgctgctgaagctgcacaccaccagccacctgcacagcgactttgtggagtgccagaacatcctgaaggagatcagccccctgctgtccatggaggccatggcctttgtgacagaggagaggaagctgacccaggagaccacctaccccaacacctacatctttgacctgtttggaggagtggacctgctggtggagatcctgatgaggcccaccatcagcatccggggccagaagctgaagatcagtgatgagatgagcaaggactgcctgagcatcctgtacaacacctgtgtgtgcacagaaggagtgaccaagaggctggccgagaagaatgactttgtgatcttcctgttcaccctgatgaccagcaagaagaccttcctgcagacagccaccctgattgaggacatcctgggcgtgaagaaggagatgatccggctggatgaggtgcccaacctgagcagcctggtgagcaactttgaccagcagcagctggccaacttctgccgcatcctggccgtgaccatcagcgagatggacacaggaaatgatgacaagcacaccctgctggccaagaatgcccagcagaagaagagcctgagcctgggccccagcgctgctgagatcaaccaggccgccctgctgagcatccctggctttgtggagcggctgtgcaagctggccaccaggaaggtgtctgagagcactggaacagccagcttcctgcaggagctggaggagtggtacacctggctggacaatgccctggtgctggatgccctgatgagggtggccaatgaggagagcgagcacaaccagggcgcctctgaagaaaatggcctgccccacaccagcgcccggacccagctgccccagagcatgaagatcatgcatgagatcatgtacaagctggaggtgctgtatgtgctgtgtgtgctgctgatgggccggcagaggaaccaggtgcacaggatgattgctgagttcaagctgatccctggcctgaacaacctgtttgacaagctgatctggaggaagcacagcgccagcgccctggtgctgcacggccacaaccagaactgtgactgcagcccagacatcaccctgaagatccagttcctgcggctgctgcagagcttcagtgaccaccacgagaacaagtacctgctgctgaacaaccaggagctgaatgagctgagcgccatcagcctgaaggccaacatccctgaggtggaggccgtgctgaacacagacaggagcctggtgtgtgatggcaagaggggcctgctgacccggctgctgcaggtgatgaagaaggagcctgctgagagcagcttccgcttctggcaggcccgggctgtggagagcttcctgcggggcaccaccagctatgctgaccagatgttcctgctgaagaggggcctgctggagcacatcctgtactgcatcgtggacagcgagtgcaagagcagagatgtgctgcagagctactttgacctgctgggggagctgatgaagttcaacgtggatgccttcaagcgcttcaacaagtacatcaacacagatgccaagttccaggtgttcctgaagcagatcaacagcagcctggtggacagcaacatgctggtgcgctgtgtgaccctgagcctggacagatttgagaaccaggtggacatgaaggtggccgaggtgctgtctgagtgccgcctgctggcctacatcagccaggtgcccacccagatgtccttcctgttccgcctcatcaacatcatccacgtgcagaccctgacccaggagaatgtgtcctgcctgaacaccagcctggtgatcctgatgctggcccggaggaaggagcggctgcccctgtacctgcggctgctgcagaggatggagcacagcaagaagtacccaggcttcctgctgaacaacttccacaacctgctgcgcttctggcagcagcactacctgcacaaggacaaggacagcacctgcctggagaacagcagctgcatctccttctcctactggaaggagaccgtgtccatcctgctgaacccagaccggcagagccccagcgccctggtgtcctacatcgaggagccctacatggacatcgaccgggacttcacagaggagtag

SEQ ID NO: 173797 - DNA, 1200 bp, Artificial Sequence
  Description of Artificial Sequence: Synthetic coding sequence
atgaggagccagagcaccatcaaggtgcacaggatgattgctgagttcaagctgatccctggcctgaacaacctgtttgacaagctgatctggaggaagcacagcgccagcgccctggtgctgcacggccacaaccagaactgtgactgcagcccagacatcaccctgaagatccagttcctgcggctgctgcagagcttcagtgaccaccacgagaacaagtacctgctgctgaacaaccaggagctgaatgagctgagcgccatcagcctgaaggccaacatccctgaggtggaggccgtgctgaacacagacaggagcctggtgtgtgatggcaagaggggcctgctgacccggctgctgcaggtgatgaagaaggagcctgctgagagcagcttccgcttctggcaggcccgggctgtggagagcttcctgcggggcaccaccagctatgctgaccagatgttcctgctgaagaggggcctgctggagcacatcctgtactgcatcgtggacagcgagtgcaagagcagagatgtgctgcagagctactttgacctgctgggggagctgatgaagttcaacgtggatgccttcaagcgcttcaacaagtacatcaacacagatgccaagttccaggtgttcctgaagcagatcaacagcagcctggtggacagcaacatgctggtgcgctgtgtgaccctgagcctggacagatttgagaaccaggtggacatgaaggtggccgaggtgctgtctgagtgccgcctgctggcctacatcagccaggtgcccacccagatgtccttcctgttccgcctcatcaacatcatccacgtgcagaccctgacccaggagaatgtgtcctgcctgaacaccagcctggtgatcctgatgctggcccggaggaaggagcggctgcccctgtacctgcggctgctgcagaggatggagcacagcaagaagtacccaggcttcctgctgaacaacttccacaacctgctgcgcttctggcagcagcactacctgcacaaggacaaggacagcacctgcctggagaacagcagctgcatctccttctcctactggaaggagaccgtgtccatcctgctgaacccagaccggcagagccccagcgccctggtgtcctacatcgaggagccctacatggacatcgaccgggacttcacagaggagtag

SEQ ID NO: 173798 - DNA, 2349 bp, Artificial Sequence
  Description of Artificial Sequence: Synthetic coding sequence
atggctgctgcccctgtggccgccggcagcggggccggccggggccgccgctctgctgccaccgtggccgcctggggcggctggggccagctgaccggccggggcctggtgcgggctgtgcagttcacagagaccttcctgacagagcgggacaagcagagcaagtggagcggcatcccccagctgctgctgaagctgcacaccaccagccacctgcacagcgactttgtggagtgccagaacatcctgaaggagatcagccccctgctgtccatggaggccatggcctttgtgacagaggagaggaagctgacccaggagaccacctaccccaacacctacatctttgacctgtttggaggagtggacctgctggtggagatcctgatgaggcccaccatcagcatccggggccagaagctgaagatcagtgatgagatgagcaaggactgcctgagcatcctgtacaacacctgtgtgtgcacagagggcgtgaccaagaggctggccgagaagaatgactttgtgatcttcctgttcaccctgatgaccagcaagaagaccttcctgcagacagccaccctgattgaggacatcctgggcgtgaagaaggagatgatccggctggatgaggtgcccaacctgagcagcctggtgagcaactttgaccagcagcagctggccaacttctgccgcatcctggccgtgaccatcagcgagatggacacaggaaatgatgacaagcacaccctgctggccaagaatgcccagcagaagaagagcctgagcctgggccccagcgctgctgagatcaaccaggccgccctgctgagcatccctggctttgtggagcggctgtgcaagctggccaccaggaaggtgtctgagagcactggaacagccagcttcctgcaggagctggaggagtggtacacctggctggacaatgccctggtgctggatgccctgatgagggtggccaatgaggagagcgagcacaaccaggccagcatcgtgtttcctcctcctggggccagcgaggagaatggcctgccccacaccagcgcccggacccagctgccccagagcatgaagatcatgcatgagatcatgtacaagctggaggtgctgtatgtgctgtgtgtgctgctgatgggccggcagaggaaccaggtgcacaggatgattgctgagttcaagctgatccctggcctgaacaacctgtttgacaagctgatctggaggaagcacagcgccagcgccctggtgctgcacggccacaaccagaactgtgactgcagcccagacatcaccctgaagatccagttcctgcggctgctgcagagcttcagtgaccaccacgagaacaagtacctgctgctgaacaaccaggagctgaatgagctgagcgccatcagcctgaaggccaacatccctgaggtggaggccgtgctgaacacagacaggagcctggtgtgtgatggcaagaggggcctgctgacccggctgctgcaggtgatgaagaaggagcctgctgagagcagcttccgcttctggcaggcccgggctgtggagagcttcctgcggggcaccaccagctatgctgaccagatgttcctgctgaagaggggcctgctggagcacatcctgtactgcatcgtggacagcgagtgcaagagcagagatgtgctgcagagctactttgacctgctgggggagctgatgaagttcaacgtggatgccttcaagcgcttcaacaagtacatcaacacagatgccaagttccaggtgttcctgaagcagatcaacagcagcctggtggacagcaacatgctggtgcgctgtgtgaccctgagcctggacagatttgagaaccaggtggacatgaaggtggccgaggtgctgtctgaatgtcggctgctggcctacatcagccaggtgcccacccagatgtccttcctgttccgcctcatcaacatcatccacgtgcagaccctgacccaggagaatgtgtcctgcctgaacaccagcctggtgatcctgatgctggcccggaggaaggagcggctgcccctgtacctgcggctgctgcagaggatggagcacagcaagaagtacccaggcttcctgctgaacaacttccacaacctgctgcgcttctggcagcagcactacctgcacaaggacaaggacagcacctgcctggagaacagcagctgcatctccttctcctactggaaggagaccgtgtccatcctgctgaacccagaccggcagagccccagcgccctggtgtcctacatcgaggagccctacatggacatcgaccgggacttcacagaggagtag

SEQ ID NO: 173799 - DNA, 2922 bp, Artificial Sequence
  Description of Artificial Sequence: Synthetic coding sequence
atggcccagctgtactacaagaaggtgaactacagcccctacagagaccgcatccccctgcagatcgtgcgggcagagacagagctgtctgctgaggagaaggccttcctgaatgctgtggagaagggggactatgccaccgtgaagcaggccctgcaggaggccgagatctactacaacgtgaacatcaactgcatggaccccctgggccgcagcgccctgctgattgccattgaaaatgaaaacctggagatcatggagctgctgctgaaccacagcgtgtatgtgggagatgccctgctgtatgccatcaggaaggaggtggtgggcgctgtggagctgctgctgagctacagaagacccagcggggagaagcaggtgcccaccctgatgatggacacccagttcagcgagttcaccccagacatcacccccatcatgctggccgcccacaccaacaactatgagatcatcaagctgctggtgcagaagagggtgaccatcccccggccccaccagatccgctgcaactgtgtggagtgtgtgagcagcagcgaggtggacagcctgcggcacagccgcagccggctgaacatctacaaggccctggccagccccagcctgattgccctgagcagcgaggaccccatcctgacagccttccggctgggctgggagctgaaggagctgagcaaggtggagaatgagttcaaggccgagtatgaggagctgagccagcagtgcaagctgtttgccaaggacctgctggaccaggcccggagcagccgggagctggagatcatcctgaaccacagagatgaccacagcgaggagctggacccccagaagtaccatgacctggccaagctgaaggtggccatcaagtaccaccagaaggagtttgtggcccagcccaactgccagcagctgctggccaccctgtggtatgatggcttccctggctggaggaggaagcactgggtggtgaagctgctgacctgcatgaccatcggcttcctgttccccatgctgagcatcgcctacctgatcagccccaggagcaacctgggcctcttcatcaagaagcccttcatcaagttcatctgccacacagccagctacctgaccttcctgttcatgctgctgctggccagccagcacatcgtgaggacagacctgcacgtgcagggccccccacccaccgtggtggagtggatgatcctgccctgggtgctgggcttcatctggggcgagatcaaggagatgtgggatggcggcttcacagagtacatccatgactggtggaacctgatggactttgccatgaacagcctgtacctggccaccatcagcctgaagatcgtggcctacgtgaagtacaacggcagccggccccgggaggagtgggagatgtggcaccccaccctgattgctgaggccctgtttgccatcagcaacatcctgagcagcctgcggctcatcagcctcttcaccgccaacagccacctgggccccctgcagatcagcctgggccgcatgctgctggacatcctgaagttcctgttcatctactgcctggtgctgctggcctttgccaacggcctgaaccagctgtacttctactatgagacccgggccattgatgagcccaacaactgcaagggcatccgctgtgagaagcagaacaatgccttcagcaccctgtttgagaccctgcagagcctcttctggagcgtgtttggcctgctgaacctgtatgtgaccaacgtgaaggcccggcatgagttcacagaatttgtgggcgccaccatgtttggcacctacaacgtcatcagcctggtggtgctgctgaacatgctgattgccatgatgaacaacagctaccagctgattgctgaccatgctgacatcgagtggaagtttgcccggaccaagctgtggatgagctactttgatgagggcggcaccctgcccccacccttcaacatcatccccagccccaagagcttcctgtacctgggcaactggttcaacaacaccttctgccccaagagggaccctgatggaagaagaagaagaagaaacctgcggagcttcacagaaagaaatgctgacagcctcatccagaaccagcactaccaggaggtgatccggaacctggtgaagcgctacgtggccgccatgatccggaacagcaagacccatgagggcctgacagaggagaacttcaaggagctgaagcaggacatcagcagcttccgctatgaggtgctggacctgctgggcaacaggaagcaccccaggagcttcagcaccagcagcacagagctgagccagagagatgacaacaatgatggcagcggcggggcccgggccaagagcaagtctgtgtccttcaacctgggctgcaagaagaagacctgccacggccccccactcatccgcaccatgcccaggagcagcggggcccagggcaagagcaaggccgagagcagcagcaagaggagcttcatgggccccagcctgaagaagctgggcctgctcttcagcaagttcaacggccacatgtctgagcccagcagcgagcccatgtacaccatcagtgatggcatcgtgcagcagcactgcatgtggcaggacatccgctacagccagatggagaagggcaaggccgaggcctgcagccagagcgagatcaacctgtctgaggtggagctgggggaggtgcagggcgccgcccagagcagtgaatgtcccctggcctgcagcagcagcctgcactgtgccagcagcatctgcagcagcaacagcaagctgctggacagcagtgaagatgtgtttgagacctggggcgaggcctgtgacctgctgatgcacaagtggggagatggccaggaggagcaggtgaccacccggctgtag

SEQ ID NO: 173800 - DNA, 2796 bp, Artificial Sequence
  Description of Artificial Sequence: Synthetic coding sequence
atgagccagagccctgccttcggcccccggcggggcagcagccccagaggagctgctggagctgctgccaggagaaatgaaagccaggactacctgctgatggacagcgagctgggggaggatggctgcccccaggcccccctgccctgctacggctactacccctgcttccggggcagtgacaaccggctggcccaccggcggcagacagtgctgcgggagaagggccgccgcctggccaacagaggccctgcctacatgttcagtgacaggagcaccagcctgagcattgaggaggagcgcttcctggatgctgctgaatatggcaacatccctgtggtgaggaagatgctggaggagtgccacagcctgaatgtgaactgtgtggactacatgggccagaatgccctgcagctggccgtggccaatgagcacctggagatcacagagctgctgctgaagaaggagaacctgagccgggtgggagatgccctgctgctggccatcagcaagggctacgtgcgcatcgtggaggccatcctgagccacccagcctttgctgagggcaagaggctggccaccagccccagccagagcgagctgcagcaggatgacttctacgcctatgatgaagatggcacccgcttcagccatgatgtgacccccatcatcctggccgcccactgccaggagtatgagatcgtgcacaccctgctgaggaaaggagccagaattgagcggccccatgactacttctgcaagtgcaatgactgcaaccagaagcagaagcatgacagcttcagccacagccgcagccgcatcaatgcctacaagggcctggccagccctgcctacctgagcctgagcagtgaagatcctgtgatgacagccctggagctgagcaatgagctggccgtgctggccaacatcgagaaggagttcaagaatgactacaagaagctgtccatgcagtgcaaggactttgtggtgggcctgctggacctgtgcaggaacacagaggaggtggaggccatcctgaatggagatgtggagaccctgcagagcggggaccacggccggcccaacctgagccggctgaagctggccatcaagtatgaggtgaagaagtttgtggcccaccccaactgccagcagcagctgctgagcatctggtatgagaacctgagcggcctgcggcagcagaccatggctgtgaagttcctggtggtgctggccgtggccatcggcctgcccttcctggccctgatctactggtttgccccctgcagcaagatgggcaagatcatgaggggccccttcatgaagtttgtggcccatgctgccagcttcaccatcttcctgggcctgctggtgatgaatgctgctgacagatttgagggcaccaagctgctgcccaatgagaccagcacagacaatgccaagcagctgttcaggatgaagaccagctgcttctcctggatggagatgctgatcatctcctgggtgattggcatgatctgggccgagtgcaaggagatctggacccagggccccaaggagtacctgtttgagctgtggaacatgctggactttggcatgctggccatctttgctgccagcttcatcgcccgcttcatggccttctggcacgccagcaaggcccagagcatcattgatgccaatgacaccctgaaggacctgaccaaggtgaccctgggggacaacgtgaagtactacaacctggcccgcatcaagtgggaccccagcgacccccagatcatcagcgagggcctgtatgccatcgctgtggtgctgtccttcagccgcatcgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacatcggggccaagcagaatgaggccttcaccaccgtggaggagagcttcaagaccctcttctgggccatcttcggcctgtctgaggtgaagtctgtggtgatcaactacaaccacaagttcattgaaaatattggctacgtgctgtatggagtgtacaacgtgaccatggtgattgtgctgctgaacatgctgattgccatgatcaacagcagcttccaggagattgaagatgatgctgatgtggagtggaagtttgcccgggccaagctgtggttctcctactttgaggagggccgcaccctgcctgtgcccttcaacctggtgcccagccccaagagcctcttctacctgctgctgaagctgaagaagtggatcagcgagctgttccagggccacaagaagggcttccaggaggatgctgagatgaacaagatcaatgaggagaagaagctgggcatcctgggcagccatgaggacctgagcaagctgagcctggacaagaagcaggtgggccacaacaagcagcccagcatccgcagcagcgaggacttccacctgaacagcttcaacaaccccccccggcagtaccagaagatcatgaagaggctcatcaagcgctacgtgctgcaggcccagattgacaaggagagtgatgaggtgaatgaaggagagctgaaggagatcaagcaggacatcagcagcctgcgctatgagctgctggaggagaagagccagaacacagaggacctggccgagctgatccgggagctgggggagaagctgtccatggagcccaaccaggaggagaccaacagatag

SEQ ID NO: 173801 - DNA, 2448 bp, Artificial Sequence
  Description of Artificial Sequence: Synthetic coding sequence
atgagccagagccctgccttcggcccccggcggggcagcagccccagaggagctgctggagctgctgccaggagaaatgaaagccaggactacctgctgatggacagcgagctgggggaggatggctgcccccaggcccccctgccctgctacggctactacccctgcttccggggcagtgacaaccggctggcccaccggcggcagacagtgctgcgggagaagggccgccgcctggccaacagaggccctgcctacatgttcagtgacaggagcaccagcctgagcattgaggaggagcgcttcctggatgctgctgaatatggcaacatccctgtggtgaggaagatgctggaggagtgccacagcctgaatgtgaactgtgtggactacatgggccagaatgccctgcagctggccgtggccaatgagcacctggagatcacagagctgctgctgaagaaggagaacctgagccgggtgggagatgccctgctgctggccatcagcaagggctacgtgcgcatcgtggaggccatcctgagccacccagcctttgctgagggcaagaggctggccaccagccccagccagagcgagctgcagcaggatgacttctacgcctatgatgaagatggcacccgcttcagccatgatgtgacccccatcatcctggccgcccactgccaggagtatgagatcgtgcacaccctgctgaggaaaggagccagaattgagcggccccatgactacttctgcaagtgcaatgactgcaaccagaagcagaagcatgacagcttcagccacagccgcagccgcatcaatgcctacaagggcctggccagccctgcctacctgagcctgagcagtgaagatcctgtgatgacagccctggagctgagcaatgagctggccgtgctggccaacatcgagaaggagttcaagatgggcaagatcatgaggggccccttcatgaagtttgtggcccatgctgccagcttcaccatcttcctgggcctgctggtgatgaatgctgctgacagatttgagggcaccaagctgctgcccaatgagaccagcacagacaatgccaagcagctgttcaggatgaagaccagctgcttctcctggatggagatgctgatcatctcctgggtgattggcatgatctgggccgagtgcaaggagatctggacccagggccccaaggagtacctgtttgagctgtggaacatgctggactttggcatgctggccatctttgctgccagcttcatcgcccgcttcatggccttctggcacgccagcaaggcccagagcatcattgatgccaatgacaccctgaaggacctgaccaaggtgaccctgggggacaacgtgaagtactacaacctggcccgcatcaagtgggaccccagcgacccccagatcatcagcgagggcctgtatgccatcgctgtggtgctgtccttcagccgcatcgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacatcggggccaagcagaatgaggccttcaccaccgtggaggagagcttcaagaccctcttctgggccatcttcggcctgtctgaggtgaagtctgtggtgatcaactacaaccacaagttcattgaaaatattggctacgtgctgtatggagtgtacaacgtgaccatggtgattgtgctgctgaacatgctgattgccatgatcaacagcagcttccaggagattgaagatgatgctgatgtggagtggaagtttgcccgggccaagctgtggttctcctactttgaggagggccgcaccctgcctgtgcccttcaacctggtgcccagccccaagagcctcttctacctgctgctgaagctgaagaagtggatcagcgagctgttccagggccacaagaagggcttccaggaggatgctgagatgaacaagatcaatgaggagaagaagctgggcatcctgggcagccatgaggacctgagcaagctgagcctggacaagaagcaggtgggccacaacaagcagcccagcatccgcagcagcgaggacttccacctgaacagcttcaacaaccccccccggcagtaccagaagatcatgaagaggctcatcaagcgctacgtgctgcaggcccagattgacaaggagagtgatgaggtgaatgaaggagagctgaaggagatcaagcaggacatcagcagcctgcgctatgagctgctggaggagaagagccagaacacagaggacctggccgagctgatccgggagctgggggagaagctgtccatggagcccaaccaggaggagaccaacagatag

SEQ ID NO: 173802 - DNA, 2631 bp, Artificial Sequence
  Description of Artificial Sequence: Synthetic coding sequence
atgagccagagccctgccttcggcccccggcggggcagcagccccagaggagctgctggagctgctgccaggagaaatgaaagccaggactacctgctgatggacagcgagctgggggaggatggctgcccccaggcccccctgccctgctacggctactacccctgcttccggggcagtgacaaccggctggcccaccggcggcagacagtgctgcgggagaagggccgccgcctggccaacagaggccctgcctacatgttcagtgacaggagcaccagcctgagcattgaggaggagcgcttcctggatgctgctgaatatggcaacatccctgtggtgaggaagatgctggaggagtgccacagcctgaatgtgaactgtgtggactacatgggccagaatgccctgcagctggccgtggccaatgagcacctggagatcacagagctgctgctgaagaaggagaacctgagccgggtgggagatgccctgctgctggccatcagcaagggctacgtgcgcatcgtggaggccatcctgagccacccagcctttgctgagggcaagaggctggccaccagccccagccagagcgagctgcagcaggatgacttctacgcctatgatgaagatggcacccgcttcagccatgatgtgacccccatcatcctggccgcccactgccaggagtatgagatcgtgcacaccctgctgaggaaaggagccagaattgagcggccccatgactacttctgcaagtgcaatgactgcaaccagaagcagaagcatgacagcttcagccacagccgcagccgcatcaatgcctacaagggcctggccagccctgcctacctgagcctgagcagtgaagatcctgtgatgacagccctggagctgagcaatgagctggccgtgctggccaacatcgagaaggagttcaagaatgactacaagaagctgtccatgcagtgcaaggactttgtggtgggcctgctggacctgtgcaggaacacagaggaggtggaggccatcctgaatggagatgtggagaccctgcagagcggggaccacggccggcccaacctgagccggctgaagctggccatcaagtatgaggtgaagaagatgggcaagatcatgaggggccccttcatgaagtttgtggcccacgccgccagcttcaccatcttcctgggcctgctggtgatgaatgctgctgacagatttgagggcaccaagctgctgcccaatgagaccagcacagacaatgccaagcagctgttcaggatgaagaccagctgcttctcctggatggagatgctgatcatctcctgggtgattggcatgatctgggccgagtgcaaggagatctggacccagggccccaaggagtacctgtttgagctgtggaacatgctggactttggcatgctggccatctttgctgccagcttcatcgcccgcttcatggccttctggcacgccagcaaggcccagagcatcattgatgccaatgacaccctgaaggacctgaccaaggtgaccctgggggacaacgtgaagtactacaacctggcccgcatcaagtgggaccccagcgacccccagatcatcagcgagggcctgtatgccatcgctgtggtgctgtccttcagcagaattgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacatcggggccaagcagaatgaggccttcaccaccgtggaggagagcttcaagaccctcttctgggccatcttcggcctgtctgaggtgaagtctgtggtgatcaactacaaccacaagttcatcgagaacatcggctacgtgctgtatggagtgtacaacgtgaccatggtgattgtgctgctgaacatgctgattgccatgatcaacagcagcttccaggagattgaagatgatgctgatgtggagtggaagtttgcccgggccaagctgtggttctcctactttgaggagggccgcaccctgcctgtgcccttcaacctggtgcccagccccaagagcctcttctacctgctgctgaagctgaagaagtggatcagcgagctgttccagggccacaagaagggcttccaggaggatgctgagatgaacaagatcaatgaggagaagaagctgggcatcctgggcagccatgaggacctgagcaagctgagcctggacaagaagcaggtgggccacaacaagcagcccagcatccgcagcagcgaggacttccacctgaacagcttcaacaaccccccccggcagtaccagaagatcatgaagaggctcatcaagagatatgtgctgcaggcccagattgacaaggagagtgatgaggtgaatgaaggagagctgaaggagatcaagcaggacatcagcagcctgcgctatgagctgctggaggagaagagccagaacacagaggacctggccgagctgatccgggagctgggggagaagctgtccatggagcccaaccaggaggagaccaacagatag

SEQ ID NO: 173803 - DNA, 2406 bp, Artificial Sequence
  Description of Artificial Sequence: Synthetic coding sequence
atgctgaggaacagcaccttcaagaacatgcagaggaggcacaccaccctgcgggagaagggccggcggcaggccatccggggccctgcctacatgtttaatgagaagggcaccagcctgaccccagaggaggagcgcttcctggacagcgcagaatatggcaacatccctgtggtgaggaagatgctggaggagagcaagaccctgaacttcaactgtgtggactacatgggccagaatgccctgcagctggccgtgggcaatgagcacctggaggtgacagagctgctgctgaagaaggagaacctggcccgggtgggagatgccctgctgctggccatcagcaagggctacgtgagaattgtggaggccatcctgaaccacccagcctttgcccagggccagaggctgaccctgagccccctggagcaggagctgagagatgatgacttctacgcctatgatgaagatggcacccgcttcagccatgacatcacccccatcatcctggccgcccactgccaggagtatgaaattgtgcacatcctgctgctgaagggggcccgcatcgagcggccccatgactacttctgcaagtgcaatgaatgtacagagaagcagaggaaggacagcttcagccacagccgcagcaggatgaatgcctacaagggcctggccagcgctgcctacctgagcctgagcagcgaggaccctgtgctgacagccctggagctgagcaatgagctggcccggctggccaacattgaaacagagttcaagtttgtggcccaccccaactgccagcagcagctgctgaccatgtggtatgagaacctgagcggcctgcggcagcagagcattgctgtgaagttcctggccgtgtttggagtgtccatcggcctgcccttcctggccatcgcctactggatcgccccctgcagcaagctgggccgcaccctgcggagccccttcatgaagtttgtggcccatgctgtgtccttcaccatcttcctgggcctgctggtggtgaatgccagtgacagatttgaaggagtgaagaccctgcccaatgagaccttcacagactaccccaagcagatcttccgggtgaagaccacccagttctcctggacagagatgctgatcatgaagtgggtgctgggcatgatctggagcgagtgcaaggagatctgggaggagggcccccgggagtatgtgctgcacctgtggaacctgctggactttggcatgctgagcatctttgtggccagcttcaccgcccgcttcatggccttcctgaaggccacagaggcccagctgtatgtggaccagcacgtgcaggatgacaccctgcacaacgtgtccctgcccccagaggtggcctacttcacctacgcccgggacaagtggtggcccagcgacccccagatcatcagcgagggcctgtatgccatcgctgtggtgctgtccttcagccgcatcgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacagaggagccaagtacaacccagccttcaccaccgtggaggagagcttcaagaccctcttctggagcatcttcggcctgtctgaggtgatctctgtggtgctgaagtatgaccacaagttcattgaaaatattggctacgtgctgtatggagtgtacaacgtgaccatggtggtggtgctgctgaacatgctgattgccatgatcaacaacagctaccaggagattgaggaggatgctgatgtggagtggaagtttgcccgggccaagctgtggctgagctactttgatgagggccgcaccctgcctgcccccttcaacctggtgcccagccccaagagcttctactacctgatcatgaggatcaagatgtgcctgatcaagctgtgcaagagcaaggccaagagctgtgaaaatgacctggagatgggcatgctgaacagcaagttcaagaagacccgctaccaggccggcatgaggaacagcgagaacctgacagccaacaacaccctgagcaagcccacccgctaccagaagatcatgaagaggctcatcaagcgctacgtgctgaaggcccaggtggacagagaaaatgatgaggtgaatgaaggagagctgaaggagatcaagcaggacatcagcagcctgcgctatgagctgctggaggagaagagccaggccaccggggagctggccgacctgatccagcagctgtctgagaagtttgggaagaacctgaacaaggaccacctgcgggtgaacaagggcaaggacatctag

SEQ ID NO: 173804 - DNA, 2241 bp, Artificial Sequence
  Description of Artificial Sequence: Synthetic coding sequence
atgctgaggaacagcaccttcaagaacatgcagaggaggcacaccaccctgcgggagaagggccggcggcaggccatccggggccctgcctacatgtttaatgagaagggcaccagcctgaccccagaggaggagcgcttcctggacagcgcagaatatggcaacatccctgtggtgaggaagatgctggaggagagcaagaccctgaacttcaactgtgtggactacatgggccagaatgccctgcagctggccgtgggcaatgagcacctggaggtgacagagctgctgctgaagaaggagaacctggcccgggtgggagatgccctgctgctggccatcagcaagggctacgtgagaattgtggaggccatcctgaaccacccagcctttgcccagggccagaggctgaccctgagccccctggagcaggagctgagagatgatgacttctacgcctatgatgaagatggcacccgcttcagccatgacatcacccccatcatcctggccgcccactgccaggagtatgaaattgtgcacatcctgctgctgaagggggcccgcatcgagcggccccatgactacttctgcaagtgcaatgaatgtacagagaagcagaggaaggacagcttcagccacagccgcagcaggatgaatgcctacaagggcctggccagcgctgcctacctgagcctgagcagcgaggaccctgtgctgacagccctggagctgagcaatgagctggcccggctggccaacattgaaacagagttcaagctgggccgcaccctgcggagccccttcatgaagtttgtggcccatgctgtgtccttcaccatcttcctgggcctgctggtggtgaatgccagtgacagatttgagggcgtgaagaccctgcccaatgagaccttcacagactaccccaagcagatcttccgggtgaagaccacccagttctcctggacagagatgctgatcatgaagtgggtgctgggcatgatctggagcgagtgcaaggagatctgggaggagggcccccgggagtatgtgctgcacctgtggaacctgctggactttggcatgctgagcatctttgtggccagcttcaccgcccgcttcatggccttcctgaaggccacagaggcccagctgtatgtggaccagcacgtgcaggatgacaccctgcacaacgtgtccctgcccccagaggtggcctacttcacctacgcccgggacaagtggtggcccagcgacccccagatcatcagcgagggcctgtatgccatcgctgtggtgctgtccttcagcagaattgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacagaggagccaagtacaacccagccttcaccaccgtggaggagagcttcaagaccctcttctggagcatcttcggcctgtctgaggtgatctctgtggtgctgaagtatgaccacaagttcatcgagaacatcggctacgtgctgtatggagtgtacaacgtgaccatggtggtggtgctgctgaacatgctgattgccatgatcaacaacagctaccaggagattgaagaagatgctgatgtggagtggaagtttgcccgggccaagctgtggctgagctactttgatgagggccgcaccctgcctgcccccttcaacctggtgcccagccccaagagcttctactacctgatcatgaggatcaagatgtgcctgatcaagctgtgcaagagcaaggccaagagctgtgaaaatgacctggagatgggcatgctgaacagcaagttcaagaagacccgctaccaggccggcatgagaaattctgagaacctgacagccaacaacaccctgagcaagcccacccgctaccagaagatcatgaagaggctcatcaagagatatgtgctgaaggcccaggtggaccgggagaatgatgaggtgaatgaaggagagctgaaggagatcaagcaggacatcagcagcctgcgctatgagctgctggaggagaagagccaggccactggagagctggccgacctgatccagcagctgtctgagaagtttgggaagaacctgaacaaggaccacctgcgggtgaacaagggcaaggacatctag

SEQ ID NO: 173805 - DNA, 2589 bp, Artificial Sequence
  Description of Artificial Sequence: Synthetic coding sequence
atgctgaggaacagcaccttcaagaacatgcagaggaggcacaccaccctgcgggagaagggccggcggcaggccatccggggccctgcctacatgtttaatgagaagggcaccagcctgaccccagaggaggagcgcttcctggacagcgcagaatatggcaacatccctgtggtgaggaagatgctggaggagagcaagaccctgaacttcaactgtgtggactacatgggccagaatgccctgcagctggccgtgggcaatgagcacctggaggtgacagagctgctgctgaagaaggagaacctggcccgggtgggagatgccctgctgctggccatcagcaagggctacgtgagaattgtggaggccatcctgaaccacccagcctttgcccagggccagaggctgaccctgagccccctggagcaggagctgagagatgatgacttctacgcctatgatgaagatggcacccgcttcagccatgacatcacccccatcatcctggccgcccactgccaggagtatgaaattgtgcacatcctgctgctgaagggggcccgcatcgagcggccccatgactacttctgcaagtgcaatgaatgtacagagaagcagaggaaggacagcttcagccacagccgcagcaggatgaatgcctacaagggcctggccagcgctgcctacctgagcctgagcagcgaggaccctgtgctgacagccctggagctgagcaatgagctggcccggctggccaacattgaaacagagttcaagaatgactacaggaagctgtccatgcagtgcaaggactttgtggtgggcgtgctggacctgtgccgggacacagaggaggtggaggccatcctgaatggagatgtgaacttccaggtgtggagcgaccaccaccggcccagcctgagccgcatcaagctggccatcaagtatgaggtgaagaagtttgtggcccaccccaactgccagcagcagctgctgaccatgtggtatgagaacctgagcggcctgcggcagcagagcattgctgtgaagttcctggccgtgtttggagtgtccatcggcctgcccttcctggccatcgcctactggatcgccccctgcagcaagctgggccgcaccctgcggagccccttcatgaagtttgtggcccatgctgtgtccttcaccatcttcctgggcctgctggtggtgaatgccagtgacagatttgagggcgtgaagaccctgcccaatgagaccttcacagactaccccaagcagatcttccgggtgaagaccacccagttctcctggacagagatgctgatcatgaagtgggtgctgggcatgatctggagcgagtgcaaggagatctgggaggagggcccccgggagtatgtgctgcacctgtggaacctgctggactttggcatgctgagcatctttgtggccagcttcaccgcccgcttcatggccttcctgaaggccacagaggcccagctgtatgtggaccagcacgtgcaggatgacaccctgcacaacgtgtccctgcccccagaggtggcctacttcacctacgcccgggacaagtggtggcccagcgacccccagatcatcagcgagggcctgtatgccatcgctgtggtgctgtccttcagcagaattgcctacatcctgcctgccaatgaaagctttggccccctgcagatcagcctgggccgcacagtgaaggacatcttcaagttcatggtgatcttcatcatggtgtttgtggccttcatgattggcatgttcaacctgtacagctactacagaggagccaagtacaacccagccttcaccaccgtggaggagagcttcaagaccctcttctggagcatcttcggcctgtctgaggtgatctctgtggtgctgaagtatgaccacaagttcatcgagaacatcggctacgtgctgtatggagtgtacaacgtgaccatggtggtggtgctgctgaacatgctgattgccatgatcaacaacagctaccaggagattgaagaagatgctgatgtggagtggaagtttgcccgggccaagctgtggctgagctactttgatgagggccgcaccctgcctgcccccttcaacctggtgcccagccccaagagcttctactacctgatcatgaggatcaagatgtgcctgatcaagctgtgcaagagcaaggccaagagctgtgaaaatgacctggagatgggcatgctgaacagcaagttcaagaagacccgctaccaggccggcatgagaaattctgagaacctgacagccaacaacaccctgagcaagcccacccgctaccagaagatcatgaagaggctcatcaagagatatgtgctgaaggcccaggtggaccgggagaatgatgaggtgaatgaaggagagctgaaggagatcaagcaggacatcagcagcctgcgctatgagctgctggaggagaagagccaggccactggagagctggccgacctgatccagcagctgtctgagaagtttgggaagaacctgaacaaggaccacctgcgggtgaacaagggcaaggacatctag

SEQ ID NO: 173806 - DNA, 4350 bp, Artificial Sequence
  Description of Artificial Sequence: Synthetic coding sequence
atggagcccagcgccctgaggaaggccggcagcgagcaggaggagggctttgagggcctgccccggcgggtgacagacctgggcatggtgagcaacctgcggcgcagcaacagcagcctcttcaagtcctggaggctgcagtgccccttcggcaacaatgacaagcaggagagcctgagctcctggatccctgagaacatcaagaagaaggaatgtgtgtactttgtggagagcagcaagctgagtgatgctgggaaggtggtgtgccagtgtggctacacccatgagcagcacctggaggaggccaccaagccccacaccttccagggcacccagtgggaccccaagaagcacgtgcaggagatgcccacagatgcctttggagacatcgtgttcaccggcctgagccagaaggtgaagaagtatgtgcgggtgtcccaggacacccccagcagcgtcatctaccacctgatgacccagcactggggcctggatgtgcccaacctgctgatctctgtgactggaggagccaagaacttcaacatgaagccccggctgaagagcatcttcagaagaggcctggtgaaggtggcccagaccactggagcctggatcatcactggaggcagccacactggagtgatgaagcaggtgggggaggccgtgcgggacttcagcctgagcagcagctacaaggagggggagctgatcaccatcggcgtggccacctggggcaccgtgcacagaagagagggcctcatccaccccaccggcagcttccctgctgagtacatcctggatgaagatggccagggcaacctgacctgcctggacagcaaccacagccacttcatcctggtggatgatggcacccacggccagtatggagtggagatccccctgcggacccggctggagaagttcatcagcgagcagaccaaggagcggggcggcgtggccatcaagatccccatcgtgtgtgtggtgctggagggcggccctggcaccctgcacaccatcgacaatgccaccaccaacggcaccccctgtgtggtggtggagggcagcggccgggtggctgatgtgattgcccaggtggccaacctgcctgtgtctgacatcaccatcagcctcatccagcagaagctgagcgtcttcttccaggagatgtttgagaccttcacagagagcagaattgtggagtggaccaagaagatccaggacatcgtgagaagacggcagctgctgactgtgttccgggagggcaaggatggccagcaggatgtggatgtggccatcctgcaggccctgctgaaggccagccgcagccaggaccactttggacatgagaactgggaccaccagctgaagctggccgtggcctggaacagagtggacatcgcccggtctgagatcttcatggatgagtggcagtggaagcccagcgacctgcaccccaccatgacagctgccctgatcagcaacaagccagagtttgtgaagctgttcctggagaatggagtgcagctgaaggagtttgtgacctgggacaccctgctgtacctgtatgagaacctggaccccagctgcctcttccacagcaagctgcagatgcaccacgtggcccaggtgctgcgggagctgctgggggacttcacccagcccctgtacccccggcccaggcacaatgaccggctgcggctgctgctgcctgtgccccacgtgaagctgaatgtgcagggcgtgtccctgcggagcctgtacaagaggagcagcggccacgtgaccttcaccatggaccccatccgggacctgctgatctgggccatcgtgcagaacagaagagagctggccggcatcatctgggcccagagccaggactgcatcgctgctgccctggcctgcagcaagatcctgaaggagctgagcaaggaggaggaggacacagacagcagcgaggagatgctggccctggccgaggagtatgagcaccgggccatcggggtcttcacagagtgctacaggaaggatgaggagcgggcccagaagctgctgaccagggtgtctgaggcctggggcaagaccacctgcctgcagctggccctggaggccaaggacatgaagtttgtgagccacggcggcatccaggccttcctgaccaaggtgtggtggggccagctgtctgtggacaatggcctgtggagggtgaccctgtgcatgctggccttccccctgctgctgaccggcctcatctccttccgggagaagaggctgcaggatgtgggcaccccagctgcccgggcccgggccttcttcaccgcccctgtggtggtgttccacctgaacatcctgagctactttgccttcctgtgcctgtttgcctacgtgctgatggtggacttccagcctgtgcccagctggtgtgaatgtgccatctacctgtggctgttcagcctggtgtgtgaggagatgaggcagctgttctatgaccctgatgaatgtggcctgatgaagaaggccgccctgtacttcagtgacttctggaacaagctggatgtgggcgccatcctgctgtttgtggccggcctgacctgccgcctcatcccagccaccctgtacccaggccgggtcatcctgagcctggacttcatcctcttctgcctgcggctgatgcacatcttcaccatcagcaagaccctgggccccaagatcatcatcgtgaagaggatgatgaaggatgtgttcttcttcctgttcctgctggccgtgtgggtggtgtcctttggagtggccaagcaggccatcctgatccacaatgaaagaagagtggactggctgttcagaggagctgtgtaccacagctacctgaccatcttcggccagatccctggctacattgatggagtgaacttcaaccctgagcactgcagccccaatggaacagacccctacaagcccaagtgcccagagagtgatgccacccagcagaggcctgccttccctgagtggctgactgtgctgctgctgtgcctgtacctgctcttcaccaacatcctgctgctgaacctgctgattgccatgttcaactacaccttccagcaggtgcaggagcacacagaccagatctggaagttccagagacatgacctgattgaggagtaccacggccggcctgctgcccccccacccttcatcctgctgagccacctgcagctgttcatcaagagggtggtgctgaagaccccagccaagaggcacaagcagctgaagaacaagctggagaagaatgaggaggccgccctgctgtcctgggagatctacctgaaggagaactacctgcagaaccggcagttccagcagaagcagaggcctgagcagaagattgaggacatcagcaacaaggtggatgccatggtggacctgctggacctggaccccctgaagaggagcggctccatggagcagaggctggccagcctggaggagcaggtggcccagacagcccaggccctgcactggatcgtgaggaccctgcgggccagcggcttcagcagcgaggctgatgtgcccaccctggccagccagaaggctgctgaggagccagatgctgagcccggcggcaggaagaagacagaggagcccggggacagctaccacgtgaatgcccggcacctgctgtaccccaactgccctgtgacccgcttccctgtgcccaatgagaaggtgccctgggagacagagttcctgatctatgacccccccttctacacagctgagaggaaggatgctgctgccatggaccccatgggagagaaccccatgggccgcacaggcctgcggggccggggcagcctgagctgcttcggccccaaccacaccctgtaccccatggtgacccgctggaggagaaatgaagatggagccatctgcaggaagagcatcaagaagatgctggaggtgctggtggtgaagctgcccctgtctgagcactgggccctgcccggcggcagccgggagcccggggagatgctgcccaggaagctgaagaggatcctgcggcaggagcactggcccagctttgagaacctgctgaagtgtggcatggaggtgtacaagggctacatggatgaccccaggaacacagacaatgcctggattgagaccgtggccgtgtctgtgcacttccaggaccagaatgatgtggagctgaaccggctgaacagcaacctgcacgcctgtgacagcggggccagcatccgctggcaggtggtggaccggcgcatccccctgtatgccaaccacaagaccctgctgcagaaggctgctgctgagtttggagcccactactag

SEQ ID NO: 173807 - DNA, 4512 bp, Artificial Sequence
  Description of Artificial Sequence: Synthetic coding sequence
atggagcccagcgccctgaggaaggccggcagcgagcaggaggagggctttgagggcctgccccggcgggtgacagacctgggcatggtgagcaacctgcggcgcagcaacagcagcctcttcaagtcctggaggctgcagtgccccttcggcaacaatgacaagcaggagagcctgagctcctggatccctgagaacatcaagaagaaggaatgtgtgtactttgtggagagcagcaagctgagtgatgctgggaaggtggtgtgccagtgtggctacacccatgagcagcacctggaggaggccaccaagccccacaccttccagggcacccagtgggaccccaagaagcacgtgcaggagatgcccacagatgcctttggagacatcgtgttcaccggcctgagccagaaggtgaagaagtatgtgcgggtgtcccaggacacccccagcagcgtcatctaccacctgatgacccagcactggggcctggatgtgcccaacctgctgatctctgtgactggaggagccaagaacttcaacatgaagccccggctgaagagcatcttcagaagaggcctggtgaaggtggcccagaccactggagcctggatcatcactggaggcagccacactggagtgatgaagcaggtgggggaggccgtgcgggacttcagcctgagcagcagctacaaggagggggagctgatcaccatcggcgtggccacctggggcaccgtgcacagaagagagggcctcatccaccccaccggcagcttccctgctgagtacatcctggatgaagatggccagggcaacctgacctgcctggacagcaaccacagccacttcatcctggtggatgatggcacccacggccagtatggagtggagatccccctgcggacccggctggagaagttcatcagcgagcagaccaaggagcggggcggcgtggccatcaagatccccatcgtgtgtgtggtgctggagggcggccctggcaccctgcacaccatcgacaatgccaccaccaacggcaccccctgtgtggtggtggagggcagcggccgggtggctgatgtgattgcccaggtggccaacctgcctgtgtctgacatcaccatcagcctcatccagcagaagctgagcgtcttcttccaggagatgtttgagaccttcacagagagcagaattgtggagtggaccaagaagatccaggacatcgtgagaagacggcagctgctgactgtgttccgggagggcaaggatggccagcaggatgtggatgtggccatcctgcaggccctgctgaaggccagccgcagccaggaccactttggacatgagaactgggaccaccagctgaagctggccgtggcctggaacagagtggacatcgcccggtctgagatcttcatggatgagtggcagtggaagcccagcgacctgcaccccaccatgacagctgccctgatcagcaacaagccagagtttgtgaagctgttcctggagaatggagtgcagctgaaggagtttgtgacctgggacaccctgctgtacctgtatgagaacctggaccccagctgcctcttccacagcaagctgcagaaggtgctggtggaggaccctgagaggcctgcctgtgccccagctgccccccggctgcagatgcaccacgtggcccaggtgctgcgggagctgctgggggacttcacccagcccctgtacccccggcccaggcacaatgaccggctgcggctgctgctgcctgtgccccacgtgaagctgaatgtgcagggcgtgtccctgcggagcctgtacaagaggagcagcggccacgtgaccttcaccatggaccccatccgggacctgctgatctgggccatcgtgcagaacagaagagagctggccggcatcatctgggcccagagccaggactgcatcgctgctgccctggcctgcagcaagatcctgaaggagctgagcaaggaggaggaggacacagacagcagcgaggagatgctggccctggccgaggagtatgagcaccgggccatcggggtcttcacagagtgctacaggaaggatgaggagcgggcccagaagctgctgaccagggtgtctgaggcctggggcaagaccacctgcctgcagctggccctggaggccaaggacatgaagtttgtgagccacggcggcatccaggccttcctgaccaaggtgtggtggggccagctgtctgtggacaatggcctgtggagggtgaccctgtgcatgctggccttccccctgctgctgaccggcctcatctccttccgggagaagaggctgcaggatgtgggcaccccagctgcccgggcccgggccttcttcaccgcccctgtggtggtgttccacctgaacatcctgagctactttgccttcctgtgcctgtttgcctacgtgctgatggtggacttccagcctgtgcccagctggtgtgaatgtgccatctacctgtggctgttcagcctggtgtgtgaggagatgaggcagctgttctatgaccctgatgaatgtggcctgatgaagaaggccgccctgtacttcagtgacttctggaacaagctggatgtgggcgccatcctgctgtttgtggccggcctgacctgccgcctcatcccagccaccctgtacccaggccgggtcatcctgagcctggacttcatcctcttctgcctgcggctgatgcacatcttcaccatcagcaagaccctgggccccaagatcatcatcgtgaagaggatgatgaaggatgtgttcttcttcctgttcctgctggccgtgtgggtggtgtcctttggagtggccaagcaggccatcctgatccacaatgaaagaagagtggactggctgttcagaggagctgtgtaccacagctacctgaccatcttcggccagatccctggctacattgatggagtgaacttcaaccctgagcactgcagccccaatggaacagacccctacaagcccaagtgcccagagagtgatgccacccagcagaggcctgccttccctgagtggctgactgtgctgctgctgtgcctgtacctgctcttcaccaacatcctgctgctgaacctgctgattgccatgttcaactacaccttccagcaggtgcaggagcacacagaccagatctggaagttccagagacatgacctgattgaggagtaccacggccggcctgctgcccccccacccttcatcctgctgagccacctgcagctgttcatcaagagggtggtgctgaagaccccagccaagaggcacaagcagctgaagaacaagctggagaagaatgaggaggccgccctgctgtcctgggagatctacctgaaggagaactacctgcagaaccggcagttccagcagaagcagaggcctgagcagaagattgaggacatcagcaacaaggtggatgccatggtggacctgctggacctggaccccctgaagaggagcggctccatggagcagaggctggccagcctggaggagcaggtggcccagacagcccaggccctgcactggatcgtgaggaccctgcgggccagcggcttcagcagcgaggctgatgtgcccaccctggccagccagaaggctgctgaggagccagatgctgagcccggcggcaggaagaagacagaggagcccggggacagctaccacgtgaatgcccggcacctgctgtaccccaactgccctgtgacccgcttccctgtgcccaatgagaaggtgccctgggagacagagttcctgatctatgacccccccttctacacagctgagaggaaggatgctgctgccatggaccccatgggagacaccctggagcccctgagcaccatccagtacaacgtggtggatggcctgcgggaccggcgctccttccacggcccctacacagtgcaggccggcctgcccctgaaccccatgggccgcacaggcctgcggggccggggcagcctgagctgcttcggccccaaccacaccctgtaccccatggtgacccgctggaggagaaatgaagatggagccatctgcaggaagagcatcaagaagatgctggaggtgctggtggtgaagctgcccctgtctgagcactgggccctgcccggcggcagccgggagcccggggagatgctgcccaggaagctgaagaggatcctgcggcaggagcactggcccagctttgagaacctgctgaagtgtggcatggaggtgtacaagggctacatggatgaccccaggaacacagacaatgcctggattgagaccgtggccgtgtctgtgcacttccaggaccagaatgatgtggagctgaaccggctgaacagcaacctgcacgcctgtgacagcggggccagcatccgctggcaggtggtggaccggcgcatccccctgtatgccaaccacaagaccctgctgcagaaggctgctgctgagtttggagcccactactag

SEQ ID NO: 173808 - DNA, 4512 bp, Artificial Sequence; identical to SEQ ID NO: 173807
  Description of Artificial Sequence: Synthetic coding sequence

SEQ ID NO: 173809 - DNA, 435 bp, Artificial Sequence
  Description of Artificial Sequence: Synthetic coding sequence
atggagcccagcgccctgaggaaggccggcagcgagcaggaggagggctttgagggcctgccccggcgggtgacagacctgggcatggtgagcaacctgcggcgcagcaacagcagcctcttcaagtcctggaggctgcagtgccccttcggcaacaatgacaagcaggagagcctgagctcctggatccctgagaacatcaagaagaaggaatgtgtgtactttgtggagagcagcaagctgagtgatgctgggaaggtggtgtgccagtgtggctacacccatgagcagcacctggaggaggccaccaagccccacaccttccagggcacccagtgggaccccaagaagcacgtgcaggagatgcccacagatgcctttggagacatcgtgttcaccggcctgagccagaaggtgaagaagtatgtgaggtag

SEQ ID NO: 173810 - DNA, 744 bp, Artificial Sequence
  Description of Artificial Sequence: Synthetic coding sequence
atgctgagccgggagcaggaggaggatggaggagctggccggcagtaccacgtgaatgcccggcacctgctgtaccccaactgccctgtgacccgcttccctgtgcccaatgagaaggtgccctgggagacagagttcctgatctatgacccccccttctacacagctgagaggaaggatgctgctgccatggaccccatgggagagaaccccatgggccgcacaggcctgcggggccggggcagcctgagctgcttcggccccaaccacaccctgtaccccatggtgacccgctggaggagaaatgaagatggagccatctgcaggaagagcatcaagaagatgctggaggtgctggtggtgaagctgcccctgtctgagcactgggccctgcccggcggcagccgggagcccggggagatgctgcccaggaagctgaagaggatcctgcggcaggagcactggcccagctttgagaacctgctgaagtgtggcatggaggtgtacaagggctacatggatgaccccaggaacacagacaatgcctggattgagaccgtggccgtgtctgtgcacttccaggaccagaatgatgtggagctgaaccggctgaacagcaacctgcacgcctgtgacagcggggccagcatccgctggcaggtggtggaccggcgcatccccctgtatgccaaccacaagaccctgctgcagaaggctgctgctgagtttggagcccactactag

SEQ ID NO: 173811 - DNA, 5136 bp, Artificial Sequence
  Description of Artificial Sequence: Synthetic coding sequence
atgggcaagaagtggagagatgctgctgagatggagcggggctgcagcgacagagaagataatgctgagagcagaagaagaagccgcagcgccagccggggccgctttgctgagagctggaagaggctgagcagcaagcagggcagcaccaagaggagcggcctgcccagccagcagaccccagcccagaagtcctggattgagcgggccttctacaagagagaatgtgtgcacatcatccccagcaccaaggacccccaccgctgctgctgcggccgcctgattggccagcacgtgggcctgacccccagcatctctgtgctgcagaatgagaagaatgaaagccggctgagcagaaatgacatccagagcgagaagtggagcatcagcaagcacacccagctgagccccacagatgccttcggcaccatcgagttccagggcggcggccacagcaacaaggccatgtatgtgcgggtgtcctttgacaccaagccagacctgctgctgcacctgatgaccaaggagtggcagctggagctgcccaagctgctgatctctgtgcatggaggcctgcagaactttgagctgcagcccaagctgaagcaggtgtttgggaagggcctcatcaaggccgccatgaccaccggggcctggatcttcaccggcggcgtgaacacaggagtcatccgccacgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtatggagctgaggtgaagctgcggcggcagctggagaagcacatcagcctgcagaagatcaacacccgcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagcgggagtacccaggcttcggctggatctacttcaagggcaacctgcccccagactaccgcatcagcctgattgacatcggcctggtgattgagtacctgatgggcggggcctaccgctgcaactacaccaggaagcgcttccgcaccctgtaccacaacctgtttggccccaagagagatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgccccccagcatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcagaaataatggagagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatcttcggcgtgaacaagtacctgggcccctacgtgatgatgattggcaagatgatgattgacatgatgtactttgtgatcatcatgctggtggtgctgatgagctttggagtggcccggcaggccatcctcttccccaatgaggagcccagctggaagctggccaagaacatcttctacatgccctactggatgatctatggagaggtgtttgctgaccagattgatcctccctgtggccagaatgagacccgggaggatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggccgcatggccacagccctggagcggctgaccggcctggagcgggcagagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagccggcggcccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagaccggccccccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgaccgggccgccttccctgggggcctgggggacaaggtggaggacctgacctgctgccaccctgagcgggaggccgagctgagccaccccagcagtgacagtgaagaaaatgaggccaagggcagaagagccaccatcgccatcagcagccaggagggggacaacagcgagaggaccctgagcaacaacatcaccgtgcccaagattgaaagagccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173812 - DNA, 4710 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacacccgctgcctgcccttcttcagcctggacagccgcctcttctacagcttctggggcagctgccagctggacagcgtgggcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgacatcggcctggtgattgagtacctgatgggcggggcctaccgctgcaactacaccaggaagcgcttccgcaccctgtaccacaacctgtttggccccaagagagatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgccccccagcatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcagaaataatggagagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatcttcggcgtgaacaagtacctgggcccctacgtgatgatgattggcaagatgatgattgacatgatgtactttgtgatcatcatgctggtggtgctgatgagctttggagtggcccggcaggccatcctcttccccaatgaggagcccagctggaagctggccaagaacatcttctacatgccctactggatgatctatggagaggtgtttgctgaccagattgatcctccctgtggccagaatgagacccgggaggatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggccgcatggccacagccctggagcggctgaccggcctggagcgggcagagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagccggcggcccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagaccggccccccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgaccgggccgccttccctgggggcctgggggacaaggtggaggacctgacctgctgccaccctgagcgggaggccgagctgagccaccccagcagtgacagtgaagaaaatgaggccaagggcagaagagccaccatcgccatcagcagccaggagggggacaacagcgagaggaccctgagcaacaacatcaccgtgcccaagattgaaagagccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173813 - DNA, 4710 bp, Artificial Sequence; identical to SEQ ID NO: 173812
  Description of Artificial Sequence: Synthetic coding sequence

SEQ ID NO: 173814 - DNA, 4701 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacaccagaattggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagcgggagtacccaggcttcggctggatctacttcaagggcaacctgcccccagactaccgcatcagcctgattgatattggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgcccccatccatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcaggaacaacggggagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatctttggagtgaacaagtacctgggcccctacgtgatgatgattggcaagatgatgattgacatgatgtacttcgtcatcatcatgctggtggtgctgatgagctttggagtggcccggcaggccatcctcttccccaatgaggagcccagctggaagctggccaagaacatcttctacatgccctactggatgatctacggggaggtgtttgctgaccagattgaccccccctgtggccagaatgagaccagagaagatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggaaggatggccacagccctggagcggctgaccggcctggagagagctgagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagcagaagacccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagacaggcctcccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgacagagctgccttccctgggggcctgggggacaaggtggaggacctgacctgctgccaccctgagcgggaggccgagctgagccaccccagcagtgacagcgaggagaatgaggccaagggccggcgggccaccatcgccatcagcagccaggagggggacaacagcgagaggaccctgagcaacaacatcaccgtgcccaagattgagcgggccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173815 - DNA, 4740 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacacccgctgcctgcccttcttcagcctggacagccgcctcttctacagcttctggggcagctgccagctggacagcgtgggcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgacatcggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgccccccagcatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcagaaataatggagagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatcttcggcgtgaacaagtacctgggcccctacgtgatgatgattggcaagatgatgattgacatgatgtactttgtgatcatcatgctggtggtgctgatgagctttggagtggcccggcaggccatcctcttccccaatgaggagcccagctggaagctggccaagaacatcttctacatgccctactggatgatctatggagaggtgtttgctgaccagattgatcctccctgtggccagaatgagacccgggaggatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggccgcatggccacagccctggagcggctgaccggcctggagcgggcagagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagccggcggcccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagaccggccccccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgaccgggccgccttccctgggggcctgggggacaaggtggaggacctgacctgctgccaccctgagcgggaggccgagctgagccaccccagcagtgacagtgaagaaaatgaggccaagggcagaagagccaccatcgccatcagcagccaggagggggacaacagcgagaggaccctgagcaacaacatcaccgtgcccaagattgaaagagccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173816 - DNA, 5124 bp, Artificial Sequence
  Description of Artificial Sequence: Synthetic coding sequence
atgcctgagccctggggcaccgtgtacttcctgggcatcgcccaggtgttctccttcctgttctcctggtggaacctggagggcgtgatgaaccaggctgatgccccccggcccctgaactggaccatcaggaagctgtgccacgccgccttcctgcccagcgtgcggctgctgaaggcccagaagtcctggattgagcgggccttctacaagagagaatgtgtgcacatcatccccagcaccaaggacccccaccgctgctgctgcggccgcctgattggccagcacgtgggcctgacccccagcatctctgtgctgcagaatgagaagaatgaaagccggctgagcagaaatgacatccagagcgagaagtggagcatcagcaagcacacccagctgagccccacagatgccttcggcaccatcgagttccagggcggcggccacagcaacaaggccatgtatgtgcgggtgtcctttgacaccaagccagacctgctgctgcacctgatgaccaaggagtggcagctggagctgcccaagctgctgatctctgtgcatggaggcctgcagaactttgagctgcagcccaagctgaagcaggtgtttgggaagggcctcatcaaggccgccatgaccaccggggcctggatcttcaccggcggcgtgaacacaggagtcatccgccacgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtatggagctgaggtgaagctgcggcggcagctggagaagcacatcagcctgcagaagatcaacacccgcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgacatcggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgccccccagcatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcagaaataatggagagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatcttcggcgtgaacaagtacctgggcccctacgtgatgatgattggcaagatgatgattgacatgatgtactttgtgatcatcatgctggtggtgctgatgagctttggagtggcccggcaggccatcctcttccccaatgaggagcccagctggaagctggccaagaacatcttctacatgccctactggatgatctatggagaggtgtttgctgaccagattgatcctccctgtggccagaatgagacccgggaggatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggccgcatggccacagccctggagcggctgaccggcctggagcgggcagagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagccggcggcccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagaccggccccccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgaccgggccgccttccctgggggcctgggggacaaggtggaggacctgacctgctgccaccctgagcgggaggccgagctgagccaccccagcagtgacagtgaagaaaatgaggccaagggcagaagagccaccatcgccatcagcagccaggagggggacaacagcgagaggaccctgagcaacaacatcaccgtgcccaagattgaaagagccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173817 - DNA, 3978 bp, Artificial Sequence
  Description of Artificial Sequence: Synthetic coding sequence
atgcctgagccctggggcaccgtgtacttcctgggcatcgcccaggtgttctccttcctgttctcctggtggaacctggagggcgtgatgaaccaggctgatgccccccggcccctgaactggaccatcaggaagctgtgccacgccgccttcctgcccagcgtgcggctgctgaaggcccagaagtcctggattgagcgggccttctacaagagagaatgtgtgcacatcatccccagcaccaaggacccccaccgctgctgctgcggccgcctgattggccagcacgtgggcctgacccccagcatctctgtgctgcagaatgagaagaatgaaagccggctgagcagaaatgacatccagagcgagaagtggagcatcagcaagcacacccagctgagccccacagatgccttcggcaccatcgagttccagggcggcggccacagcaacaaggccatgtatgtgcgggtgtcctttgacaccaagccagacctgctgctgcacctgatgaccaaggagtggcagctggagctgcccaagctgctgatctctgtgcatggaggcctgcagaactttgagctgcagcccaagctgaagcaggtgtttgggaagggcctcatcaaggccgccatgaccaccggggcctggatcttcaccggcggcgtgaacacaggagtcatccgccacgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtatggagctgaggtgaagctgcggcggcagctggagaagcacatcagcctgcagaagatcaacacccgcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgacatcggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgccccccagcatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcagaaataatggagagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatcttcggcgtgaacaagtacctgggcccctacgtgatgatgattggcaagatgatgattgacatgatgtactttgtgatcatcatgctggtggtgctgatgagctttggagtggcccggcaggccatcctcttccccaatgaggagcccagctggaagctggccaagaacatcttctacatgccctactggatgatctatggagaggtgtttgctgaccagattgatcctccctgtggccagaatgagacccgggaggatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggccgcatggccacagccctggagcggctgaccggcctggagcgggcagagagcaacaagatccgcagcaggaccagcagtgactgcacagatgctgcctacatcgtgcggcagagcagcttcaacagccaggagggcaacaccttcaagctgcaggagagcattgatcctgctgagcaccccctgtacagcgtgtag

SEQ ID NO: 173818 - DNA, 4671 bp, Artificial Sequence
  Description of Artificial Sequence: Synthetic coding sequence
tgatatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacaccagaattggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagcgggagtacccaggcttcggctggatctacttcaagggcaacctgcccccagactaccgcatcagcctgattgatattggcctggtgattgagtacctgatgggcggggcctaccgctgcaactacaccaggaagcgcttccgcaccctgtaccacaacctgtttggccccaagagagatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgcccccatccatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcaggaacaacggggagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatctttggagtgaacaagtacctgggcccctacgtgatgatgattggcaagatgatgattgacatgatgtacttcgtcatcatcatgctggtggtgctgatgagctttggagtggcccggcaggccatcctcttccccaatgaggagcccagctggaagctggccaagaacatcttctacatgccctactggatgatctacggggaggtgtttgctgaccagattgaccccccctgtggccagaatgagaccagagaagatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggaaggatggccacagccctggagcggctgaccggcctggagagagctgagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagcagaagacccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagacaggcctcccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgacagagctgccttccctgggggcctgggggacaaggtggaggacctgacctgctgccaccctgagcgggaggccgagctgagccaccccagcagtgacagcgaggagaatgaggccaagggccggcgggccaccatcgccatcagcagccaggagggggacaacagcgagaggaccctgagcaacaacatcaccgtgcccaagattgagcgggccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173819 - DNA, 4701 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacaccagaattggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgatattggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgcccccatccatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcaggaacaacggggagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatctttggagtgaacaagtacctgggcccctacgtgatgatgattggcaagatgatgattgacatgatgtacttcgtcatcatcatgctggtggtgctgatgagctttggagtggcccggcaggccatcctcttccccaatgaggagcccagctggaagctggccaagaacatcttctacatgccctactggatgatctacggggaggtgtttgctgaccagattgacaggaagcaggtgtatgacagccacacccccaagagcgccccctgtggccagaatgagaccagagaagatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggaaggatggccacagccctggagcggctgaccggcctggagagagctgagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagcagaagacccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagacaggcctcccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgacagagctgccttccctgggggcctgggggacaaggtggaggacctgacctgctgccaccctgagcgggaggccgagctgagccaccccagcagtgacagcgaggagaatgaggccaagggccggcgggccaccatcgccatcagcagccaggagggggacaacagcgagaggaccctgagcaacaacatcaccgtgcccaagattgagcgggccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173820 - DNA, 4740 bp, Artificial Sequence; identical to SEQ ID NO: 173815
  Description of Artificial Sequence: Synthetic coding sequence

SEQ ID NO: 173821 - DNA, 4701 bp, Artificial Sequence; identical to SEQ ID NO: 173814
  Description of Artificial Sequence: Synthetic coding sequence

SEQ ID NO: 173822 - DNA, 5205 bp, Artificial Sequence
  Description of Artificial Sequence: Synthetic coding sequence
atgggcaagaagtggagagatgctgctgagatggagcggggctgcagcgacagagaagataatgctgagagcagaagaagaagccgcagcgccagccggggccgctttgctgagagctggaagaggctgagcagcaagcagggcagcaccaagaggagcggcctgcccagccagcagaccccagcccagaagtcctggattgagcgggccttctacaagagagaatgtgtgcacatcatccccagcaccaaggacccccaccgctgctgctgcggccgcctgattggccagcacgtgggcctgacccccagcatctctgtgctgcagaatgagaagaatgaaagccggctgagcagaaatgacatccagagcgagaagtggagcatcagcaagcacacccagctgagccccacagatgccttcggcaccatcgagttccagggcggcggccacagcaacaaggccatgtatgtgcgggtgtcctttgacaccaagccagacctgctgctgcacctgatgaccaaggagtggcagctggagctgcccaagctgctgatctctgtgcatggaggcctgcagaactttgagctgcagcccaagctgaagcaggtgtttgggaagggcctcatcaaggccgccatgaccaccggggcctggatcttcaccggcggcgtgaacacaggagtcatccgccacgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtatggagctgaggtgaagctgcggcggcagctggagaagcacatcagcctgcagaagatcaacacccgctgcctgcccttcttcagcctggacagccgcctcttctacagcttctggggcagctgccagctggacagcgtgggcatcggccagggcgtgcctgtggtggccctgattgtggagggcggccccaacgtcatcagcatcgtgctggagtacctgcgggacaccccacctgtgcctgtggtggtgtgtgatggcagcggccgggccagtgacatcctggccttcggccacaagtacagcgaggagggcggcctcatcaatgaaagcctgcgggaccagctgctggtgaccatccagaagaccttcacctacaccaggacccaggcccagcacctgttcatcatcctgatggagtgcatgaagaagaaggagctgatcaccgtcttcaggatgggcagcgagggccaccaggacatcgacctggccatcctgacagccctgctgaagggggccaatgccagcgccccagaccagctgagcctggccctggcctggaacagagtggacatcgcccggagccagatcttcatctacggccagcagtggcctgtgggcagcctggagcaggccatgctggatgccctggtgctggacagagtggactttgtgaagctgctgattgaaaatggagtgtccatgcaccgcttcctgaccatcagccggctggaggagctgtacaacaccaggcatggccccagcaacaccctgtaccacctggtgagagatgtgaagaagggcaacctgcccccagactaccgcatcagcctgattgatattggcctggtgattgagtacctgatgggcggggcctaccgctgcaactacaccaggaagcgcttccgcaccctgtaccacaacctgtttggccccaagaggcccaaggccctgaagctgctgggcatggaggatgacatccccctgcggcggggcaggaagaccaccaagaagcgggaggaggaggtggacatcgacctggatgatcctgagatcaaccacttccccttccccttccacgagctgatggtgtgggccgtgctgatgaagaggcagaagatggccctcttcttctggcagcacggggaggaggccatggccaaggccctggtggcctgcaagctgtgcaaggccatggcccacgaggcctctgaaaatgacatggtggatgacatcagccaggagctgaaccacaacagccgggactttggccagctggccgtggagctgctggaccagagctacaagcaggatgagcagctggccatgaagctgctgacctatgagctgaagaactggagcaatgccacctgcctgcagctggccgtggccgccaagcaccgggacttcatcgcccacacctgcagccagatgctgctgacagacatgtggatgggccgcctgaggatgaggaagaacagcggcctgaaggtgatcctgggcatcctgctgcccccatccatcctgagcctggagttcaagaacaaggatgacatgccctacatgagccaggcccaggagatccacctgcaggagaaggaggccgaggagcctgagaagcccaccaaggagaaggaggaggaggacatggagctgacagccatgctgggcaggaacaacggggagagcagcaggaagaaggatgaggaggaggtgcagagcaagcacaggctcatccccctgggcaggaagatctatgagttctacaatgcccccatcgtgaagttctggttctacaccctggcctacatcggctacctgatgctgttcaactacatcgtgctggtgaagatggagcgctggcccagcacccaggagtggatcgtcatctcctacatcttcaccctgggcatcgagaagatgagggagatcctgatgtctgagcccgggaagctgctgcagaaggtgaaggtgtggctgcaggagtactggaatgtgacagacctgattgccatcctgctcttctctgtgggcatgatcctgcggctgcaggaccagcccttcagaagtgatggccgggtcatctactgtgtgaacatcatctactggtacatccggctgctggacatctttggagtgaacaagtacctgggcccctacgtgatgatgattggcaagatgatgattgacatgatgtacttcgtcatcatcatgctggtggtgctgatgagctttggagtggcccggcaggccatcctcttccccaatgaggagcccagctggaagctggccaagaacatcttctacatgccctactggatgatctacggggaggtgtttgctgaccagattgaccccccctgtggccagaatgagaccagagaagatggcaagatcatccagctgcccccctgcaagacaggagcctggatcgtgcctgccatcatggcctgctacctgctggtggccaacatcctgctggtgaacctgctgattgctgtgttcaacaacaccttctttgaggtgaagagcatcagcaaccaggtgtggaagttccagcgctaccagctgatcatgaccttccacgagaggcctgtgctgcccccacccctcatcatcttcagccacatgaccatgatcttccagcacctgtgctgccgctggaggaagcatgaaagtgaccctgatgagcgggactatggcctgaagctgttcatcacagatgatgagctgaagaaggtgcatgactttgaggagcagtgcatcgaggagtacttccgggagaaggatgaccgcttcaacagcagcaatgatgagcgcatccgggtgaccagcgagcgggtggagaacatgtccatgaggctggaggaggtgaatgaaagagagcacagcatgaaggccagcctgcagacagtggacatccggctggcccagctggaggacctgattggaaggatggccacagccctggagcggctgaccggcctggagagagctgagagcaacaagatccgcagcaggaccagcagtgactgcacagatgctgcctacatcgtgcggcagagcagcttcaacagccaggagggcaacaccttcaagctgcaggagagcattgatcctgctggggaggagaccatgagccccaccagccccaccctgatgcccaggatgaggagccacagcttctacagcgtgaacatgaaggacaagggcggcatcgagaagctggagagcatcttcaaggagaggagcctgagcctgcaccgggccaccagcagccacagcgtggccaaggagcccaaggccccagctgccccagccaacaccctggccatcgtgcctgacagcagaagacccagcagctgcatcgacatctacgtgtctgccatggatgagctgcactgtgacatcgaccccctggacaacagcgtgaacatcctgggcctgggggagcccagcttcagcacccctgtgcccagcacagcccccagcagcagcgcctatgccaccctggcccccacagacaggcctcccagccgcagcattgactttgaggacatcacctccatggacaccaggagcttcagcagtgactacacccacctgcctgagtgccagaacccctgggacagcgagccccccatgtaccacaccatcgagaggagcaagagcagccgctacctggccaccacccccttcctgctggaggaggcccccatcgtgaagagccacagcttcatgttcagccccagccgcagctactatgccaactttggagtgcctgtgaagacagctgagtacaccagcatcacagactgcatcgacacccgctgtgtgaatgccccccaggccatcgctgacagagctgccttccctgggggcctgggggacaaggtggaggacctgacctgctgccaccctgagcgggaggccgagctgagccaccccagcagtgacagcgaggagaatgaggccaagggccggcgggccaccatcgccatcagcagccaggagggggacaacagcgagaggaccctgagcaacaacatcaccgtgcccaagattgagcgggccaacagctacagcgctgaggagcccagcgccccctatgcccacaccaggaagagcttcagcatcagtgacaagctggaccggcagaggaacacagccagcctgaggaaccccttccagaggagcaagagcagcaagccagagggccgcggggacagcctgtccatgaggcggctgagcaggaccagcgccttccagagctttgagagcaagcacaactag

SEQ ID NO: 173823 - DNA, 645 bp, Artificial Sequence
  Description of Artificial Sequence: Synthetic coding sequence
atgtatgtgcgggtgtcctttgacaccaagccagacctgctgctgcacctgatgaccaaggagtggcagctggagctgcccaagctgctgatctctgtgcacggcggcctgcagaactttgagctgcagcccaagctgaagcaggtgtttgggaagggcctcatcaaggccgccatgaccactggagcctggatcttcaccggaggagtgaacacaggagtcatcagacatgtgggagatgccctgaaggaccacgccagcaagagccggggcaagatctgcaccatcggcatcgccccctggggcatcgtggagaaccaggaggacctgattggaagagatgtggtgcggccctaccagaccatgagcaaccccatgagcaagctgactgtgctgaacagcatgcacagccacttcatcctggccgacaatggcaccaccgggaagtacggggctgaggtgaagctgcggcggcagctggagaagcacatcagcctgcagaagatcaacaccagcttccacagctacaagacagcccacgtggacctgcaggacaagaggcaggtgaagacagccctggagcaggccgagtggcagcccggccggggcatgtttgaccatgacaacctgatgcagagcacctag

SEQ ID NO: 173824 - DNA, 3645 bp, Artificial Sequence
  Description of Artificial Sequence: Synthetic coding sequence
atggtggtgcctgagaaggagcagagctggatccccaagatcttcaagaagaagacctgcaccaccttcatcgtggacagcacagaccccggcggcaccctgtgccagtgtggccggcccaggacagcccaccctgctgtggccatggaggatgcctttggagctgctgtggtgacagtgtgggacagtgatgcccacaccacagagaagcccacagatgcctatggagagctggacttcaccggggccggcaggaagcacagcaacttcctgcggctgagtgacagaacagatcctgctgctgtgtacagcctggtgaccaggacctggggcttccgggcccccaacctggtggtgtctgtgctgggcggcagcggcggccctgtgctgcagacctggctgcaggacctgctgcggcggggcctggtgcgggccgcccagagcactggagcctggatcgtgactggaggcctgcacacaggcatcggcagacatgtgggcgtggccgtgcgggaccaccagatggccagcactggaggcaccaaggtggtggccatgggcgtggccccctggggcgtggtgaggaacagagacaccctcatcaaccccaagggcagcttccctgcccgctaccgctggaggggggaccctgaagatggagtgcagttccccctggactacaactacagcgccttcttcctggtggatgatggcacccacggctgcctgggcggggagaaccgcttccggctgcggctggagagctacatcagccagcagaagacaggagtgggcggcactggaattgacatccctgtgctgctgctgctgattgatggagatgagaagatgctgaccagaattgaaaatgccacccaggcccagctgccctgcctgctggtggccggcagcggcggcgctgctgactgcctggccgagaccctggaggacaccctggcccctggcagcggcggggcccggcagggcgaggcccgggaccgcatccgccgcttcttccccaagggggacctggaggtgctgcaggcccaggtggagcgcatcatgaccaggaaggagctgctgactgtgtacagcagtgaagatggcagcgaggagtttgagaccatcgtgctgaaggccctggtgaaggcctgtggcagcagcgaggccagcgcctacctggatgagctgcggctggccgtggcctggaacagagtggacatcgcccagagcgagctgttccggggggacatccagtggaggagcttccacctggaggccagcctgatggatgccctgctgaatgacaggcctgagtttgtgcggctgctgatcagccacggcctgagcctgggccacttcctgacccccatgaggctggcccagctgtacagcgctgcccccagcaacagcctcatccggaacctgctggaccaggccagccacagcgctggcaccaaggccccagccctgaagggcggcgctgctgagctgcggcccccagatgtgggccacgtgctgaggatgctgctgggcaagatgtgtgccccccgctaccccagcggcggggcctgggacccccaccctggccagggctttggagagagcatgtacctgctgagtgacaaggccaccagccccctgagcctggatgctggcctgggccaggccccctggagcgacctgctgctgtgggccctgctgctgaacagagcccagatggccatgtacttctgggagatgggcagcaatgctgtgagcagcgccctgggcgcctgcctgctgctgcgggtgatggcccggctggagccagatgctgaggaggccgcccggaggaaggacctggccttcaagtttgagggcatgggcgtggacctgtttggagagtgctaccgcagcagcgaggtgcgggccgcccggctgctgctgcggcgctgccccctgtggggagatgccacctgcctgcagctggccatgcaggctgatgcccgggccttctttgcccaggatggagtgcagagcctgctgacccagaagtggtggggagacatggccagcaccacccccatctgggccctggtgctggccttcttctgccccccactcatctacaccaggctcatcaccttcaggaagtctgaggaggagcccacccgggaggagctggagtttgacatggacagcgtcatcaatggagagggccctgtgggcacagctgaccctgctgagaagacccccctgggcgtgccccggcagagcggccggcccggctgctgcggcggccgctgtggcggccgccgctgcctgcggcgctggttccacttctggggcgcccctgtgaccatcttcatgggaaatgtggtgtcctacctgctcttcctgctgctcttcagccgggtgctgctggtggacttccagcctgcccctcctggcagcctggagctgctgctgtacttctgggccttcaccctgctgtgtgaggagctgcggcagggcctgagcggcggcggcggcagcctggccagcggcggccctggccctggccacgccagcctgagccagaggctgcggctgtacctggccgacagctggaaccagtgtgacctggtggccctgacctgcttcctgctgggcgtgggctgccgcctgaccccaggcctgtaccacctgggccgcacagtgctgtgcatcgacttcatggtgttcaccgtgcggctgctgcacatcttcaccgtgaacaagcagctgggccccaagatcgtcatcgtgtccaagatgatgaaggatgtgttcttcttcctgttcttcctgggcgtgtggctggtggcctacggcgtggccacagagggcctgctgcggccccgggacagcgacttccccagcatcctgcggcgggtcttctaccggccctacctgcagatcttcggccagatcccccaggaggacatggatgtggccctgatggagcacagcaactgcagcagcgagcccggcttctgggcccaccccccaggggcccaggccggcacctgtgtgtcccagtatgccaactggctggtggtgctgctgctggtgatcttcctgctggtggccaacatcctgctggtgaacctgctgattgccatgttctcctacaccttcggcaaggtgcagggcaacagcgacctgtactggaaggcccagcgctaccgcctcatccgggagttccacagcaggcctgccctggccccacccttcatcgtcatcagccacctgcggctgctgctgcggcagctgtgccggcggcccaggagcccccagcccagcagccctgccctggagcacttccgggtgtacctgagcaaggaggccgagaggaagctgctgacctgggagagcgtgcacaaggagaacttcctgctggcccgggcccgggacaagcgggagagtgacagcgagcggctgaagaggaccagccagaaggtggacctggccctgaagcagctgggccacatccgggagtatgagcagaggctgaaggtgctggagcgggaggtgcagcagtgcagccgggtgctgggctgggtggccgaggccctgagccgcagcgccctgctgcccccaggcggccccccacctccagacctgcccggcagcaaggactag

SEQ ID NO: 173825 - DNA, 2583 bp, Artificial Sequence
  Description of Artificial Sequence: Synthetic coding sequence
atgctgaccagaattgaaaatgccacccaggcccagctgccctgcctgctggtggccggcagcggcggcgctgctgactgcctggccgagaccctggaggacaccctggcccctggcagcggcggggcccggcagggcgaggcccgggaccgcatccgccgcttcttccccaagggggacctggaggtgctgcaggcccagagcttccacctggaggccagcctgatggatgccctgctgaatgacaggcctgagtttgtgcggctgctgatcagccacggcctgagcctgggccacttcctgacccccatgaggctggcccagctgtacagcgctgcccccagcaacagcctcatccggaacctgctggaccaggccagccacagcgctggcaccaaggccccagccctgaagggcggcgctgctgagctgcggcccccagatgtgggccacgtgctgaggatgctgctgggcaagatgtgtgccccccgctaccccagcggcggggcctgggacccccaccctggccagggctttggagagagcatgtacctgctgagtgacaaggccaccagccccctgagcctggatgctggcctgggccaggccccctggagcgacctgctgctgtgggccctgctgctgaacagagcccagatggccatgtacttctgggagatgggcagcaatgctgtgagcagcgccctgggcgcctgcctgctgctgcgggtgatggcccggctggagccagatgctgaggaggccgcccggaggaaggacctggccttcaagtttgagggcatgggcgtggacctgtttggagagtgctaccgcagcagcgaggtgcgggccgcccggctgctgctgcggcgctgccccctgtggggagatgccacctgcctgcagctggccatgcaggctgatgcccgggccttctttgcccaggatggagtgcagagcctgctgacccagaagtggtggggagacatggccagcaccacccccatctgggccctggtgctggccttcttctgccccccactcatctacaccaggctcatcaccttcaggaagtctgaggaggagcccacccgggaggagctggagtttgacatggacagcgtcatcaatggagagggccctgtgggcacagctgaccctgctgagaagacccccctgggcgtgccccggcagagcggccggcccggctgctgcggcggccgctgtggcggccgccgctgcctgcggcgctggttccacttctggggcgcccctgtgaccatcttcatgggaaatgtggtgtcctacctgctcttcctgctgctcttcagccgggtgctgctggtggacttccagcctgcccctcctggcagcctggagctgctgctgtacttctgggccttcaccctgctgtgtgaggagctgcggcagggcctgagcggcggcggcggcagcctggccagcggcggccctggccctggccacgccagcctgagccagaggctgcggctgtacctggccgacagctggaaccagtgtgacctggtggccctgacctgcttcctgctgggcgtgggctgccgcctgaccccaggcctgtaccacctgggccgcacagtgctgtgcatcgacttcatggtgttcaccgtgcggctgctgcacatcttcaccgtgaacaagcagctgggccccaagatcgtcatcgtgtccaagatgatgaaggatgtgttcttcttcctgttcttcctgggcgtgtggctggtggcctacggcgtggccacagagggcctgctgcggccccgggacagcgacttccccagcatcctgcggcgggtcttctaccggccctacctgcagatcttcggccagatcccccaggaggacatggatgtggccctgatggagcacagcaactgcagcagcgagcccggcttctgggcccaccccccaggggcccaggccggcacctgtgtgtcccagtatgccaactggctggtggtgctgctgctggtgatcttcctgctggtggccaacatcctgctggtgaacctgctgattgccatgttctcctacaccttcggcaaggtgcagggcaacagcgacctgtactggaaggcccagcgctaccgcctcatccgggagttccacagcaggcctgccctggccccacccttcatcgtcatcagccacctgcggctgctgctgcggcagctgtgccggcggcccaggagcccccagcccagcagccctgccctggagcacttccgggtgtacctgagcaaggaggccgagaggaagctgctgacctgggagagcgtgcacaaggagaacttcctgctggcccgggcccgggacaagcgggagagtgacagcgagcggctgaagaggaccagccagaaggtggacctggccctgaagcagctgggccacatccgggagtatgagcagaggctgaaggtgctggagcgggaggtgcagcagtgcagccgggtgctgggctgggtggccgaggccctgagccgcagcgccctgctgcccccaggcggccccccacctccagacctgcccggcagcaaggactag

SEQ ID NO: 173826 - DNA, 3210 bp, Artificial Sequence
  Description of Artificial Sequence: Synthetic coding sequence
atggtggtgcctgagaaggagcagagctggatccccaagatcttcaagaagaagacctgcaccaccttcatcgtggacagcacagaccccggcggcaccctgtgccagtgtggccggcccaggacagcccaccctgctgtggccatggaggatgcctttggagctgctgtggtgacagtgtgggacagtgatgcccacaccacagagaagcccacagatgcctatggagagctggacttcaccggggccggcaggaagcacagcaacttcctgcggctgagtgacagaacagatcctgctgctgtgtacagcctggtgaccaggacctggggcttccgggcccccaacctggtggtgtctgtgctgggcggcagcggcggccctgtgctgcagacctggctgcaggacctgctgcggcggggcctggtgcgggccgcccagagcactggagcctggatcgtgactggaggcctgcacacaggcatcggcagacatgtgggcgtggccgtgcgggaccaccagatggccagcactggaggcaccaaggtggtggccatgggcgtggccccctggggcgtggtgaggaacagagacaccctcatcaaccccaagggcagcttccctgcccgctaccgctggaggggggaccctgaagatggagtgcagttccccctggactacaactacagcgccttcttcctggtggatgatggcacccacggctgcctgggcggggagaaccgcttccggctgcggctggagagctacatcagccagcagaagacaggagtgggcggcactggaattgacatccctgtgctgctgctgctgattgatggagatgagaagatgctgaccagaattgaaaatgccacccaggcccagctgccctgcctgctggtggccggcagcggcggcgctgctgactgcctggccgagaccctggaggacaccctggcccctggcagcggcggggcccggcagggcgaggcccgggaccgcatccgccgcttcttccccaagggggacctggaggtgctgcaggcccaggtggagcgcatcatgaccaggaaggagctgctgactgtgtacagcagtgaagatggcagcgaggagtttgagaccatcgtgctgaaggccctggtgaaggcctgtggcagcagcgaggccagcgcctacctggatgagctgcggctggccgtggcctggaacagagtggacatcgcccagagcgagctgttccggggggacatccagtggaggagcttccacctggaggccagcctgatggatgccctgctgaatgacaggcctgagtttgtgcggctgctgatcagccacggcctgagcctgggccacttcctgacccccatgaggctggcccagctgtacagcgctgcccccagcaacagcctcatccggaacctgctggaccaggccagccacagcgctggcaccaaggccccagccctgaagggcggcgctgctgagctgcggcccccagatgtgggccacgtgctgaggatgctgctgggcaagatgtgtgccccccgctaccccagcggcggggcctgggacccccaccctggccagggctttggagagagcatgtacctgctgagtgacaaggccaccagccccctgagcctggatgctggcctgggccaggccccctggagcgacctgctgctgtgggccctgctgctgaacagagcccagatggccatgtacttctgggagatgggcagcaatgctgtgagcagcgccctgggcgcctgcctgctgctgcgggtgatggcccggctggagccagatgctgaggaggccgcccggaggaaggacctggccttcaagtttgagggcatgggcgtggacctgtttggagagtgctaccgcagcagcgaggtgcgggccgcccggctgctgctgcggcgctgccccctgtggggagatgccacctgcctgcagctggccatgcaggctgatgcccgggccttctttgcccaggatggagtgcagagcctgctgacccagaagtggtggggagacatggccagcaccacccccatctgggccctggtgctggccttcttctgccccccactcatctacaccaggctcatcaccttcaggaagtctgaggaggagcccacccgggaggagctggagtttgacatggacagcgtcatcaatggagagggccctgtgggcctgaccccaggcctgtaccacctgggccgcacagtgctgtgcatcgacttcatggtgttcaccgtgcggctgctgcacatcttcaccgtgaacaagcagctgggccccaagatcgtgattgtgtccaagatgatgaaggatgtgttcttcttcctgttcttcctgggcgtgtggctggtggcctatggagtggccacagagggcctgctgcggccccgggacagcgacttccccagcatcctgcggcgggtcttctaccggccctacctgcagatcttcggccagatcccccaggaggacatggatgtggccctgatggagcacagcaactgcagcagcgagcccggcttctgggcccaccccccaggggcccaggccggcacctgtgtgtcccagtatgccaactggctggtggtgctgctgctggtgatcttcctgctggtggccaacatcctgctggtgaacctgctgattgccatgttctcctacaccttcggcaaggtgcagggcaacagcgacctgtactggaaggcccagcgctaccgcctcatccgggagttccacagcaggcctgccctggccccacccttcatcgtcatcagccacctgcggctgctgctgcggcagctgtgcagaagacccaggagcccccagcccagcagccctgccctggagcacttccgggtgtacctgagcaaggaggccgagaggaagctgctgacctgggagagcgtgcacaaggagaacttcctgctggcccgggcccgggacaagcgggagagtgacagcgagcggctgaagaggaccagccagaaggtggacctggccctgaagcagctgggccacatccgggagtatgagcagaggctgaaggtgctggagcgggaggtgcagcagtgcagccgggtgctgggctgggtggccgaggccctgagccgcagcgccctgctgcccccaggcggccccccacctccagacctgcccggcagcaaggactag

SEQ ID NO: 173827 - DNA, 3498 bp, Artificial Sequence
  Description of Artificial Sequence: Synthetic coding sequence
atgcaggatgtgcagggccccaggcctggcagccctggagatgctgaggaccggcgggagctgggcctgcacagaggagaggtgaactttggaggcagcggcaagaagaggggcaagtttgtgcgggtgcccagcggcgtggcccccagcgtgctgtttgacctgctgctggccgagtggcacctgcctgcccccaacctggtggtgtccctggtgggggaggagcagccctttgccatgaagtcctggctgagagatgtgctgaggaagggcctggtgaaggccgcccagagcactggagcctggatcctgaccagcgccctgcgggtgggcctggcccggcacgtgggccaggccgtgcgggaccacagcctggccagcaccagcaccaaggtgcgggtggtggccgtgggcatggccagcctgggccgggtgctgcaccggcgcatcctggaggaggcccaggaggacttccctgtgcactacccagaagatgatggcggcagccagggccccctgtgcagcctggacagcaacctgagccacttcatcctggtggagcccggccccccaggaaaaggagatggcctgacagagctgcggctgcggctggagaagcacatcagcgagcagagagctggctatggaggcaccggcagcattgagatccctgtgctgtgcctgctggtgaatggagaccccaacaccctggagcgcatcagcagagctgtggagcaggccgccccctggctgatcctggtgggcagcggcggcattgctgatgtgctggccgccctggtgaaccagccccacctgctggtgcccaaggtggccgagaagcagttcaaggagaagttccccagcaagcacttctcctgggaggacatcgtgcgctggaccaagctgctgcagaacatcaccagccaccagcacctgctgactgtgtatgactttgagcaggagggcagcgaggagctggacaccgtcatcctgaaggccctggtgaaggcctgcaagagccacagccaggagccccaggactacctggatgagctgaagctggccgtggcctgggacagagtggacatcgccaagtctgagatcttcaatggagatgtggagtggaagagctgtgacctggaggaggtgatggtggatgccctggtgagcaacaagccagagtttgtgcggctgtttgtggacaacggggctgatgtggccgacttcctgacctacggccgcctgcaggagctgtacagatctgtgtccaggaagagcctgctgtttgacctgctgcagaggaagcaggaggaggcccggctgaccctggccggcctgggcacccagcaggcccgggagcccccagctggccccccagccttcagcctgcacgaggtgtcccgggtgctgaaggacttcctgcaggatgcctgccggggcttctaccaggacggccggcctggggacagaagaagagctgagaagggccctgccaagaggcccaccggccagaagtggctgctggacctgaaccagaagtctgagaacccctggagggacctcttcctgtgggccgtgctgcagaacagacatgagatggccacctacttctgggccatgggccaggagggcgtggccgccgccctggccgcctgcaagatcctgaaggagatgagccacctggagacagaagctgaggccgcccgggccacccgggaggccaagtatgaaaggctggccctggacctcttcagcgagtgctacagcaacagcgaggcccgggcctttgccctgctggtgagaagaaaccgctgctggagcaagaccacctgcctgcacctggccacagaagcagatgccaaggccttctttgcccatgatggagtgcaggccttcctgacccgcatctggtggggagacatggctgctggcacccccatcctgcggctgctgggcgccttcctgtgcccagccctggtgtacaccaacctgatcaccttcagcgaggaggcccccctgaggacaggcctggaggacctgcaggacctggacagcctggacacagagaagagccccctgtatggcctgcagagccgggtggaggagctggtggaggccccccgggcccagggcgaccggggccccagggctgtgttcctgctgacccgctggaggaagttctggggcgcccctgtgacagtgttcctgggcaatgtggtgatgtactttgccttcctgttcctgttcacctacgtgctgctggtggacttccggcccccaccccagggccccagcggccctgaggtgaccctgtacttctgggtgttcaccctggtgctggaggagatccggcagggcttcttcacagatgaggacacccacctggtgaagaagttcaccctgtatgtgggggacaactggaacaagtgtgacatggtggccatcttcctgttcatcgtgggcgtgacctgcaggatgctgcccagcgcctttgaagctggccgcacagtgctggccatggacttcatggtgttcaccctgcggctcatccacatctttgccatccacaagcagctgggccccaagatcatcgtggtggagaggatgatgaaggatgtgttcttcttcctgttcttcctgtctgtgtggctggtggcctatggagtgaccacccaggccctgctgcacccccatgatggccgcctggagtggatcttcagaagagtgctgtaccggccctacctgcagatcttcggccagatccccctggatgaaattgatgaggcccgggtgaactgcagcacccaccccctgctgctggaggacagccccagctgccccagcctgtatgccaactggctggtgatcctgctgctggtgaccttcctgctggtgaccaacgtgctgctgatgaacctgctgattgccatgttctcctacaccttccaggtggtgcagggcaatgctgacatgttctggaagttccagcgctacaacctgattgtggagtaccacgagaggcctgccctggccccacccttcatcctgctgagccacctgagcctgaccctgcggcgggtcttcaagaaggaggccgagcacaagcgggagcacctggagcgggacctgcctgaccccctggaccagaaggtggtgacctgggagaccgtgcagaaggagaacttcctgagcaagatggagaagagaagaagagattctgagggggaggtgctgaggaagacagcccaccgggtggacttcatcgccaagtacctgggcggcctgcgggagcaggagaagaggatcaagtgcctggagagccagatcaactactgcagcgtgctggtgtcctctgtggctgatgtgctggcccagggcggcggccccaggagcagccagcactgtggggagggcagccagctggtggccgctgaccaccggggcggcctggatggctgggagcagcccggggccggccagcccccaagtgacacctag

SEQ ID NO: 173828 - DNA, 2619 bp, Artificial Sequence
  Description of Artificial Sequence: Synthetic coding sequence
atgcaggatgtgcagggccccaggcctggcagccctggagatgctgaggaccggcgggagctgggcctgcacagaggagaggtgaactttggaggcagcggcaagaagaggggcaagtttgtgcgggtgcccagcggcgtggcccccagcgtgctgtttgacctgctgctggccgagtggcacctgcctgcccccaacctggtggtgtccctggtgggggaggagcagccctttgccatgaagtcctggctgagagatgtgctgaggaagggcctggtgaaggccgcccagagcactggagcctggatcctgaccagcgccctgcgggtgggcctggcccggcacgtgggccaggccgtgcgggaccacagcctggccagcaccagcaccaaggtgcgggtggtggccgtgggcatggccagcctgggccgggtgctgcaccggcgcatcctggaggaggcccaggaggacttccctgtgcactacccagaagatgatggcggcagccagggccccctgtgcagcctggacagcaacctgagccacttcatcctggtggagcccggccccccaggaaaaggagatggcctgacagagctgcggctgcggctggagaagcacatcagcgagcagagagctggctatggaggcaccggcagcattgagatccctgtgctgtgcctgctggtgaatggagaccccaacaccctggagcgcatcagcagagctgtggagcaggccgccccctggctgatcctggtgggcagcggcggcattgctgatgtgctggccgccctggtgaaccagccccacctgctggtgcccaaggtggccgagaagcagttcaaggagaagttccccagcaagcacttctcctgggaggacatcgtgcgctggaccaagctgctgcagaacatcaccagccaccagcacctgctgactgtgtatgactttgagcaggagggcagcgaggagctggacaccgtcatcctgaaggccctggtgaaggcctgcaagagccacagccaggagccccaggactacctggatgagctgaagctggccgtggcctgggacagagtggacatcgccaagtctgagatcttcaatggagatgtggagtggaagagctgtgacctggaggaggtgatggtggatgccctggtgagcaacaagccagagtttgtgcggctgtttgtggacaacggggctgatgtggccgacttcctgacctacggccgcctgcaggagctgtacagatctgtgtccaggaagagcctgctgtttgacctgctgcagaggaagcaggaggaggcccggctgaccctggccggcctgggcacccagcaggcccgggagcccccagctggccccccagccttcagcctgcacgaggtgtcccgggtgctgaaggacttcctgcaggatgcctgccggggcttctaccaggacggccggcctggggacagaagaagagctgagaagggccctgccaagaggcccaccggccagaagtggctgctggacctgaaccagaagtctgagaacccctggagggacctcttcctgtgggccgtgctgcagaacagacatgagatggccacctacttctgggccatgggccaggagggcgtggccgccgccctggccgcctgcaagatcctgaaggagatgagccacctggagacagaagctgaggccgcccgggccacccgggaggccaagtatgaaaggctggccctggacctcttcagcgagtgctacagcaacagcgaggcccgggcctttgccctgctggtgagaagaaaccgctgctggagcaagaccacctgcctgcacctggccacagaagcagatgccaaggccttctttgcccatgatggagtgcaggccttcctgacccgcatctggtggggagacatggctgctggcacccccatcctgcggctgctgggcgccttcctgtgcccagccctggtgtacaccaacctgatcaccttcagcgaggaggcccccctgaggacaggcctggaggacctgcaggacctggacagcctggacacagagaagagccccctgtatggcctgcagagccgggtggaggagctggtggaggccccccgggcccagggcgaccggggccccagggctgtgttcctgctgacccgctggaggaagttctggggcgcccctgtgacagtgttcctgggcaatgtggtgatgtactttgccttcctgttcctgttcacctacgtgctgctggtggacttccggcccccaccccagggccccagcggccctgaggtgaccctgtacttctgggtgttcaccctggtgctggaggagatccggcagggcttcttcacagatgaggacacccacctggtgaagaagttcaccctgtatgtgggggacaactggaacaagtgtgacatggtggccatcttcctgttcatcgtgggcgtgacctgcaggatgctgcccagcgcctttgaagctggccgcacagtgctggccatggacttcatggtgttcaccctgcggctcatccacatctttgccatccacaagcagctgggccccaagatcatcgtggtggagaggatgaagcctgtgtag

SEQ ID NO: 173829 - DNA, 3504 bp, Artificial Sequence
  Description of Artificial Sequence: Synthetic coding sequence
atgcaggatgtgcagggccccaggcctggcagccctggagatgctgaggaccggcgggagctgggcctgcacagaggagaggtgaactttggaggcagcggcaagaagaggggcaagtttgtgcgggtgcccagcggcgtggcccccagcgtgctgtttgacctgctgctggccgagtggcacctgcctgcccccaacctggtggtgtccctggtgggggaggagcagccctttgccatgaagtcctggctgagagatgtgctgaggaagggcctggtgaaggccgcccagagcactggagcctggatcctgaccagcgccctgcgggtgggcctggcccggcacgtgggccaggccgtgcgggaccacagcctggccagcaccagcaccaaggtgcgggtggtggccgtgggcatggccagcctgggccgggtgctgcaccggcgcatcctggaggaggcccaggtgcatgaggacttccctgtgcactacccagaagatgatggcggcagccagggccccctgtgcagcctggacagcaacctgagccacttcatcctggtggagcccggccccccaggaaaaggagatggcctgacagagctgcggctgcggctggagaagcacatcagcgagcagagagctggctatggaggcaccggcagcattgagatccctgtgctgtgcctgctggtgaatggagaccccaacaccctggagcgcatcagcagagctgtggagcaggccgccccctggctgatcctggtgggcagcggcggcattgctgatgtgctggccgccctggtgaaccagccccacctgctggtgcccaaggtggccgagaagcagttcaaggagaagttccccagcaagcacttctcctgggaggacatcgtgcgctggaccaagctgctgcagaacatcaccagccaccagcacctgctgactgtgtatgactttgagcaggagggcagcgaggagctggacaccgtcatcctgaaggccctggtgaaggcctgcaagagccacagccaggagccccaggactacctggatgagctgaagctggccgtggcctgggacagagtggacatcgccaagtctgagatcttcaatggagatgtggagtggaagagctgtgacctggaggaggtgatggtggatgccctggtgagcaacaagccagagtttgtgcggctgtttgtggacaacggggctgatgtggccgacttcctgacctacggccgcctgcaggagctgtacagatctgtgtccaggaagagcctgctgtttgacctgctgcagaggaagcaggaggaggcccggctgaccctggccggcctgggcacccagcaggcccgggagcccccagctggccccccagccttcagcctgcacgaggtgtcccgggtgctgaaggacttcctgcaggatgcctgccggggcttctaccaggacggccggcctggggacagaagaagagctgagaagggccctgccaagaggcccaccggccagaagtggctgctggacctgaaccagaagtctgagaacccctggagggacctcttcctgtgggccgtgctgcagaacagacatgagatggccacctacttctgggccatgggccaggagggcgtggccgccgccctggccgcctgcaagatcctgaaggagatgagccacctggagacagaagctgaggccgcccgggccacccgggaggccaagtatgaaaggctggccctggacctcttcagcgagtgctacagcaacagcgaggcccgggcctttgccctgctggtgagaagaaaccgctgctggagcaagaccacctgcctgcacctggccacagaagcagatgccaaggccttctttgcccatgatggagtgcaggccttcctgacccgcatctggtggggagacatggctgctggcacccccatcctgcggctgctgggcgccttcctgtgcccagccctggtgtacaccaacctgatcaccttcagcgaggaggcccccctgaggacaggcctggaggacctgcaggacctggacagcctggacacagagaagagccccctgtatggcctgcagagccgggtggaggagctggtggaggccccccgggcccagggcgaccggggccccagggctgtgttcctgctgacccgctggaggaagttctggggcgcccctgtgacagtgttcctgggcaatgtggtgatgtactttgccttcctgttcctgttcacctacgtgctgctggtggacttccggcccccaccccagggccccagcggccctgaggtgaccctgtacttctgggtgttcaccctggtgctggaggagatccggcagggcttcttcacagatgaggacacccacctggtgaagaagttcaccctgtatgtgggggacaactggaacaagtgtgacatggtggccatcttcctgttcatcgtgggcgtgacctgcaggatgctgcccagcgcctttgaagctggccgcacagtgctggccatggacttcatggtgttcaccctgcggctcatccacatctttgccatccacaagcagctgggccccaagatcatcgtggtggagaggatgatgaaggatgtgttcttcttcctgttcttcctgtctgtgtggctggtggcctatggagtgaccacccaggccctgctgcacccccatgatggccgcctggagtggatcttcagaagagtgctgtaccggccctacctgcagatcttcggccagatccccctggatgaaattgatgaggcccgggtgaactgcagcacccaccccctgctgctggaggacagccccagctgccccagcctgtatgccaactggctggtgatcctgctgctggtgaccttcctgctggtgaccaacgtgctgctgatgaacctgctgattgccatgttctcctacaccttccaggtggtgcagggcaatgctgacatgttctggaagttccagcgctacaacctgattgtggagtaccacgagaggcctgccctggccccacccttcatcctgctgagccacctgagcctgaccctgcggcgggtcttcaagaaggaggccgagcacaagcgggagcacctggagcgggacctgcctgaccccctggaccagaaggtggtgacctgggagaccgtgcagaaggagaacttcctgagcaagatggagaagagaagaagagattctgagggggaggtgctgaggaagacagcccaccgggtggacttcatcgccaagtacctgggcggcctgcgggagcaggagaagaggatcaagtgcctggagagccagatcaactactgcagcgtgctggtgtcctctgtggctgatgtgctggcccagggcggcggccccaggagcagccagcactgtggggagggcagccagctggtggccgctgaccaccggggcggcctggatggctgggagcagcccggggccggccagcccccaagtgacacctag

SEQ ID NO: 173830 - DNA, 3480 bp, Artificial Sequence
  Description of Artificial Sequence: Synthetic coding sequence
cctggcagccctggagatgctgaggaccggcgggagctgggcctgcacagaggagaggtgaactttggaggcagcggcaagaagaggggcaagtttgtgcgggtgcccagcggcgtggcccccagcgtgctgtttgacctgctgctggccgagtggcacctgcctgcccccaacctggtggtgtccctggtgggggaggagcagccctttgccatgaagtcctggctgagagatgtgctgaggaagggcctggtgaaggccgcccagagcactggagcctggatcctgaccagcgccctgcgggtgggcctggcccggcacgtgggccaggccgtgcgggaccacagcctggccagcaccagcaccaaggtgcgggtggtggccgtgggcatggccagcctgggccgggtgctgcaccggcgcatcctggaggaggcccaggtgcatgaggacttccctgtgcactacccagaagatgatggcggcagccagggccccctgtgcagcctggacagcaacctgagccacttcatcctggtggagcccggccccccaggaaaaggagatggcctgacagagctgcggctgcggctggagaagcacatcagcgagcagagagctggctatggaggcaccggcagcattgagatccctgtgctgtgcctgctggtgaatggagaccccaacaccctggagcgcatcagcagagctgtggagcaggccgccccctggctgatcctggtgggcagcggcggcattgctgatgtgctggccgccctggtgaaccagccccacctgctggtgcccaaggtggccgagaagcagttcaaggagaagttccccagcaagcacttctcctgggaggacatcgtgcgctggaccaagctgctgcagaacatcaccagccaccagcacctgctgactgtgtatgactttgagcaggagggcagcgaggagctggacaccgtcatcctgaaggccctggtgaaggcctgcaagagccacagccaggagccccaggactacctggatgagctgaagctggccgtggcctgggacagagtggacatcgccaagtctgagatcttcaatggagatgtggagtggaagagctgtgacctggaggaggtgatggtggatgccctggtgagcaacaagccagagtttgtgcggctgtttgtggacaacggggctgatgtggccgacttcctgacctacggccgcctgcaggagctgtacagatctgtgtccaggaagagcctgctgtttgacctgctgcagaggaagcaggaggaggcccggctgaccctggccggcctgggcacccagcaggcccgggagcccccagctggccccccagccttcagcctgcacgaggtgtcccgggtgctgaaggacttcctgcaggatgcctgccggggcttctaccaggacggccggcctggggacagaagaagagctgagaagggccctgccaagaggcccaccggccagaagtggctgctggacctgaaccagaagtctgagaacccctggagggacctcttcctgtgggccgtgctgcagaacagacatgagatggccacctacttctgggccatgggccaggagggcgtggccgccgccctggccgcctgcaagatcctgaaggagatgagccacctggagacagaagctgaggccgcccgggccacccgggaggccaagtatgaaaggctggccctggacctcttcagcgagtgctacagcaacagcgaggcccgggcctttgccctgctggtgagaagaaaccgctgctggagcaagaccacctgcctgcacctggccacagaagcagatgccaaggccttctttgcccatgatggagtgcaggccttcctgacccgcatctggtggggagacatggctgctggcacccccatcctgcggctgctgggcgccttcctgtgcccagccctggtgtacaccaacctgatcaccttcagcgaggaggcccccctgaggacaggcctggaggacctgcaggacctggacagcctggacacagagaagagccccctgtatggcctgcagagccgggtggaggagctggtggaggccccccgggcccagggcgaccggggccccagggctgtgttcctgctgacccgctggaggaagttctggggcgcccctgtgacagtgttcctgggcaatgtggtgatgtactttgccttcctgttcctgttcacctacgtgctgctggtggacttccggcccccaccccagggccccagcggccctgaggtgaccctgtacttctgggtgttcaccctggtgctggaggagatccggcagggcttcttcacagatgaggacacccacctggtgaagaagttcaccctgtatgtgggggacaactggaacaagtgtgacatggtggccatcttcctgttcatcgtgggcgtgacctgcaggatgctgcccagcgcctttgaagctggccgcacagtgctggccatggacttcatggtgttcaccctgcggctcatccacatctttgccatccacaagcagctgggccccaagatcatcgtggtggagaggatgatgaaggatgtgttcttcttcctgttcttcctgtctgtgtggctggtggcctatggagtgaccacccaggccctgctgcacccccatgatggccgcctggagtggatcttcagaagagtgctgtaccggccctacctgcagatcttcggccagatccccctggatgaaattgatgaggcccgggtgaactgcagcacccaccccctgctgctggaggacagccccagctgccccagcctgtatgccaactggctggtgatcctgctgctggtgaccttcctgctggtgaccaacgtgctgctgatgaacctgctgattgccatgttctcctacaccttccaggtggtgcagggcaatgctgacatgttctggaagttccagcgctacaacctgattgtggagtaccacgagaggcctgccctggccccacccttcatcctgctgagccacctgagcctgaccctgcggcgggtcttcaagaaggaggccgagcacaagcgggagcacctggagcgggacctgcctgaccccctggaccagaaggtggtgacctgggagaccgtgcagaaggagaacttcctgagcaagatggagaagagaagaagagattctgagggggaggtgctgaggaagacagcccaccgggtggacttcatcgccaagtacctgggcggcctgcgggagcaggagaagaggatcaagtgcctggagagccagatcaactactgcagcgtgctggtgtcctctgtggctgatgtgctggcccagggcggcggccccaggagcagccagcactgtggggagggcagccagctggtggccgctgaccaccggggcggcctggatggctgggagcagcccggggccggccagcccccaagtgacacctag

SEQ ID NO: 173831 - DNA, 3402 bp, Artificial Sequence
  Description of Artificial Sequence: Synthetic coding sequence
atgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgacatcggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggctgtgattgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagagaccgtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagcccccatcctggagcctggcccgggacatcgtgtttgagccctactggatgatctatggagaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaggaggacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgcggcgctaccggccctttgcccggagccacagcttccgcttccacaaggaggagaagctgatgaagatctgcaagatcaagagcaaggagtag

SEQ ID NO: 173832 - DNA, 912 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgggagtaccaccggggctctgtgacccagagcggctgcaggcctgctgaggtgttccacggcctgccctag

SEQ ID NO: 173833 - DNA, 6069 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgatattggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggccgtcatcgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagaaacagtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagccccccagctggagcctggcccgggacatcgtgtttgagccctactggatgatctacggggaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaagaagacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccaggccaagatcatgcagacaggaggcggctacgtgaactgggccttctctgaaggagatgaaacaggagtcttcagcatcaagaagaagtggcagacctgcctgcccagcacctgtgacagcgacagcagccgctctgagcagcaccagaagcaggcccaggacagcagcctgagtgacaacagcaccaggtctgcccagagcagtgaatgttctgaggtgggcccctggctgcagcccaacaccagcttctggatcaaccccctgcggcgctaccggccctttgcccggagccacagcttccgcttccacaaggaggagaagctgatgaagatctgcaagatcaagaacctgagcggcagcagcgagatcggccagggcgcctgggtgaaggccaagatgctgaccaaggaccggcggctgagcaagaagaagaagaacacccagggcctgcaggtgcccatcatcaccgtgaatgcctgcagccagagcgaccagctgaaccctgagcccggggagaacagcatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgctgaagagcagcattggagtggacaagatcagcgccagcctgaagagcccccaggagccccaccaccactacagcgccattgaaagaaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgaccggggagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggggaggatgccatccggaacttcatcgccaagcaccactgcaacagctgctgcaggaagctgaagctgcctgacctgaagagaaatgactacagccctgagcgcatcaacagcaccttcggcctggagatcaagattgagagcgctgaggagcccccagcccgggagactggaagaaacagcccagaagatgacatgcagctgtag

SEQ ID NO: 173834 - DNA, 6054 bp, Artificial Sequence
  Description of Artificial Sequence: Synthetic coding sequence
atgacagcccctgtgaccagccagaagtcctggatcaagggcgtgtttgacaagcgggagtgcagcaccatcatccccagcagcaagaacccccaccgctgcacccctgtgtgccaggtgtgccagaacctgatccgctgctactgcggccgcctgattggagaccatgctggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcacggcggcatccagaacttcaccatgcccagcaagttcaaggagatcttcagccagggcctggtgaaggctgctgagaccactggagcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgacatcggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggctgtgattgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagagaccgtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagcccccatcctggagcctggcccgggacatcgtgtttgagccctactggatgatctatggagaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaggaggacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccaggccaagatcatgcagacaggaggcggctacgtgaactgggccttctctgaaggagatgagaccggggtcttcagcatcaagaagaagtggcagacctgcctgcccagcacctgtgacagcgacagcagccgctctgagcagcaccagaagcaggcccaggacagcagcctgagtgacaacagcaccaggtctgcccagagcagcgagtgcagcgaggtgggcccctggctgcagcccaacaccagcttctggatcaaccccctgcggcgctaccggccctttgcccggagccacagcttccgcttccacaaggaggagaagctgatgaagatctgcaagatcaagaacctgagcggcagcagcgagatcggccagggcgcctgggtgaaggccaagatgctgaccaaggaccggcggctgagcaagaagaagaagaacacccagggcctgcaggtgcccatcatcaccgtgaatgcctgcagccagagcgaccagctgaaccctgagcctggagaaaattccatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgctgaagagcagcattggagtggacaagatcagcgccagcctgaagagcccccaggagccccaccaccactacagcgccatcgagaggaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgactggagagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggagaagatgccatccggaacttcatcgccaagcaccactgcaacagctgctgcaggaagctgaagctgcctgacctgaagagaaatgactacagccctgagcgcatcaacagcaccttcggcctggagatcaagattgaatctgctgaggagcccccagcccgggagaccggcaggaacagcccagaagatgacatgcagctgtag

SEQ ID NO: 173835 - DNA, 5844 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgatattggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggccgtcatcgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagaaacagtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagccccccagctggagcctggcccgggacatcgtgtttgagccctactggatgatctacggggaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaagaagacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccaggccaagatcatgcagacaggaggcggctacgtgaactgggccttctctgaaggagatgaaacaggagtcttcagcatcaagaagaagtggcagacctgcctgcccagcacctgtgacagcgacagcagccgctctgagcagcaccagaagcaggcccaggacagcagcctgagtgacaacagcaccaggtctgcccagagcagtgaatgttctgaggtgggcccctggctgcagcccaacaccagcttctggatcaaccccctgcggcgctaccggccctttgcccggagccacagcttccgcttccacaaggaggagaagctgatgaagatctgcaagatcaagaacctgagcggcagcagcgagatcggccagggcgcctgggtgaaggccaagatgctgaccaaggaccggcggctgagcaagaagaagaagaacacccagggcctgcaggtgcccatcatcaccgtgaatgcctgcagccagagcgaccagctgaaccctgagcccggggagaacagcatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgcacgtgatcaagatgcccatcagcagcctcatcagcgagatcagcgccagcctgaagagcccccaggagccccaccaccactacagcgccattgaaagaaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgaccggggagttcaggaagtacaacaacaacaatggagatgagatcacccccaccaacaccctggaggagctgatgctggccttcagccactggacctatgagtacaccagaggagagctgctggtgctggacctgcaggccctgtggttctgggacagcatgctgaaggcccggctgggcggctggaggatgtag

SEQ ID NO: 173836 - DNA, 1707 bp, Artificial Sequence
  Description of Artificial Sequence: Synthetic coding sequence
cgggagagcccccacccagccctgctgcagagccagaagtcctggatcaagggcgtgtttgacaagcgggagtgcagcaccatcatccccagcagcaagaacccccaccgctgcacccctgtgtgccaggtgtgccagaacctgatccgctgctactgcggccgcctgattggagaccatgctggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcacggcggcatccagaacttcaccatgcccagcaagttcaaggagatcttcagccagggcctggtgaaggctgctgagaccactggagcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccctggagaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgaccggggagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggggaggatgccatccggaacttcatcgccaagcaccactgcaacagctgctgcaggaagctgaagctgcctgacctgaagagaaatgactacagccctgagcgcatcaacagcaccttcggcctggagatcaagattgagagcgctgaggagcccccagcccgggagactggaagaaacagcccagaagatgacatgcagctgtag

SEQ ID NO: 173837 - DNA, 2580 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcaggacctgagcaagaacagcctgtggaacagccgcagcaccaacctgaacagaaacagcctgcacgtgatcaagatgcccatcagcagcctcatcagcgagatcagcgccagcctgaagagcccccaggagccccaccaccactacagcgccatcgagaggaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgactggagagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggagaagatgccatccggaacttcatcgccaagcaccactgcaacagctgctgcaggaagctgaagctgcctgacctgaagagaaatgactacagccctgagcgcatcaacagcaccttcggcctggagatcaagattgaatctgctgaggagcccccagcccgggagaccggcaggaacagcccagaagatgacatgcagctgtag

SEQ ID NO: 173838 - DNA, 2934 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgatattggcctggtggtggagtacctgattggccgggcctaccgcagcaactacaccaggaagcacttccgggccctgtacaacaacctgtacaggaagtacaagatcatcaccgtgaatgcctgcagccagagcgaccagctgaaccctgagcctggagaaaattccatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgcacgtgatcaagatgcccatcagcagcctcatcagcgagatcagcgccagcctgaagagcccccaggagccccaccaccactacagcgccatcgagaggaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgactggagagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggagaagatgccatccggaacttcatcgccaagcaccactgcaacagctgctgcaggaagctgaagctgcctgacctgaagagaaatgactacagccctgagcgcatcaacagcaccttcggcctggagatcaagattgaatctgctgaggagcccccagcccgggagaccggcaggaacagcccagaagatgacatgcagctgtag

SEQ ID NO: 173839 - DNA, 3402 bp, Artificial Sequence
  Description of Artificial Sequence: Synthetic coding sequence
atgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgacatcggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggctgtgattgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagagaccgtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagcccccatcctggagcctggcccgggacatcgtgtttgagccctactggatgatctatggagaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaggaggacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccgctaccggccctttgcccggagccacagcttccgcttccacaaggaggagaagctgatgaagatctgcaagatcaagagcaaggagtag

SEQ ID NO: 173840 - DNA, 6054 bp, Artificial Sequence
  Description of Artificial Sequence: Synthetic coding sequence
atgatcatcctgagcaagagccagaagtcctggatcaagggcgtgtttgacaagcgggagtgcagcaccatcatccccagcagcaagaacccccaccgctgcacccctgtgtgccaggtgtgccagaacctgatccgctgctactgcggccgcctgattggagaccatgctggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcacggcggcatccagaacttcaccatgcccagcaagttcaaggagatcttcagccagggcctggtgaaggctgctgagaccactggagcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgacatcggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggctgtgattgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagagaccgtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagcccccatcctggagcctggcccgggacatcgtgtttgagccctactggatgatctatggagaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaggaggacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccaggccaagatcatgcagacaggaggcggctacgtgaactgggccttctctgaaggagatgagaccggggtcttcagcatcaagaagaagtggcagacctgcctgcccagcacctgtgacagcgacagcagccgctctgagcagcaccagaagcaggcccaggacagcagcctgagtgacaacagcaccaggtctgcccagagcagcgagtgcagcgaggtgggcccctggctgcagcccaacaccagcttctggatcaaccccctgcggcgctaccggccctttgcccggagccacagcttccgcttccacaaggaggagaagctgatgaagatctgcaagatcaagaacctgagcggcagcagcgagatcggccagggcgcctgggtgaaggccaagatgctgaccaaggaccggcggctgagcaagaagaagaagaacacccagggcctgcaggtgcccatcatcaccgtgaatgcctgcagccagagcgaccagctgaaccctgagcctggagaaaattccatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgctgaagagcagcattggagtggacaagatcagcgccagcctgaagagcccccaggagccccaccaccactacagcgccatcgagaggaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgactggagagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggagaagatgccatccggaacttcatcgccaagcaccactgcaacagctgctgcaggaagctgaagctgcctgacctgaagagaaatgactacagccctgagcgcatcaacagcaccttcggcctggagatcaagattgaatctgctgaggagcccccagcccgggagaccggcaggaacagcccagaagatgacatgcagctgtag

SEQ ID NO: 173841 - DNA, 6081 bp, Artificial Sequence
  Description of Artificial Sequence: Synthetic coding sequence
atgaaggagcagcctgtgctggagcggctgcagagccagaagtcctggatcaagggcgtgtttgacaagagagaatgttccaccatcatccccagcagcaagaacccccaccgctgcacccctgtgtgccaggtgtgccagaacctgatccgctgctactgcggccgcctcatcggggaccacgccggcatcgactacagctggaccatctctgctgccaagggcaaggagagcgagcagtggagcgtggagaagcacaccaccaagagccccacagacaccttcggcaccatcaacttccaggatggagagcacacccaccacgccaagtacatccgcaccagctatgacaccaagctggaccacctgctgcacctgatgctgaaggagtggaagatggagctgcccaagctggtgatctctgtgcatggaggcatccagaacttcaccatgcccagcaagttcaaggagatcttcagccagggcctggtgaaggctgctgagaccaccggggcctggatcatcacagagggcatcaacacaggagtgtccaagcacgtgggagatgccctgaagagccacagcagccacagcctgaggaagatctggacagtgggcatccccccctggggcgtgattgagaaccagagggacctgattggcaaggatgtggtgtgcctgtaccagaccctggacaaccccctgagcaagctgaccaccctgaacagcatgcacagccacttcatcctgagtgatgatggcaccgtgggcaagtatggaaatgagatgaagctgcggaggaacctggagaagtacctgagcctgcagaagatccactgccgcagccggcagggcgtgcctgtggtgggcctggtggtggagggcggccccaacgtcatcctgtctgtgtgggagaccgtgaaggacaaggaccctgtggtggtgtgtgagggcaccggccgggctgctgacctgctggccttcacccacaagcacctggctgatgagggcatgctgcggccccaggtgaaggaggagatcatctgcatgatccagaacaccttcaacttcagcctgaagcagagcaagcacctgttccagatcctgatggagtgcatggtgcaccgggactgcatcaccatctttgatgctgacagcgaggagcagcaggacctggacctggccatcctgacagccctgctgaagggcaccaacctgagcgccagcgagcagctgaacctggccatggcctgggacagagtggacatcgccaagaagcacatcctgatctatgagcagcactggaagccagatgccctggagcaggccatgtctgatgccctggtgatggacagagtggactttgtgaagctgctgattgaatatggagtgaacctgcaccgcttcctgaccatcccccggctggaggagctgtacaacaccaagcagggccccaccaacaccctgctgcaccacctggtgcaggatgtgaagcagcacaccctgctgagcggctaccgcatcaccctgattgatattggcctggtggtggagtacctgattggccgggcctaccgcagcaactacaccaggaagcacttccgggccctgtacaacaacctgtacaggaagtacaagcaccagaggcacagcagcggcaacagaaatgaatctgctgagagcaccctgcacagccagttcatcagaacagcccagccctacaagttcaaggagaagagcatcgtgctgcacaagagcaggaagaagagcaaggagcagaatgtgtctgatgatcctgagagcacaggcttcctgtacccctacaatgacctgctggtgtgggccgtgctgatgaagaggcagaagatggccatgttcttctggcagcacggggaggaggccaccgtgaaggccgtcatcgcctgcatcctgtaccgggccatggcccacgaggccaaggagagccacatggtggatgatgccagcgaggagctgaagaactacagcaagcagtttggccagctggccctggacctgctggagaaggccttcaagcagaatgaaagaatggccatgaccctgctgacctatgagctgaggaactggagcaacagcacctgcctgaagctggccgtgtctgggggcctgcggccctttgtgagccacacctgcacccagatgctgctgacagacatgtggatgggccgcctgaagatgaggaagaacagctggctgaagatcatcatcagcatcatcctgccccccaccatcctgaccctggagttcaagagcaaggccgagatgagccacgtgccccagagccaggacttccagttcatgtggtactacagcgaccagaatgccagcagcagcaaggagagcgcctctgtgaaggagtatgacctggagcggggccatgatgagaagctggatgagaaccagcacttcggcctggagagcggccaccagcacctgccctggaccaggaaggtgtatgagttctacagcgcccccatcgtgaagttctggttctacaccatggcctacctggccttcctgatgctgttcacctacacagtgctggtggagatgcagccccagcccagcgtgcaggagtggctggtgtccatctacatcttcaccaatgccatcgaggtggtgcgggagatctgcatcagcgagcccgggaagttcacccagaaggtgaaggtgtggatcagcgagtactggaacctgacagaaacagtggccatcggcctcttctctgctggctttgtgctgcgctggggagacccccccttccacacagctggccgcctcatctactgcatcgacatcatcttctggttcagccggctgctggacttctttgctgtgaaccagcacgccggcccctacgtgaccatgattgccaagatgacagccaacatgttctacatcgtcatcatcatggccatcgtgctgctgagctttggagtggccaggaaggccatcctgagccccaaggagccccccagctggagcctggcccgggacatcgtgtttgagccctactggatgatctacggggaggtgtatgctggggagattgatgtgtgcagcagccagcccagctgccccccaggcagcttcctgacccccttcctgcaggccgtgtacctgtttgtgcagtacatcatcatggtgaacctgctgattgccttcttcaacaacgtgtacctggacatggagagcatcagcaacaacctgtggaagtacaaccgctaccgctacatcatgacctaccacgagaagccctggctgcccccacccctcatcctgctgagccacgtgggcctgctgctgcggcggctgtgctgccaccgggcccctcatgaccaggaggagggagatgtgggcctgaagctgtacctgagcaaagaagacctgaagaagctgcatgactttgaggagcagtgtgtggagaagtacttccacgagaagatggaggatgtgaactgcagctgtgaggagcgcatccgggtgaccagcgagcgggtgacagagatgtacttccagctgaaggagatgaatgagaaggtgtccttcatcaaggacagcctgctgagcctggacagccaggtgggccacctgcaggacctgagcgccctgactgtggacaccctgaaggtgctgtctgctgtggacaccctgcaggaggatgaggccctgctggccaagaggaagcacagcacctgcaagaagctgccccacagctggagcaatgtcatctgtgccgaggtgctgggctccatggagattgctggggagaagaagtaccagtactacagcatgcccagcagcctgctgcggagcctggccggcggccgccaccccccccgggtgcagagaggagccctgctggagatcaccaacagcaagcgggaggccaccaacgtgagaaatgaccaggagcggcaggagacccagagcagcatcgtggtgtctggagtgagccccaaccggcaggcccacagcaaatatggccagttcctgctggtgcccagcaacctgaagagggtgcccttctctgctgagaccgtgctgcccctgagccggcccagcgtgcctgatgtgctggccacagagcaggacatccagacagaggtgctggtgcacctgaccggccagacccctgtggtgtctgactgggcctctgtggatgagcccaaggagaagcatgagcccatcgcccacctgctggatggccaggacaaggccgagcaggtgctgcccaccctgagctgcaccccagagcccatgaccatgagcagccccctgagccaggccaagatcatgcagacaggaggcggctacgtgaactgggccttctctgaaggagatgaaacaggagtcttcagcatcaagaagaagtggcagacctgcctgcccagcacctgtgacagcgacagcagccgctctgagcagcaccagaagcaggcccaggacagcagcctgagtgacaacagcaccaggtctgcccagagcagtgaatgttctgaggtgggcccctggctgcagcccaacaccagcttctggatcaaccccctgcggcgctaccggccctttgcccggagccacagcttccgcttccacaaggaggagaagctgatgaagatctgcaagatcaagaacctgagcggcagcagcgagatcggccagggcgcctgggtgaaggccaagatgctgaccaaggaccggcggctgagcaagaagaagaagaacacccagggcctgcaggtgcccatcatcaccgtgaatgcctgcagccagagcgaccagctgaaccctgagcccggggagaacagcatcagcgaggaggagtacagcaagaactggttcaccgtgtccaagttcagccacactggagtggagccctacatccaccagaagatgaagaccaaggagatcggccagtgtgccatccagatcagtgactacctgaagcagagccaggaggacctgagcaagaacagcctgtggaacagccgcagcaccaacctgaacagaaacagcctgcacgtgatcaagatgcccatcagcagcctcatcagcgagatcagcgccagcctgaagagcccccaggagccccaccaccactacagcgccattgaaagaaacaacctgatgaggctgagccagaccatccccttcacccctgtgcagctgtttgctggggaggagatcaccgtgtaccgcctggaggagagcagccccctgaacctggacaagtccatgagctcctggagccagaggggccgggccgccatgatccaggtgctgagccgggaggagatggatggcggcctgaggaaggccatgagggtggtgtccacctggagcgaagatgacatcctgaagccaggccaggtgttcatcgtgaagagcttcctgcctgaggtggtgaggacctggcacaagatcttccaggagagcacagtgctgcacctgtgcctgcgggagatccagcagcagagagctgcccagaagctgatctacaccttcaaccaggtgaagccccagaccatcccctacaccccccgcttcctggaggtgttcctgatctactgccacagcgccaaccagtggctgaccatcgagaagtacatgaccggggagttcaggaagtacaacaacaacaatggagatgagatcacccccaccaacaccctggaggagctgatgctggccttcagccactggacctatgagtacaccagaggagagctgctggtgctggacctgcagggcgtgggggagaacctgacagaccccagcgtcatcaagccagaggtgaagcagagccggggcatggtgtttggacctgccaacctgggggaggatgccatccggaacttcatcgccaagcaccactgcaacagctgctgcaggaagctgaagctgcctgacctgaagagaaatgactacagccctgagcgcatcaacagcaccttcggcctggagatcaagattgagagcgctgaggagcccccagcccgggagactggaagaaacagcccagaagatgacatgcagctgtag

SEQ ID NO: 173842 - DNA, 5598 bp, Artificial Sequence
  Description of Artificial Sequence: Synthetic coding sequence
atgagccagaagtcctggattgagagcaccctgaccaagagagaatgtgtgtacatcatccccagcagcaaggacccccaccgctgcctgcccggctgccagatctgccagcagctggtgcgctgcttctgtggccgcctggtgaagcagcacgcctgcttcaccgccagcctggccatgaagtacagtgatgtgaagctgggggaccacttcaaccaggccatcgaggagtggagcgtggagaagcacacagagcagagccccacagatgcctacggcgtcatcaacttccagggcggcagccacagctaccgggccaagtatgtgcggctgtcctatgacaccaagccagaggtgatcctgcagctgctgctgaaggagtggcagatggagctgcccaagctggtgatctctgtgcacggcggcatgcagaagtttgagctgcacccccgcatcaagcagctgctgggcaagggcctcatcaaggctgctgtgaccactggagcctggatcctgactggaggagtgaacacaggagtggccaagcacgtgggagatgccctgaaggagcacgccagccgcagcagcaggaagatctgcaccatcggcatcgccccctggggcgtgattgaaaatagaaatgacctggtgggcagagatgtggtggccccctaccagaccctgctgaaccccctgagcaagctgaatgtgctgaacaacctgcacagccacttcatcctggtggatgatggcaccgtgggcaagtacggggctgaggtgcggctgcggcgggagctggagaagaccatcaaccagcagaggatccacgccagaattggccagggcgtgcctgtggtggccctgatctttgagggcggccccaacgtcatcctgactgtgctggagtacctgcaggagagcccccctgtgcctgtggtggtgtgtgagggcaccggccgggctgctgacctgctggcctacatccacaagcagacagaggagggcggcaacctgcctgatgctgctgagccagacatcatcagcaccatcaagaagaccttcaactttggccagaatgaggccctgcacctgttccagaccctgatggagtgcatgaagaggaaggagctgatcaccgtcttccacatcggcagtgatgagcaccaggacattgatgtggccatcctgacagccctgctgaagggcaccaatgccagcgcctttgaccagctgatcctgaccctggcctgggacagagtggacatcgccaagaaccacgtgtttgtgtatggccagcagtggctggtgggcagcctggagcaggccatgctggatgccctggtgatggacagagtggcctttgtgaagctgctgattgaaaatggagtgtccatgcacaagttcctgaccatcccccggctggaggagctgtacaacaccaagcagggccccaccaaccccatgctgttccacctggtgagagatgtgaagcagggcaacctgcccccaggctacaagatcaccctgattgacatcggcctggtgattgagtacctgatgggcggcacctaccgctgcacctacaccaggaagcgcttccgcctcatctacaacagcctgggcggcaacaacagaagaagtggaagaaacaccagcagcagcaccccccagctgaggaagagccatgagagctttggaaacagagctgacaagaaggagaagatgaggcacaaccacttcatcaagacagcccagccctaccggcccaagattgacacagtgatggaggagggcaagaagaagaggaccaaggatgaaattgtggacattgatgatcctgagaccaagcgcttcccctaccccctgaatgagctgctgatctgggcctgcctgatgaagaggcaggtgatggcccgcttcctgtggcagcacggggaggagagcatggccaaggccctggtggcctgcaagatctaccgctccatggcctatgaggccaagcagagcgacctggtggatgacaccagcgaggagctgaagcagtacagcaatgactttggccagctggccgtggagctgctggagcagagcttccggcaggatgagaccatggccatgaagctgctgacctatgagctgaagaactggagcaacagcacctgcctgaagctggccgtgagcagccggctgcggccctttgtggcccacacctgcacccagatgctgctgagtgacatgtggatgggccgcctgaacatgaggaagaacagctggtacaaggtgatcctgagcatcctggtgcccccagccatcctgctgctggagtacaagaccaaggccgagatgagccacatcccccagagccaggatgcccaccagatgaccatggatgattctgagaacaacttccagaacatcacagaggagatccccatggaggtgttcaaggaggtgcgcatcctggacagcaatgaaggcaagaatgagatggagatccagatgaagagcaagaagctgcccatcaccaggaagttctacgccttctaccacgcccccatcgtgaagttctggttcaacaccctggcctacctgggcttcctgatgctgtacacctttgtggtgctggtgcagatggagcagctgcccagcgtgcaggagtggatcgtcatcgcctacatcttcacctacgccatcgagaaggtgcgggagatcttcatgtctgaggccggcaaggtgaaccagaagatcaaggtgtggttcagtgactacttcaacatcagtgacaccatcgccatcatctccttcttcatcggcttcggcctgcgctttggagccaagtggaactttgccaatgcctatgacaaccacgtgtttgtggccggccgcctcatctactgcctgaacatcatcttctggtacgtgcggctgctggacttcctggccgtgaaccagcaggccggcccctacgtgatgatgattggcaagatggtggccaacatgttctacatcgtggtgatcatggccctggtgctgctgagctttggagtgcccaggaaggccatcctgtacccccatgaggcccccagctggaccctggccaaggacatcgtgttccacccctactggatgatctttggagaggtgtatgcctatgaaattgatgtgtgtgccaatgacagcgtcatcccccagatctgtggccctggcacctggctgacccccttcctgcaggccgtgtacctgtttgtgcagtacatcatcatggtgaacctgctgattgccttcttcaacaacgtgtacctgcaggtgaaggccatcagcaacatcgtgtggaagtaccagcgctaccacttcatcatggcctaccacgagaagcctgtgctgcccccacccctcatcatcctgagccacatcgtgtccctcttctgctgcatctgcaagaggaggaagaaggacaagaccagtgatggccccaagctgttcctgacagaggaggaccagaagaagctgcatgactttgaggagcagtgtgtggagatgtacttcaatgagaaggatgacaagttccacagcggcagcgaggagcgcatccgggtgacctttgagcgggtggagcagatgtgcatccagatcaaggaggtgggggacagagtgaactacatcaagaggagcctgcagagcctggacagccagatcggccacctgcaggacctgagcgccctgactgtggacaccctgaagaccctgacagcccagaaggccagcgaggccagcaaggtgcacaatgagatcacccgggagctgagcatcagcaagcacctggcccagaacctgattgatgatggccctgtgcggcccagcgtgtggaagaagcacggcgtggtgaacaccctgagcagcagcctgccccagggcgacctggagagcaacaaccccttccactgcaacatcctgatgaaggatgacaaggacccccagtgcaacatcttcggccaggacctgcctgctgtgccccagaggaaggagttcaacttccctgaggccggcagcagcagcggggccctcttccccagcgctgtgagccccccagagctgcggcagaggctgcacggcgtggagctgctgaagatcttcaacaagaaccagaagctgggcagcagcagcaccagcatcccccacctgagcagcccccccaccaagttctttgtgtccacccccagccagcccagctgcaagagccacctggagaccggcaccaaggaccaggagaccgtgtgcagcaaggccacagaaggagacaacacagaatttggagcctttgtgggccaccgggacagcatggacctgcagcgcttcaaggagaccagcaacaagatcaagatcctgagcaacaacaacaccagcgagaacaccctgaagagggtgagcagcctggccggcttcacagactgccacaggaccagcatccctgtgcacagcaagcaggccgagaagatcagcagaagacccagcacagaggacacccatgaggtggacagcaaggccgccctgatcccagactggctgcaggaccggcccagcaaccgggagatgcccagcgaggagggcaccctgaatggcctgaccagccccttcaagccagccatggacaccaactactactacagcgctgtggagaggaacaacctgatgaggctgagccagagcatccccttcacccctgtgcccccaagaggagagcctgtgacagtgtaccgcctggaggagagcagccccaacatcctgaacaacagcatgagctcctggagccagctgggcctgtgtgccaagattgagttcctgagcaaggaggagatgggcggcggcctgcggcgggctgtgaaggtgcagtgcacctggagcgagcatgacatcctgaagagcggccacctgtacatcatcaagagcttcctgcctgaggtggtgaacacctggagcagcatctacaaggaggacacagtgctgcacctgtgcctgcgggagatccagcagcagagagctgcccagaagctgacctttgccttcaaccagatgaagcccaagagcatcccctacagcccccgcttcctggaggtgttcctgctgtactgccacagcgctggccagtggtttgctgtggaggagtgcatgaccggggagttcaggaagtacaacaacaacaatggagatgagatcatccccaccaacaccctggaggagatcatgctggccttcagccactggacctatgagtacaccagaggagagctgctggtgctggacctgcagggcgtgggggagaacctgacagaccccagcgtcatcaaggccgaggagaagaggagctgtgacatggtgtttggacctgccaacctgggggaggatgccatcaagaacttccgggccaagcaccactgcaacagctgctgcaggaagctgaagctgcctgacctgaagagaaatgactacaccccagacaagatcatcttcccccaggatgagcccagcgacctgaacctgcagcccggcaacagcaccaaggagagcgagagcaccaacagcgtgcggctgatgctgtag

SEQ ID NO: 173843 - DNA, 3315 bp, Artificial Sequence
  Description of Artificial Sequence: Synthetic coding sequence
atgtccttccgggccgcccggctgtccatgaggaacagaagaaatgacaccctggacagcaccaggaccctgtacagcagcgccagccgcagcacagacctgagctacagcgagagtgacctggtgaacttcatccaggccaacttcaagaagagagaatgtgtgttcttcaccaaggacagcaaggccacagaaaatgtgtgcaagtgtggctacgcccagagccagcacatggagggcacccagatcaaccagagcgagaagtggaactacaagaagcacaccaaggagttccccacagatgcctttggagacatccagtttgagaccctgggcaagaagggcaagtacatccggctgagctgtgacacagatgctgagatcctgtatgagctgctgacccagcactggcacctgaagacccccaacctggtgatctctgtgactggaggagccaagaactttgccctgaagcccaggatgaggaagatcttcagccgcctcatctacatcgcccagagcaaaggagcctggatcctgactggaggcacccactacggcctgatgaagtacatcggggaggtggtgcgggacaacaccatcagccgcagcagtgaagaaaatattgtggccatcggcattgctgcctggggcatggtgagcaacagagacaccctcatccggaactgtgatgctgagggctacttcctggcccagtacctgatggatgacttcacccgggaccccctgtacatcctggacaacaaccacacccacctgctgctggtggacaatggctgccacggccaccccaccgtggaggccaagctgaggaaccagctggagaagtacatcagcgagaggaccatccaggacagcaactatggaggcaagatccccatcgtgtgctttgcccagggcggcggcaaggagaccctgaaggccatcaacaccagcatcaagaacaagatcccctgtgtggtggtggagggcagcggccagattgctgatgtgattgccagcctggtggaggtggaggatgccctgaccagcagcgctgtgaaggagaagctggtgcgcttcctgcccaggacagtgtcccggctgcctgaggaggagacagagagctggatcaagtggctgaaggagatcctggagtgcagccacctgctgaccgtcatcaagatggaggaggccggagatgaaattgtgtccaatgccatctcctatgccctgtacaaggccttcagcaccagcgagcaggacaaggacaactggaatggccagctgaagctgctgctggagtggaaccagctggacctggccaatgatgagatcttcaccaatgaccggcgctgggagagcgctgacctgcaggaggtgatgttcaccgccctgatcaaggaccggcccaagtttgtgcggctcttcctggagaatggcctgaacctgaggaagttcctgacccatgatgtgctgacagagctgttcagcaaccacttcagcaccctggtgtacagaaacctgcagatcgccaagaacagctacaatgatgccctgctgacctttgtgtggaagctggtggccaacttccggcggggcttcaggaaggaggacagaaatggaagagatgagatggacatcgagctgcatgatgtgagccccatcaccaggcaccccctgcaggccctcttcatctgggccatcctgcagaacaagaaggagctgagcaaggtgatctgggagcagacccggggctgcaccctggccgccctgggcgccagcaagctgctgaagaccctggccaaggtgaagaatgacatcaatgctgctggggagagcgaggagctggccaatgaatatgagaccagggctgtggagctgttcacagagtgctacagcagtgatgaggacctggccgagcagctgctggtgtacagctgtgaggcctggggcggcagcaactgcctggagctggccgtggaggccacagaccagcacttcatcgcccagcccggggtgcagaacttcctgagcaagcagtggtatggagagatcagccgggacaccaagaactggaagatcatcctgtgcctcttcatcatccccctggtgggctgcggctttgtgtccttcaggaagaagcctgtggacaagcacaagaagctgctgtggtactacgtggccttcttcaccagcccctttgtggtgttctcctggaatgtggtgttctacatcgccttcctgctgctgtttgcctacgtgctgctgatggacttccacagcgtgccccaccccccagagctggtgctgtacagcctggtgtttgtgctcttctgtgatgaggtgcggcagtggtacgtgaatggagtgaactacttcacagacctgtggaatgtgatggacaccctgggcctcttctacttcatcgccggcatcgtgttccggctgcacagcagcaacaagagcagcctgtacagcggccgggtcatcttctgcctggactacatcatcttcaccctgcggctcatccacatcttcaccgtgtccaggaacctgggccccaagatcatcatgctgcagaggatgctgattgatgtgttcttcttcctgttcctgtttgctgtgtggatggtggcctttggagtggcccggcagggcatcctgcggcagaatgagcagcgctggcgctggatcttccgcagcgtcatctatgagccctacctggccatgtttggccaggtgcccagtgatgtggatggcaccacctatgactttgcccactgcaccttcaccggaaatgaaagcaagcccctgtgtgtggagctggatgagcacaacctgccccgcttccctgagtggatcaccatccccctggtgtgcatctacatgctgagcaccaacatcctgctggtgaacctgctggtggccatgtttggctacacagtgggcaccgtgcaggagaacaatgaccaggtgtggaagttccagcgctacttcctggtgcaggagtactgcagccggctgaacatccccttccccttcatcgtgtttgcctacttctacatggtggtgaagaagtgcttcaagtgctgctgcaaggagaagaacatggagagctctgtgtgctgcttcaagaatgaagataatgagaccctggcctgggagggcgtgatgaaggagaactacctggtgaagatcaacaccaaggccaatgacaccagcgaggagatgaggcaccgcttccggcagctggacaccaagctgaatgacctgaagggcctgctgaaggagatcgccaacaagatcaagtag

SEQ ID NO: 173844 - DNA, 579 bp, Artificial Sequence
  Description of Artificial Sequence: Synthetic coding sequence
atgaagagcttcctgcctgtgcacaccatcgtgctgatcagagaaaatgtgtgcaagtgtggctacgcccagagccagcacatggagggcacccagatcaaccagagcgagaagtggaactacaagaagcacaccaaggagttccccacagatgcctttggagacatccagtttgagaccctgggcaagaagggcaagtacatccggctgagctgtgacacagatgctgagatcctgtatgagctgctgacccagcactggcacctgaagacccccaacctggtgatctctgtgactggaggagccaagaactttgccctgaagcccaggatgaggaagatcttcagccgcctcatctacatcgcccagagcaaaggagcctggatcctgactggaggcacccactacggcctgatgaagtacatcggggaggtggtgcgggacaacaccatcagccgcagcagtgaagaaaatattgtggccatcggcattgctgcctggggcatggtgagcaacagagacaccctcatccggaactgtgatgctgaggtgcctgtgggccaggaggaggtgtgctag

SEQ ID NO: 173845 - DNA, 498 bp, Artificial Sequence
  Description of Artificial Sequence: Synthetic coding sequence
atggagggcacccagatcaaccagagcgagaagtggaactacaagaagcacaccaaggagttccccacagatgccttcggggacatccagtttgagaccctgggcaagaagggcaagtacatccggctgagctgtgacacagatgctgagatcctgtatgagctgctgacccagcactggcacctgaagacccccaacctggtgatctctgtgactggaggagccaagaactttgccctgaagcccaggatgaggaagatcttcagccgcctcatctacatcgcccagagcaagggggcctggatcctgaccggcggcacccactacggcctgatgaagtacatcggggaggtggtgcgggacaacaccatcagccgcagcagcgaggagaacatcgtggccatcggcattgctgcctggggcatggtgagcaacagagacaccctcatccggaactgtgatgctgaggtgcctgtgggccaggaggaggtgtgctag

SEQ ID NO: 173846 - DNA, 2049 bp, Artificial Sequence
  Description of Artificial Sequence: Synthetic coding sequence
atgcaggccatcaacaccagcatcaagaacaagatcccctgtgtggtggtggagggcagcggccagattgctgatgtgattgccagcctggtggaggtggaggatgccctgaccagcagcgctgtgaaggagaagctggtgcgcttcctgcccaggacagtgtcccggctgcctgaggaggagacagagagctggatcaagtggctgaaggagatcctggagtgcagccacctgctgaccgtcatcaagatggaggaggccggagatgaaattgtgtccaatgccatctcctatgccctgtacaaggccttcagcaccagcgagcaggacaaggacaactggaatggccagctgaagctgctgctggagtggaaccagctggacctggccaatgatgagatcttcaccaatgaccggcgctgggagagcgctgacctgcaggaggtgatgttcaccgccctgatcaaggaccggcccaagtttgtgcggctcttcctggagaatggcctgaacctgaggaagttcctgacccatgatgtgctgacagagctgttcagcaaccacttcagcaccctggtgtacagaaacctgcagatcgccaagaacagctacaatgatgccctgctgacctttgtgtggaagctggtggccaacttccggcggggcttcaggaaggaggacagaaatggaagagatgagatggacatcgagctgcatgatgtgagccccatcaccaggcaccccctgcaggccctcttcatctgggccatcctgcagaacaagaaggagctgagcaaggtgatctgggagcagacccggggctgcaccctggccgccctgggcgccagcaagctgctgaagaccctggccaaggtgaagaatgacatcaatgctgctggggagagcgaggagctggccaatgaatatgagaccagggctgtggagctgttcacagagtgctacagcagtgatgaggacctggccgagcagctgctggtgtacagctgtgaggcctggggcggcagcaactgcctggagctggccgtggaggccacagaccagcacttcatcgcccagcccggggtgcagtggtacgtgaatggagtgaactacttcacagacctgtggaatgtgatggacaccctgggcctcttctacttcatcgccggcatcgtgttccggctgcacagcagcaacaagagcagcctgtacagcggccgggtcatcttctgcctggactacatcatcttcaccctgcggctcatccacatcttcaccgtgtccaggaacctgggccccaagatcatcatgctgcagaggatgctgattgatgtgttcttcttcctgttcctgtttgctgtgtggatggtggcctttggagtggcccggcagggcatcctgcggcagaatgagcagcgctggcgctggatcttccgcagcgtcatctatgagccctacctggccatgtttggccaggtgcccagtgatgtggatggcaccacctatgactttgcccactgcaccttcaccggaaatgaaagcaagcccctgtgtgtggagctggatgagcacaacctgccccgcttccctgagtggatcaccatccccctggtgtgcatctacatgctgagcaccaacatcctgctggtgaacctgctggtggccatgtttggctacacagtgggcaccgtgcaggagaacaatgaccaggtgtggaagttccagcgctacttcctggtgcaggagtactgcagccggctgaacatccccttccccttcatcgtgtttgcctacttctacatggtggtgaagaagtgcttcaagtgctgctgcaaggagaagaacatggagagctctgtgtgctgcttcaagaatgaagataatgagaccctggcctgggagggcgtgatgaaggagaactacctggtgaagatcaacaccaaggccaatgacaccagcgaggagatgaggcaccgcttccggcagctggacaccaagctgaatgacctgaagggcctgctgaaggagatcgccaacaagatcaagtag

SEQ ID NO: 173847 - DNA, 2514 bp, Artificial Sequence
  Description of Artificial Sequence: Synthetic coding sequence
atggagaccctgaccccaggccacctgcagcccagccccagcagcccccggccccgggccgcccctggcagcctgggccgggtgacccggcggcggctgagccgctggatcgccctgaccaggaaggtgtcctggaccccagcccggcccagccagagcgccctgctgagccccagccggggccaggagacagcccctcctgtgcccggctgctgccccaggaccctgagccccccagccccccggcggcccagcggctccatgattgctggggtgtccctgaagcccctgctgcgcatcacagcccgcatctggagggcctgctgcagcagctgcagaagagcccggagcaccagccagaccaccagcagcaaggtggccccagccctgggcagcggccgggccccagccctggcctgcccagacccccccctgtgcctgagtgaccctgagaccgggaagacctgcctgctgaaggccatgctgaacctgcatgatggccagaacaccaccatccccctgctgctggagatcgcccggcagacagacagcctgaaggagctggtgaatgccagctacacagacagctactacaagggccagacagccctgcacatcgccatcgagaggaggaacatggccctggtgaccctgctggtggagaatggagcagatgtgcaggccgccgcccatggagacttcttcaagaagaccaagggccggcccggcttctactttggagagctgcccctgagcctggccgcctgcaccaaccagctgggcatcgtgaagttcctgctgcagaacagctggcagacagctgacatcagcgcccgggacagcgtgggcaacacagtgctgcacgccctggtggaggtggccgacaacacagctgacaacaccaagtttgtgacctccatgtacaatgagatcctgatgctgggcgccaagctgcaccccaccctgaagctggaggagctgaccaacaagaagggcatgacccccctggccctggccgccggcaccgggaagattggagtgctggcctacatcctgcagcgggagatccaggagcctgagtgccgccacctgagcaggaagttcacagagtgggcctacggccctgtgcacagcagcctgtatgacctgagctgcatcgacacctgtgagaagaacagcgtgctggaggtgattgcctacagcagcagcgagacccccaacagacatgacatgctgctggtggagcccctgaaccggctgctgcaggacaagtgggacagatttgtgaagaggatcttctacttcaacttcctggtgtactgcctgtacatgatcatcttcaccatggccgcctactacagacctgtggatggcctgccccccttcaagatggagaagacaggagactacttccgggtgactggagagatcctgtctgtgctgggcggcgtgtacttcttcttccggggcatccagtacttcctgcagaggcggcccagcatgaagaccctgtttgtggacagctacagcgagatgctgttcttcctgcagagcctcttcatgctggccaccgtggtgctgtacttcagccacctgaaggagtatgtggcctccatggtgttcagcctggccctgggctggaccaacatgctgtactacacccggggcttccagcagatgggcatctatgctgtgatgattgagaagatgatcctgcgggacctgtgccgcttcatgtttgtgtacatcgtgttcctgtttggcttcagcacagctgtggtgaccctgattgaagatggcaagaatgacagcctgcccagcgagagcaccagccaccgctggaggggccctgcctgccggcccccagacagcagctacaacagcctgtacagcacctgcctggagctgttcaagttcaccatcggcatgggagacctggagttcacagagaactatgacttcaaggctgtgttcatcatcctgctgctggcctacgtgatcctgacctacatcctgctgctgaacatgctgattgccctgatgggagagaccgtgaacaagatcgcccaggagagcaagaacatctggaagctgcagagggccatcaccatcctggacacagagaagagcttcctgaagtgcatgaggaaggccttccgcagcggcaagctgctgcaggtgggctacaccccagatggcaaggatgactaccgctggtgcttccgggtggatgaggtgaactggaccacctggaacaccaacgtgggcatcatcaatgaagaccccggcaactgtgaaggagtgaagaggaccctgtccttcagcctgcggagcagccgggtgtctggccgccactggaagaactttgccctggtgcccctgctgcgggaggccagcgcccgggaccggcagagcgcccagcctgaggaggtgtacctgcggcagttcagcggcagcctgaagccagaagatgctgaggtgttcaagagccctgctgccagcggggagaagtag

SEQ ID NO: 173848 - DNA, 2340 bp, Artificial Sequence
  Description of Artificial Sequence: Synthetic coding sequence
atgaagaagtggagcagcacagacctgggcgctgctgctgaccccctgcagaaggacacctgcccagaccccctggatggagaccccaacagcaggcctcctccagccaagccccagctgagcacagccaagagcaggacccggctgtttgggaagggggacagcgaggaggccttccctgtggactgcccccatgaggagggggagctggacagctgccccaccatcaccgtgtcccctgtgatcaccatccagaggcctggagatggccccaccggggcccggctgctgagccaggacagcgtggccgccagcacagagaagaccctgcggctgtatgacagaagaagcatctttgaagctgtggcccagaacaactgccaggacctggagagcctgctgctcttcctgcagaagagcaagaagcacctgacagacaatgagttcaaggaccctgagaccgggaagacctgcctgctgaaggccatgctgaacctgcatgatggccagaacaccaccatccccctgctgctggagatcgcccggcagacagacagcctgaaggagctggtgaatgccagctacacagacagctactacaagggccagacagccctgcacatcgccatcgagaggaggaacatggccctggtgaccctgctggtggagaatggagcagatgtgcaggccgccgcccatggagacttcttcaagaagaccaagggccggcccggcttctactttggagagctgcccctgagcctggccgcctgcaccaaccagctgggcatcgtgaagttcctgctgcagaacagctggcagacagctgacatcagcgcccgggacagcgtgggcaacacagtgctgcacgccctggtggaggtggccgacaacacagctgacaacaccaagtttgtgacctccatgtacaatgagatcctgatgctgggcgccaagctgcaccccaccctgaagctggaggagctgaccaacaagaagggcatgacccccctggccctggccgccggcaccgggaagattggcaacagacatgacatgctgctggtggagcccctgaaccggctgctgcaggacaagtgggacagatttgtgaagaggatcttctacttcaacttcctggtgtactgcctgtacatgatcatcttcaccatggccgcctactacagacctgtggatggcctgccccccttcaagatggagaagacaggagactacttccgggtgactggagagatcctgtctgtgctgggcggcgtgtacttcttcttccggggcatccagtacttcctgcagaggcggcccagcatgaagaccctgtttgtggacagctacagcgagatgctgttcttcctgcagagcctcttcatgctggccaccgtggtgctgtacttcagccacctgaaggagtatgtggcctccatggtgttcagcctggccctgggctggaccaacatgctgtactacacccggggcttccagcagatgggcatctatgctgtgatgattgagaagatgatcctgcgggacctgtgccgcttcatgtttgtgtacatcgtgttcctgtttggcttcagcacagctgtggtgaccctgattgaagatggcaagaatgacagcctgcccagcgagagcaccagccaccgctggaggggccctgcctgccggcccccagacagcagctacaacagcctgtacagcacctgcctggagctgttcaagttcaccatcggcatgggagacctggagttcacagagaactatgacttcaaggctgtgttcatcatcctgctgctggcctacgtgatcctgacctacatcctgctgctgaacatgctgattgccctgatgggagagaccgtgaacaagatcgcccaggagagcaagaacatctggaagctgcagagggccatcaccatcctggacacagagaagagcttcctgaagtgcatgaggaaggccttccgcagcggcaagctgctgcaggtgggctacaccccagatggcaaggatgactaccgctggtgcttccgggtggatgaggtgaactggaccacctggaacaccaacgtgggcatcatcaatgaagaccccggcaactgtgaaggagtgaagaggaccctgtccttcagcctgcggagcagccgggtgtctggccgccactggaagaactttgccctggtgcccctgctgcgggaggccagcgcccgggaccggcagagcgcccagcctgaggaggtgtacctgcggcagttcagcggcagcctgaagccagaagatgctgaggtgttcaagagccctgctgccagcggggagaagtag

SEQ ID NO: 173849 - DNA, 2520 bp, Artificial Sequence; identical to SEQ ID NO: 173779
  Description of Artificial Sequence: Synthetic coding sequence

SEQ ID NO: 173850 - DNA, 2520 bp, Artificial Sequence; identical to SEQ ID NO: 173779
  Description of Artificial Sequence: Synthetic coding sequence

SEQ ID NO: 173851 - DNA, 2553 bp, Artificial Sequence
  Description of Artificial Sequence: Synthetic coding sequence
atgaagaagtggagcagcacagacctgggcgctgctgctgaccccctgcagaaggacacctgcccagaccccctggatggagaccccaacagcaggcctcctccagccaagccccagctgagcacagccaagagcaggacccggctgtttgggaagggggacagcgaggaggccttccctgtggactgcccccatgaggagggggagctggacagctgccccaccatcaccgtgtcccctgtgatcaccatccagaggcctggagatggccccaccggggcccggctgctgagccaggacagcgtggccgccagcacagagaagaccctgcggctgtatgacagaagaagcatctttgaagctgtggcccagaacaactgccaggacctggagagcctgctgctcttcctgcagaagagcaagaagcacctgacagacaatgagttcaaggaccctgagaccgggaagacctgcctgctgaaggccatgctgaacctgcatgatggccagaacaccaccatccccctgctgctggagatcgcccggcagacagacagcctgaaggagctggtgaatgccagctacacagacagctactacaagggccagacagccctgcacatcgccatcgagaggaggaacatggccctggtgaccctgctggtggagaatggagcagatgtgcaggccgccgcccatggagacttcttcaagaagaccaagggccggcccggcttctactttggagagctgcccctgagcctggccgcctgcaccaaccagctgggcatcgtgaagttcctgctgcagaacagctggcagacagctgacatcagcgcccgggacagcgtgggcaacacagtgctgcacgccctggtggaggtggccgacaacacagctgacaacaccaagtttgtgacctccatgtacaatgagatcctgatgctgggcgccaagctgcaccccaccctgaagctggaggagctgaccaacaagaagggcatgacccccctggccctggccgccggcaccgggaagattggagtgattgaaaatggcccccccctgtccttcatggtgctggcctacatcctgcagcgggagatccaggagccagaatgtcgccacctgagcaggaagttcacagagtgggcctacggccctgtgcacagcagcctgtatgacctgagctgcatcgacacctgtgagaagaacagcgtgctggaggtgattgcctacagcagcagcgagacccccaacagacatgacatgctgctggtggagcccctgaaccggctgctgcaggacaagtgggacagatttgtgaagaggatcttctacttcaacttcctggtgtactgcctgtacatgatcatcttcaccatggccgcctactacagacctgtggatggcctgccccccttcaagatggagaagacaggagactacttccgggtgactggagagatcctgtctgtgctgggcggcgtgtacttcttcttccggggcatccagtacttcctgcagaggcggcccagcatgaagaccctgtttgtggacagctacagcgagatgctgttcttcctgcagagcctcttcatgctggccaccgtggtgctgtacttcagccacctgaaggagtatgtggcctccatggtgttcagcctggccctgggctggaccaacatgctgtactacacccggggcttccagcagatgggcatctatgctgtgatgattgagaagatgatcctgcgggacctgtgccgcttcatgtttgtgtacatcgtgttcctgtttggcttcagcacagctgtggtgaccctgattgaagatggcaagaatgacagcctgcccagcgagagcaccagccaccgctggaggggccctgcctgccggcccccagacagcagctacaacagcctgtacagcacctgcctggagctgttcaagttcaccatcggcatgggagacctggagttcacagaaaattatgacttcaaggctgtgttcatcatcctgctgctggcctacgtgatcctgacctacatcctgctgctgaacatgctgattgccctgatgggagaaacagtgaacaagatcgcccaggagagcaagaacatctggaagctgcagagggccatcaccatcctggacacagagaagagcttcctgaagtgcatgaggaaggccttccgcagcggcaagctgctgcaggtgggctacaccccagatggcaaggatgactaccgctggtgcttccgggtggatgaggtgaactggaccacctggaacaccaacgtgggcatcatcaatgaagatcctggcaactgtgagggcgtgaagaggaccctgtccttcagcctgcggagcagccgggtgtctggccgccactggaagaactttgccctggtgcccctgctgcgggaggccagcgcccgggaccggcagagcgcccagcctgaggaggtgtacctgcggcagttcagcggcagcctgaagccagaagatgctgaggtgttcaagagccctgctgccagcggggagaagtag

SEQ ID NO: 173852 - DNA, 2295 bp, Artificial Sequence
  Description of Artificial Sequence: Synthetic coding sequence
atgaccagccccagcagcagccctgtgttccggctggagaccctggatggcggccaggaggatggcagcgaggccgaccggggcaagctggactttggcagcggcctgccccccatggagagccagttccagggcgaggacaggaagtttgccccccagatccgggtgaacctgaactacaggaagggcaccggggccagccagcctgaccccaacagatttgaccgggacaggctcttcaatgctgtgtcccggggcgtgcctgaggacctggccggcctgcctgagtacctgagcaagaccagcaagtacctgacagacagcgagtacacagagggcagcacaggcaagacctgcctgatgaaggctgtgctgaacctgaaggatggagtgaatgcctgcatcctgcccctgctgcagattgaccgggacagcggcaacccccagcccctggtgaatgcccagtgcacagatgactactaccggggccacagcgccctgcacatcgccatcgagaagaggagcctgcagtgtgtgaagctgctggtggagaatggagccaacgtgcacgcccgggcctgtggccgcttcttccagaagggccagggcacctgcttctactttggagagctgcccctgagcctggccgcctgcaccaagcagtgggatgtggtgtcctacctgctggagaacccccaccagcctgccagcctgcaggccacagacagccagggcaacacagtgctgcacgccctggtgatgatcagtgacaacagcgcagaaaatattgccctggtgacctccatgtatgatggcctgctgcaggccggggcccggctgtgccccaccgtgcagctggaggacatccggaacctgcaggacctgacccccctgaagctggccgccaaggagggcaagattgagatcttccgccacatcctgcagcgggagttcagcggcctgagccacctgagcaggaagttcacagagtggtgctacggccctgtgcgggtgtccctgtatgacctggcctctgtggacagctgtgaagaaaattctgtgctggagatcatcgccttccactgcaagagcccccaccgccacaggatggtggtgctggagcccctgaacaagctgctgcaggccaagtgggacctgctgatccccaagttcttcctgaacttcctgtgcaacctgatctacatgttcatcttcaccgctgtggcctaccaccagcccaccctgaagaagcaggccgccccccacctgaaggccgaggtgggcaacagcatgctgctgaccggccacatcctgatcctgctgggcggcatctacctgctggtgggccagctgtggtacttctggaggagacatgtgttcatctggatctccttcatcgacagctactttgagatcctcttcctgttccaggccctgctgactgtggtgtcccaggtgctgtgcttcctggccatcgagtggtacctgcccctgctggtgtctgccctggtgctgggctggctgaacctgctgtactacacccggggcttccagcacacaggcatctacagcgtgatgatccagaaggtgatcctgcgggacctgctgcgcttcctgctgatctacctggtgttcctgtttggatttgctgtggccctggtgtccctgagccaggaggcctggaggcctgaggcccccaccggccccaatgccacagagagcgtgcagcccatggagggccaggaggatgagggcaatggagcccagtaccggggcatcctggaggccagcctggagctgttcaagttcaccatcggcatgggagagctggccttccaggagcagctgcacttccggggcatggtgctgctgctgctgctggcctacgtgctgctgacctacatcctgctgctgaacatgctgattgccctgatgtctgagaccgtgaacagcgtggccacagacagctggagcatctggaagctgcagaaggccatctctgtgctggagatggagaatggctactggtggtgcaggaagaagcagagagctggggtgatgctgactgtgggcaccaagccagatggcagcccagatgagcgctggtgcttccgggtggaggaggtgaactgggcctcctgggagcagaccctgcccaccctgtgtgaggaccccagcggggccggcgtgcccaggaccctggagaaccctgtgctggccagcccccccaaggaggatgaagatggagcctctgaagaaaattatgtgcctgtgcagctgctgcagagcaactag

SEQ ID NO: 173853 - DNA, 801 bp, Artificial Sequence
  Description of Artificial Sequence: Synthetic coding sequence
tgagacttcagcctgggcgtgcccagctggtggtgcctgatctgcttcaacatcggccccagcgtgggccccagccagcctgaccccaacagatttgaccgggacaggctcttcaatgctgtgtcccggggcgtgcctgaggacctggccggcctgcctgagtacctgagcaagaccagcaagtacctgacagacagcgagtacacagagggcagcacaggcaagacctgcctgatgaaggctgtgctgaacctgaaggatggagtgaatgcctgcatcctgcccctgctgcagattgaccgggacagcggcaacccccagcccctggtgaatgcccagtgcacagatgactactaccggggccacagcgccctgcacatcgccatcgagaagaggagcctgcagtgtgtgaagctgctggtggagaatggagccaacgtgcacgcccgggcctgtggccgcttcttccagaagggccagggcacctgcttctactttggagagctgcccctgagcctggccgcctgcaccaagcagtgggatgtggtgtcctacctgctggagaacccccaccagcctgccagcctgcaggccacagacagccagggcaacacagtgctgcacgccctggtgatgatcagtgacaacagcgcagaaaatattgccctggtgacctccatgtatgatggcctgctgcaggccggggcccggctgtgccccaccgtgcagctggaggacatccggaacctgcaggacctgacccccctgaagctggccgccaaggagggcaagattgaatag

SEQ ID NO: 173854 - DNA, 2373 bp, Artificial Sequence; identical to SEQ ID NO: 173780
  Description of Artificial Sequence: Synthetic coding sequence

SEQ ID NO: 173855 - DNA, 2376 bp, Artificial Sequence
  Description of Artificial Sequence: Synthetic coding sequence
atgaaggcccaccccaaggagatggtgcccctgatgggcaagagggtggccgcccccagcggcaacccagccatcctgcctgagaagaggcctgctgagatcacccccaccaagaagagcgcccacttcttcctggagattgagggctttgagcccaaccccaccgtggccaagaccagcccccctgtgttcagcaagcccatggacagcaacatccggcagtgcatcagcggcaactgtgatgacatggacagcccccagagcccccaggatgatgtgacagagacccccagcaaccccaacagccccagcgcccagctggccaaggaggagcagaggaggaagaagaggcggctgaagaagaggatctttgctgctgtgtctgagggctgtgtggaggagctggtggagctgctggtggagctgcaggagctgtgcagaagaagacatgatgaagatgtgcctgacttcctgatgcacaagctgacagccagtgacaccgggaagacctgcctgatgaaggccctgctgaacatcaaccccaacaccaaggagatcgtgcgcatcctgctggcctttgctgaggagaatgacatcctgggccgcttcatcaatgctgagtacacagaggaggcctatgagggccagacagccctgaacatcgccattgaaagacggcagggcgacattgctgccctgctgattgctgctggagcagatgtgaatgcccacgccaagggggccttcttcaaccccaagtaccagcacgagggcttctactttggagagacccccctggccctggccgcctgcaccaaccagcctgagatcgtgcagctgctgatggagcacgagcagacagacatcaccagccgggacagccggggcaacaacatcctgcacgccctggtgacagtggccgaggacttcaagacccagaatgactttgtgaagaggatgtatgacatgatcctgctgcggagcggcaactgggagctggagaccaccagaaataatgatggcctgacccccctgcagctggccgccaagatgggcaaggccgagatcctgaagtacatcctgagccgggagatcaaggagaagaggctgcggagcctgagcaggaagttcacagactgggcctacggccctgtgagcagcagcctgtatgacctgaccaacgtggacaccaccacagacaacagcgtgctggagatcaccgtgtacaacaccaacatcgacaacagacatgagatgctgaccctggagcccctgcacaccctgctgcacatgaagtggaagaagtttgccaagcacatgttcttcctgtccttctgcttctacttcttctacaacatcaccctgaccctggtgtcctactaccggccccgggaggaggaggccatcccccaccccctggccctgacccacaagatgggctggctgcagctgctgggccgcatgtttgtgctgatctgggccatgtgcatctctgtgaaggagggcatcgccatcttcctgctgcggcccagcgacctgcagagcatcctgagtgatgcctggttccactttgtgttcttcatccaggccgtgctggtgatcctgagcgtcttcctgtacctgtttgcctacaaggagtacctggcctgcctggtgctggccatggccctgggctgggccaacatgctgtactacacccggggcttccagagcatgggcatgtacagcgtgatgatccagaaggtgatcctgcatgatgtgctgaagttcctgtttgtgtacatcgtgttcctgctgggctttggagtggccctggccagcctgattgaaaaatgtcccaaggacaacaaggactgcagcagctatggcagcttcagtgatgctgtgctggagctgttcaagctgaccatcggcctgggggacctgaacatccagcagaacagcaagtaccccatcctcttcctgttcctgctgatcacctacgtgatcctgacctttgtgctgctgctgaacatgctgattgccctgatgggagagaccgtggagaatgtgtccaaggagagcgagcgcatctggaggctgcagagggcccggaccatcctggagtttgagaagatgctgcctgagtggctgcggagccgcttcaggatgggagagctgtgcaaggtggctgaagatgacttccggctgtgcctgcgcatcaatgaggtgaagtggacagagtggaagacccacgtgtccttcctgaatgaagatcctggccctgtgagaagaacagctgacttcaacaagatccaggacagcagcaggaacaacagcaagaccaccctgaatgcctttgaggaggtggaggagttccctgagacctctgtgtag

SEQ ID NO: 173856 - DNA, 2328 bp, Artificial Sequence
  Description of Artificial Sequence: Synthetic coding sequence
atgagccaccacacctggcccagccctgccctgaacctggactttgccacctacctgctgcgggacctgggcgcccacttcttcctggagattgagggctttgagcccaaccccaccgtggccaagaccagcccccctgtgttcagcaagcccatggacagcaacatccggcagtgcatcagcggcaactgtgatgacatggacagcccccagagcccccaggatgatgtgacagagacccccagcaaccccaacagccccagcgcccagctggccaaggaggagcagaggaggaagaagaggcggctgaagaagaggatctttgctgctgtgtctgagggctgtgtggaggagctggtggagctgctggtggagctgcaggagctgtgcagaagaagacatgatgaagatgtgcctgacttcctgatgcacaagctgacagccagtgacaccgggaagacctgcctgatgaaggccctgctgaacatcaaccccaacaccaaggagatcgtgcgcatcctgctggcctttgctgaggagaatgacatcctgggccgcttcatcaatgctgagtacacagaggaggcctatgagggccagacagccctgaacatcgccattgaaagacggcagggcgacattgctgccctgctgattgctgctggagcagatgtgaatgcccacgccaagggggccttcttcaaccccaagtaccagcacgagggcttctactttggagagacccccctggccctggccgcctgcaccaaccagcctgagatcgtgcagctgctgatggagcacgagcagacagacatcaccagccgggacagccggggcaacaacatcctgcacgccctggtgacagtggccgaggacttcaagacccagaatgactttgtgaagaggatgtatgacatgatcctgctgcggagcggcaactgggagctggagaccaccagaaataatgatggcctgacccccctgcagctggccgccaagatgggcaaggccgagatcctgaagtacatcctgagccgggagatcaaggagaagaggctgcggagcctgagcaggaagttcacagactgggcctacggccctgtgagcagcagcctgtatgacctgaccaacgtggacaccaccacagacaacagcgtgctggagatcaccgtgtacaacaccaacatcgacaacagacatgagatgctgaccctggagcccctgcacaccctgctgcacatgaagtggaagaagtttgccaagcacatgttcttcctgtccttctgcttctacttcttctacaacatcaccctgaccctggtgtcctactaccggccccgggaggaggaggccatcccccaccccctggccctgacccacaagatgggctggctgcagctgctgggccgcatgtttgtgctgatctgggccatgtgcatctctgtgaaggagggcatcgccatcttcctgctgcggcccagcgacctgcagagcatcctgagtgatgcctggttccactttgtgttcttcatccaggccgtgctggtgatcctgagcgtcttcctgtacctgtttgcctacaaggagtacctggcctgcctggtgctggccatggccctgggctgggccaacatgctgtactacacccggggcttccagagcatgggcatgtacagcgtgatgatccagaaggtgatcctgcatgatgtgctgaagttcctgtttgtgtacatcgtgttcctgctgggctttggagtggccctggccagcctgattgaaaaatgtcccaaggacaacaaggactgcagcagctatggcagcttcagtgatgctgtgctggagctgttcaagctgaccatcggcctgggggacctgaacatccagcagaacagcaagtaccccatcctcttcctgttcctgctgatcacctacgtgatcctgacctttgtgctgctgctgaacatgctgattgccctgatgggagagaccgtggagaatgtgtccaaggagagcgagcgcatctggaggctgcagagggcccggaccatcctggagtttgagaagatgctgcctgagtggctgcggagccgcttcaggatgggagagctgtgcaaggtggctgaagatgacttccggctgtgcctgcgcatcaatgaggtgaagtggacagagtggaagacccacgtgtccttcctgaatgaagatcctggccctgtgagaagaacagctgacttcaacaagatccaggacagcagcaggaacaacagcaagaccaccctgaatgcctttgaggaggtggaggagttccctgagacctctgtgtag

SEQ ID NO: 173857 - DNA, 2616 bp, Artificial Sequence
  Description of Artificial Sequence: Synthetic coding sequence
atggctgacagcagcgagggcccccgggccggccctggagaggtggccgagctgcctggagatgaaagtggcaccccaggaggagaggccttccccctgagcagcctggccaacctgtttgaaggagaagatggcagcctgagccccagccctgcagatgccagcaggcctgctggccctggagatggccggcccaacctgaggatgaagttccagggcgccttcagaaaaggagtgcccaaccccatcgacctgctggagagcaccctgtatgagagctctgtggtgcccggccccaagaaggcccccatggacagcctgtttgattatggcacctaccgccaccacagcagtgacaacaagcgctggaggaagaagatcatcgagaagcagccccagagccccaaggccccagccccccagcccccacccatcctgaaggtgttcaaccggcccatcctgtttgatattgtgtcccggggcagcacagctgacctggatggcctgctgcccttcctgctgacccacaagaagaggctgacagatgaggagttccgggagcccagcacaggcaagacctgcctgcccaaggccctgctgaacctgagcaatggaagaaatgacaccatccctgtgctgctggacattgctgagaggacaggcaacatgagggagttcatcaacagccccttccgggacatctactaccggggccagacagccctgcacatcgccatcgagcggcgctgcaagcactacgtggagctgctggtggcccagggcgcagatgtgcacgcccaggcccggggccgcttcttccagcccaaggatgaaggaggctacttctactttggagagctgcccctgagcctggccgcctgcaccaaccagccccacatcgtgaactacctgacagagaacccccacaagaaggctgacatgaggcggcaggacagccggggcaacacagtgctgcacgccctggtggccatcgctgacaacacccgggagaacaccaagtttgtgaccaagatgtatgacctgctgctgctgaagtgtgcccggctcttcccagacagcaacctggaggccgtgctgaacaatgatggcctgagccccctgatgatggccgccaagacaggcaagattggcatcttccagcacatcatcagaagagaggtgacagatgaggacaccaggcacctgagcaggaagttcaaggactgggcctacggccctgtgtacagcagcctgtatgacctgagcagcctggacacctgtggggaggaggcctctgtgctggagatcctggtgtacaacagcaagattgagaacagacatgagatgctggccgtggagcccatcaatgagctgctgcgggacaagtggaggaagtttggagctgtgtccttctacatcaacgtggtgtcctacctgtgtgccatggtgatcttcaccctgacagcctactaccagcccctggagggcaccccaccctacccctaccgcaccaccgtggactacctgcggctggccggggaggtgatcaccctcttcaccggggtgctcttcttcttcaccaacatcaaggacctcttcatgaagaagtgccctggggtgaacagcctcttcattgatggcagcttccagctgctgtacttcatctacagcgtgctggtgattgtgtctgctgccctgtacctggccggcatcgaggcctacctggccgtgatggtgtttgccctggtgctgggctggatgaatgccctgtacttcacccggggcctgaagctgaccggcacctacagcatcatgatccagaagatcctcttcaaggacctcttccgcttcctgctggtgtacctgctcttcatgattggctacgccagcgccctggtgtccctgctgaacccctgtgccaacatgaaggtgtgcaatgaagaccagaccaactgcaccgtgcccacctaccccagctgccgggacagcgagaccttcagcaccttcctgctggacctcttcaagctgaccatcggcatgggagacctggagatgctgagcagcaccaagtaccctgtggtgttcatcatcctgctggtgacctacatcatcctgacctttgtgctgctgctgaacatgctgattgccctgatgggagaaacagtgggccaggtgtccaaggagagcaagcacatctggaagctgcagtgggccaccaccatcctggacatcgagaggagcttccctgtgttcctgaggaaggccttccgcagcggggagatggtgacagtgggcaagagcagtgatggcaccccagaccggcgctggtgcttccgggtggatgaggtgaactggagccactggaaccagaacctgggcatcatcaatgaagatcctgggaagaatgagacctaccagtactacggcttcagccacacagtgggccgcctgcggcgggaccgctggagctctgtggtgccccgggtggtggagctgaacaagaacagcaacccagatgaggtggtggtgcccctggacagcatgggcaacccccgctgtgatggccaccagcagggctaccccaggaagtggaggacagatgatgcccccctgtag

SEQ ID NO: 173858 - DNA, 2436 bp, Artificial Sequence
  Description of Artificial Sequence: Synthetic coding sequence
atggctgacagcagcgagggcccccgggccggccctggagaggtggccgagctgcctggagatgaaagtggcaccccaggaggagaggccttccccctgagcagcctggccaacctgtttgaaggagaagatggcagcctgagccccagccctgcagatgccagcaggcctgctggccctggagatggccggcccaacctgaggatgaagttccagggcgccttcagaaaaggagtgcccaaccccatcgacctgctggagagcaccctgtatgagagctctgtggtgcccggccccaagaaggcccccatggacagcctgtttgattatggcacctaccgccaccacagcagtgacaacaagcgctggaggaagaagatcatcgagaagcagccccagagccccaaggccccagccccccagcccccacccatcctgaaggtgttcaaccggcccatcctgtttgatattgtgtcccggggcagcacagctgacctggatggcctgctgcccttcctgctgacccacaagaagaggctgacagatgaggagttccgggagcccagcacaggcaagacctgcctgcccaaggccctgctgaacctgagcaatggaagaaatgacaccatccctgtgctgctggacattgctgagaggacaggcaacatgagggagttcatcaacagccccttccgggacatctactaccggggccagacagccctgcacatcgccatcgagcggcgctgcaagcactacgtggagctgctggtggcccagggcgcagatgtgcacgcccaggcccggggccgcttcttccagcccaaggatgaaggaggctacttctactttggagagctgcccctgagcctggccgcctgcaccaaccagccccacatcgtgaactacctgacagagaacccccacaagaaggctgacatgaggcggcaggacagccggggcaacacagtgctgcacgccctggtggccatcgctgacaacacccgggagaacaccaagtttgtgaccaagatgtatgacctgctgctgctgaagtgtgcccggctcttcccagacagcaacctggaggccgtgctgaacaatgatggcctgagccccctgatgatggccgccaagacaggcaagattggcaacagacatgagatgctggccgtggagcccatcaatgagctgctgcgggacaagtggaggaagtttggagctgtgtccttctacatcaacgtggtgtcctacctgtgtgccatggtgatcttcaccctgacagcctactaccagcccctggagggcaccccaccctacccctaccgcaccaccgtggactacctgcggctggccggggaggtgatcaccctcttcaccggggtgctcttcttcttcaccaacatcaaggacctcttcatgaagaagtgccctggggtgaacagcctcttcattgatggcagcttccagctgctgtacttcatctacagcgtgctggtgattgtgtctgctgccctgtacctggccggcatcgaggcctacctggccgtgatggtgtttgccctggtgctgggctggatgaatgccctgtacttcacccggggcctgaagctgaccggcacctacagcatcatgatccagaagatcctcttcaaggacctcttccgcttcctgctggtgtacctgctcttcatgattggctacgccagcgccctggtgtccctgctgaacccctgtgccaacatgaaggtgtgcaatgaagaccagaccaactgcaccgtgcccacctaccccagctgccgggacagcgagaccttcagcaccttcctgctggacctcttcaagctgaccatcggcatgggagacctggagatgctgagcagcaccaagtaccctgtggtgttcatcatcctgctggtgacctacatcatcctgacctttgtgctgctgctgaacatgctgattgccctgatgggagaaacagtgggccaggtgtccaaggagagcaagcacatctggaagctgcagtgggccaccaccatcctggacatcgagaggagcttccctgtgttcctgaggaaggccttccgcagcggggagatggtgacagtgggcaagagcagtgatggcaccccagaccggcgctggtgcttccgggtggatgaggtgaactggagccactggaaccagaacctgggcatcatcaatgaagatcctgggaagaatgagacctaccagtactacggcttcagccacacagtgggccgcctgcggcgggaccgctggagctctgtggtgccccgggtggtggagctgaacaagaacagcaacccagatgaggtggtggtgcccctggacagcatgggcaacccccgctgtgatggccaccagcagggctaccccaggaagtggaggacagatgatgcccccctgtag

SEQ ID NO: 173859 - DNA, 2475 bp, Artificial Sequence
  Description of Artificial Sequence: Synthetic coding sequence
atggctgacagcagcgagggcccccgggccggccctggagaggtggccgagctgcctggagatgaaagtggcaccccaggaggagaggccttccccctgagcagcctggccaacctgtttgaaggagaagatggcagcctgagccccagccctgcagatgccagcaggcctgctggccctggagatggccggcccaacctgaggatgaagttccagggcgccttcagaaaaggagtgcccaaccccatcgacctgctggagagcaccctgtatgagagctctgtggtgcccggccccaagaaggcccccatggacagcctgtttgattatggcacctaccgccaccacagcagtgacaacaagcgctggaggaagaagatcatcgagaagcagccccagagccccaaggccccagccccccagcccccacccatcctgaaggtgttcaaccggcccatcctgtttgatattgtgtcccggggcagcacagctgacctggatggcctgctgcccttcctgctgacccacaagaagaggctgacagatgaggagttccgggagcccagcacaggcaagacctgcctgcccaaggccctgctgaacctgagcaatggaagaaatgacaccatccctgtgctgctggacattgctgagaggacaggcaacatgagggagttcatcaacagccccttccgggacatctactacagaggagagctgcccctgagcctggccgcctgcaccaaccagccccacatcgtgaactacctgacagagaacccccacaagaaggctgacatgaggcggcaggacagccggggcaacacagtgctgcacgccctggtggccatcgctgacaacacccgggagaacaccaagtttgtgaccaagatgtatgacctgctgctgctgaagtgtgcccggctcttcccagacagcaacctggaggccgtgctgaacaatgatggcctgagccccctgatgatggccgccaagacaggcaagattggcatcttccagcacatcatccggcgggaggtgacagatgaggacaccaggcacctgagcaggaagttcaaggactgggcctacggccctgtgtacagcagcctgtatgacctgagcagcctggacacctgtggggaggaggcctctgtgctggagatcctggtgtacaacagcaagattgaaaatagacatgagatgctggccgtggagcccatcaatgagctgctgcgggacaagtggaggaagtttggagctgtgtccttctacatcaacgtggtgtcctacctgtgtgccatggtgatcttcaccctgacagcctactaccagcccctggagggcaccccaccctacccctaccgcaccaccgtggactacctgcggctggccggggaggtgatcaccctcttcaccggggtgctcttcttcttcaccaacatcaaggacctcttcatgaagaagtgccctggggtgaacagcctcttcattgatggcagcttccagctgctgtacttcatctacagcgtgctggtgattgtgtctgctgccctgtacctggccggcatcgaggcctacctggccgtgatggtgtttgccctggtgctgggctggatgaatgccctgtacttcacccggggcctgaagctgaccggcacctacagcatcatgatccagaagatcctcttcaaggacctcttccgcttcctgctggtgtacctgctcttcatgattggctacgccagcgccctggtgtccctgctgaacccctgtgccaacatgaaggtgtgcaatgaagaccagaccaactgcaccgtgcccacctaccccagctgccgggacagcgagaccttcagcaccttcctgctggacctcttcaagctgaccatcggcatgggagacctggagatgctgagcagcaccaagtaccctgtggtgttcatcatcctgctggtgacctacatcatcctgacctttgtgctgctgctgaacatgctgattgccctgatgggagagaccgtgggccaggtgtccaaggagagcaagcacatctggaagctgcagtgggccaccaccatcctggacatcgagaggagcttccctgtgttcctgaggaaggccttccgctctggagagatggtgacagtgggcaagagcagtgatggcaccccagaccggcgctggtgcttccgggtggatgaggtgaactggagccactggaaccagaacctgggcatcatcaatgaagaccccgggaagaatgagacctaccagtactacggcttcagccacacagtgggccgcctgcggcgggaccgctggagctctgtggtgccccgggtggtggagctgaacaagaacagcaacccagatgaggtggtggtgcccctggacagcatgggcaacccccgctgtgatggccaccagcagggctaccccaggaagtggaggacagatgatgcccccctgtag

SEQ ID NO: 173860 - DNA, 2616 bp, Artificial Sequence; identical to SEQ ID NO: 173857
  Description of Artificial Sequence: Synthetic coding sequence

SEQ ID NO: 173861 - DNA, 2514 bp, Artificial Sequence
  Description of Artificial Sequence: Synthetic coding sequence
atggctgacagcagcgagggcccccgggccggccctggagaggtggccgagctgcctggagatgaaagtggcaccccaggagatggccggcccaacctgaggatgaagttccagggcgccttcagaaaaggagtgcccaaccccatcgacctgctggagagcaccctgtatgagagctctgtggtgcccggccccaagaaggcccccatggacagcctgtttgattatggcacctaccgccaccacagcagtgacaacaagcgctggaggaagaagatcatcgagaagcagccccagagccccaaggccccagccccccagcccccacccatcctgaaggtgttcaaccggcccatcctgtttgatattgtgtcccggggcagcacagctgacctggatggcctgctgcccttcctgctgacccacaagaagaggctgacagatgaggagttccgggagcccagcacaggcaagacctgcctgcccaaggccctgctgaacctgagcaatggaagaaatgacaccatccctgtgctgctggacattgctgagaggacaggcaacatgagggagttcatcaacagccccttccgggacatctactaccggggccagacagccctgcacatcgccatcgagcggcgctgcaagcactacgtggagctgctggtggcccagggcgcagatgtgcacgcccaggcccggggccgcttcttccagcccaaggatgaaggaggctacttctactttggagagctgcccctgagcctggccgcctgcaccaaccagccccacatcgtgaactacctgacagagaacccccacaagaaggctgacatgaggcggcaggacagccggggcaacacagtgctgcacgccctggtggccatcgctgacaacacccgggagaacaccaagtttgtgaccaagatgtatgacctgctgctgctgaagtgtgcccggctcttcccagacagcaacctggaggccgtgctgaacaatgatggcctgagccccctgatgatggccgccaagacaggcaagattggcatcttccagcacatcatcagaagagaggtgacagatgaggacaccaggcacctgagcaggaagttcaaggactgggcctacggccctgtgtacagcagcctgtatgacctgagcagcctggacacctgtggggaggaggcctctgtgctggagatcctggtgtacaacagcaagattgagaacagacatgagatgctggccgtggagcccatcaatgagctgctgcgggacaagtggaggaagtttggagctgtgtccttctacatcaacgtggtgtcctacctgtgtgccatggtgatcttcaccctgacagcctactaccagcccctggagggcaccccaccctacccctaccgcaccaccgtggactacctgcggctggccggggaggtgatcaccctcttcaccggggtgctcttcttcttcaccaacatcaaggacctcttcatgaagaagtgccctggggtgaacagcctcttcattgatggcagcttccagctgctgtacttcatctacagcgtgctggtgattgtgtctgctgccctgtacctggccggcatcgaggcctacctggccgtgatggtgtttgccctggtgctgggctggatgaatgccctgtacttcacccggggcctgaagctgaccggcacctacagcatcatgatccagaagatcctcttcaaggacctcttccgcttcctgctggtgtacctgctcttcatgattggctacgccagcgccctggtgtccctgctgaacccctgtgccaacatgaaggtgtgcaatgaagaccagaccaactgcaccgtgcccacctaccccagctgccgggacagcgagaccttcagcaccttcctgctggacctcttcaagctgaccatcggcatgggagacctggagatgctgagcagcaccaagtaccctgtggtgttcatcatcctgctggtgacctacatcatcctgacctttgtgctgctgctgaacatgctgattgccctgatgggagaaacagtgggccaggtgtccaaggagagcaagcacatctggaagctgcagtgggccaccaccatcctggacatcgagaggagcttccctgtgttcctgaggaaggccttccgcagcggggagatggtgacagtgggcaagagcagtgatggcaccccagaccggcgctggtgcttccgggtggatgaggtgaactggagccactggaaccagaacctgggcatcatcaatgaagatcctgggaagaatgagacctaccagtactacggcttcagccacacagtgggccgcctgcggcgggaccgctggagctctgtggtgccccgggtggtggagctgaacaagaacagcaacccagatgaggtggtggtgcccctggacagcatgggcaacccccgctgtgatggccaccagcagggctaccccaggaagtggaggacagatgatgcccccctgtag

SEQ ID NO: 173862 - DNA, 2436 bp, Artificial Sequence; identical to SEQ ID NO: 173858
  Description of Artificial Sequence: Synthetic coding sequence

SEQ ID NO: 173863 - DNA, 2475 bp, Artificial Sequence; identical to SEQ ID NO: 173859
  Description of Artificial Sequence: Synthetic coding sequence

SEQ ID NO: 173864 - DNA, 2295 bp, Artificial Sequence
  Description of Artificial Sequence: Synthetic coding sequence
atggctgacagcagcgagggcccccgggccggccctggagaggtggccgagctgcctggagatgaaagtggcaccccaggaggagaggccttccccctgagcagcctggccaacctgtttgaaggagaagatggcagcctgagccccagccctgcagatgccagcaggcctgctggccctggagatggccggcccaacctgaggatgaagttccagggcgccttcagaaaaggagtgcccaaccccatcgacctgctggagagcaccctgtatgagagctctgtggtgcccggccccaagaaggcccccatggacagcctgtttgattatggcacctaccgccaccacagcagtgacaacaagcgctggaggaagaagatcatcgagaagcagccccagagccccaaggccccagccccccagcccccacccatcctgaaggtgttcaaccggcccatcctgtttgatattgtgtcccggggcagcacagctgacctggatggcctgctgcccttcctgctgacccacaagaagaggctgacagatgaggagttccgggagcccagcacaggcaagacctgcctgcccaaggccctgctgaacctgagcaatggaagaaatgacaccatccctgtgctgctggacattgctgagaggacaggcaacatgagggagttcatcaacagccccttccgggacatctactacagaggagagctgcccctgagcctggccgcctgcaccaaccagccccacatcgtgaactacctgacagagaacccccacaagaaggctgacatgaggcggcaggacagccggggcaacacagtgctgcacgccctggtggccatcgctgacaacacccgggagaacaccaagtttgtgaccaagatgtatgacctgctgctgctgaagtgtgcccggctcttcccagacagcaacctggaggccgtgctgaacaatgatggcctgagccccctgatgatggccgccaagacaggcaagattggcaacagacatgagatgctggccgtggagcccatcaatgagctgctgcgggacaagtggaggaagtttggagctgtgtccttctacatcaacgtggtgtcctacctgtgtgccatggtgatcttcaccctgacagcctactaccagcccctggagggcaccccaccctacccctaccgcaccaccgtggactacctgcggctggccggggaggtgatcaccctcttcaccggggtgctcttcttcttcaccaacatcaaggacctcttcatgaagaagtgccctggggtgaacagcctcttcattgatggcagcttccagctgctgtacttcatctacagcgtgctggtgattgtgtctgctgccctgtacctggccggcatcgaggcctacctggccgtgatggtgtttgccctggtgctgggctggatgaatgccctgtacttcacccggggcctgaagctgaccggcacctacagcatcatgatccagaagatcctcttcaaggacctcttccgcttcctgctggtgtacctgctcttcatgattggctacgccagcgccctggtgtccctgctgaacccctgtgccaacatgaaggtgtgcaatgaagaccagaccaactgcaccgtgcccacctaccccagctgccgggacagcgagaccttcagcaccttcctgctggacctcttcaagctgaccatcggcatgggagacctggagatgctgagcagcaccaagtaccctgtggtgttcatcatcctgctggtgacctacatcatcctgacctttgtgctgctgctgaacatgctgattgccctgatgggagagaccgtgggccaggtgtccaaggagagcaagcacatctggaagctgcagtgggccaccaccatcctggacatcgagaggagcttccctgtgttcctgaggaaggccttccgctctggagagatggtgacagtgggcaagagcagtgatggcaccccagaccggcgctggtgcttccgggtggatgaggtgaactggagccactggaaccagaacctgggcatcatcaatgaagaccccgggaagaatgagacctaccagtactacggcttcagccacacagtgggccgcctgcggcgggaccgctggagctctgtggtgccccgggtggtggagctgaacaagaacagcaacccagatgaggtggtggtgcccctggacagcatgggcaacccccgctgtgatggccaccagcagggctaccccaggaagtggaggacagatgatgcccccctgtag

SEQ ID NO: 173865 - DNA, 2190 bp, Artificial Sequence
  Description of Artificial Sequence: Synthetic coding sequence
atgggcggcttcctgcccaaggccgagggccctggcagccagctgcagaagctgctgcccagcttcctggtgcgggagcaggactgggaccagcacctggacaagctgcacatgctgcagcagaagaggatcctggagagccccctgctgcgggccagcaaagaaaatgacctgtctgtgctgcggcagctgctgctggactgcacctgtgatgtgcggcagagaggagccctgggggagacagccctgcacatcgccgccctgtatgacaacctggaggccgccctggtgctgatggaggccgcccctgagctggtgtttgagcccaccacctgtgaggcctttgctggccagacagccctgcacatcgctgtggtgaaccagaatgtgaacctggtgcgggccctgctgacccggcgggcctctgtgtctgcccgggccaccggcacagccttcagaagaagccccaggaacctgatctactttggagagcaccccctgagctttgctgcctgtgtgaacagcgaggagatcgtgcggctgctgattgaacatggagctgacatccgggcccaggacagcctgggcaacacagtgctgcacatcctgatcctgcagcccaacaagacctttgcctgccagatgtacaacctgctgctgtcctatgatggccatggagaccacctgcagcccctggacctggtgcccaaccaccagggcctgacccccttcaagctggccggcgtggagggcaacacagtgatgttccagcacctgatgcagaagagaagacacatccagtggacctacggccccctgaccagcatcctgtatgacctgacagaaattgacagctggggcgaggagctgtccttcctggagctggtggtgtccagtgacaagcgggaggcccggcagatcctggagcagacccctgtgaaggagctggtgtccttcaagtggaacaagtatggccggccctacttctgcatcctggccgccctgtacctgctgtacatgatctgcttcaccacctgctgcgtgtaccggcccctgaagttccggggcggcaacagaacccacagccgggacatcaccatcctgcagcagaagctgctgcaggaggcctatgagacccgggaggacatcatccggctggtgggggagctggtgtccatcgtgggcgccgtcatcatcctgctgctggagatcccagacatcttccgggtgggcgccagccgctactttgggaagaccatcctgggcggccccttccacgtgatcatcatcacctacgccagcctggtgctggtgaccatggtgatgaggctgaccaacaccaacggggaggtggtgcccatgagctttgccctggtgctgggctggtgcagcgtgatgtacttcacccggggcttccagatgctgggccccttcaccatcatgatccagaagatgatctttggagacctgatgaggttctgctggctgatggctgtggtgatcctgggctttgccagcgccttctacatcatcttccagacagaggaccccaccagcctgggccagttctatgactaccccatggccctcttcaccacctttgagctgttcctgactgtgattgatgccccagccaactatgatgtggacctgcccttcatgttcagcatcgtgaactttgcctttgccatcatcgccaccctgctgatgctgaacctcttcatcgccatgatgggagacacccactggagggtggcccaggagagagatgagctgtggagggcccaggtggtggccaccaccgtgatgctggagaggaagctgccccgctgcctgtggcccaggagcggcatctgtggctgtgaatttggcctgggggaccgctggttcctgcgggtggagaaccacaatgaccagaaccccctgcgggtgctgcgctacgtggaggtgttcaagaacagcgacaaggaggatgaccaggagcaccccagcgagaagcagcccagcggggctgagagcggcaccctggcccgggccagcctggccctgcccaccagcagcctgagcaggacagccagccagagcagcagccaccggggctgggagatcctgcggcagaacaccctgggccacctgaacctgggcctgaacctgtctgaaggagatggagaggaggtgtaccacttctag

SEQ ID NO: 173866 - DNA, 1146 bp, Artificial Sequence
  Description of Artificial Sequence: Synthetic coding sequence
atgggcggcttcctgcccaaggccgagggccctggcagccagctgcagaagctgctgcccagcttcctggtgcgggagcaggactgggaccagcacctggacaagctgcacatgctgcagcagaagaggatcctggagagccccctgctgcgggccagcaaagaaaatgacctgtctgtgctgcggcagctgctgctggactgcacctgtgatgtgcggcagagaggagccctgggggagacagccctgcacatcgccgccctgtatgacaacctggaggccgccctggtgctgatggaggccgcccctgagctggtgtttgagcccaccacctgtgaggcctttgctggccagacagccctgcacatcgctgtggtgaaccagaatgtgaacctggtgcgggccctgctgacccggcgggcctctgtgtctgcccgggccaccggcacagccttcagaagaagccccaggaacctgatctactttggagagcaccccctgagctttgctgcctgtgtgaacagcgaggagatcgtgcggctgctgattgaacatggagctgacatccgggcccaggacagcctgggcaacacagtgctgcacatcctgatcctgcagcccaacaagacctttgcctgccagatgtacaacctgctgctgtcctatgatggccatggagaccacctgcagcccctggacctggtgcccaaccaccagggcctgacccccttcaagctggccggcgtggagggcaacacagtgatgttccagcacctgatgcagaagagaagacacatccagtggacctacggccccctgaccagcatcctgtatgacctgacagaaattgacagctggggcgaggagctgtccttcctggagctggtggtgtccagtgacaagcgggaggcccggcagatcctggagcagacccctgtgaaggagctggtgtccttcaagtggaacaagtatggccggccctacttctgcatcctggccgccctgtacctgctgtacatgatctgcttcaccacctgctgcgtgtaccggcccctgaagttccggggcggcaacagaacccacagccgggacatcaccatcctgcagcagaagctgctgcaggtgatcctgctgcggcggggctag

SEQ ID NO: 173867 - DNA, 1674 bp, Artificial Sequence
  Description of Artificial Sequence: Synthetic coding sequence
atgggcctgagcctgcccaaggagaagggcctcatcctgtgcctgtggagcaagttctgccgctggttccaggacagcctgggcaacacagtgctgcacatcctgatcctgcagcccaacaagacctttgcctgccagatgtacaacctgctgctgtcctatgacagacatggagaccacctgcagcccctggacctggtgcccaaccaccagggcctgacccccttcaagctggccggcgtggagggcaacacagtgatgttccagcacctgatgcagaagaggaagcacacccagtggacctacggccccctgaccagcaccctgtatgacctgacagaaattgacagcagtggagatgagcagagcctgctggagctgatcatcaccaccaagaagcgggaggcccggcagatcctggaccagacccctgtgaaggagctggtgtccctgaagtggaagagatatggccggccctacttctgcatgctgggcgccatctacctgctgtacatcatctgcttcaccatgtgctgcatctaccggcccctgaagcccaggaccaacaacagaaccagcccccgggacaacaccctgctgcagcagaagctgctgcaggaggcctacatgacccccaaggatgacatccggctggtgggggagctggtgaccgtcatcggggccatcatcatcctgctggtggaggtgcctgacatcttcaggatgggcgtgacccgcttcttcggccagaccatcctgggcggccccttccacgtgctgatcatcacctacgccttcatggtgctggtgaccatggtgatgaggctcatcagcgccagcggggaggtggtgcccatgagctttgccctggtgctgggctggtgcaatgtgatgtactttgcccggggcttccagatgctgggccccttcaccatcatgatccagaagatgatctttggagacctgatgaggttctgctggctgatggctgtggtgatcctgggctttgccagcgccttctacatcatcttccagacagaagatcctgaggagctgggccacttctatgactaccccatggccctcttcagcacctttgagctgttcctgaccatcattgatggccctgccaactacaacgtggacctgcccttcatgtacagcatcacctacgccgcctttgccatcatcgccaccctgctgatgctgaacctgctgattgccatgatgggagacacccactggagggtggcccacgagagagatgagctgtggagggcccagatcgtggccaccaccgtgatgctggagaggaagctgccccgctgcctgtggcccaggagcggcatctgtggccgggagtatggcctgggggaccgctggttcctgcgggtggaggaccggcaggacctgaaccggcagaggatccagagatatgcccaggccttccacacccggggcagcgaggacctggacaaggacagcgtggagaagctggagctgggctgccccttcagcccccacctgagcctgcccatgcccagcgtgagccgcagcaccagccgcagcagcgccaactgggagcggctgcggcagggcaccctgcggcgggacctgcggggcatcatcaacagaggcctggaggatggagagagctgggagtaccagatctag

SEQ ID NO: 173868 - DNA, 2178 bp, Artificial Sequence
  Description of Artificial Sequence: Synthetic coding sequence
atgggcctgagcctgcccaaggagaagggcctcatcctgtgcctgtggagcaagttctgccgctggttccagaggcgggagagctgggcccagagcagagatgagcagaacctgctgcagcagaagaggatctgggagagccccctgctgctggccgccaaggacaatgatgtgcaggccctgaacaagctgctgaagtatgaggactgcaaggtgcaccagagaggagccatgggagaaacagccctgcacatcgccgccctgtatgacaacctggaggccgccatggtgctgatggaggccgcccctgagctggtgtttgagcccatgaccagcgagctgtatgagggccagacagccctgcacatcgctgtggtgaaccagaacatgaacctggtgcgggccctgctggcccggcgggcctctgtgtctgcccgggccaccggcacagccttcagaagaagcccctgcaacctgatctactttggagagcaccccctgagctttgctgcctgtgtgaacagcgaggagatcgtgcggctgctgattgaacatggagctgacatccgggcccaggacagcctgggcaacacagtgctgcacatcctgatcctgcagcccaacaagacctttgcctgccagatgtacaacctgctgctgtcctatgacagacatggagaccacctgcagcccctggacctggtgcccaaccaccagggcctgacccccttcaagctggccggcgtggagggcaacacagtgatgttccagcacctgatgcagaagaggaagcacacccagtggacctacggccccctgaccagcaccctgtatgacctgacagaaattgacagcagtggagatgagcagagcctgctggagctgatcatcaccaccaagaagcgggaggcccggcagatcctggaccagacccctgtgaaggagctggtgtccctgaagtggaagagatatggccggccctacttctgcatgctgggcgccatctacctgctgtacatcatctgcttcaccatgtgctgcatctaccggcccctgaagcccaggaccaacaacagaaccagcccccgggacaacaccctgctgcagcagaagctgctgcaggaggcctacatgacccccaaggatgacatccggctggtgggggagctggtgaccgtcatcggggccatcatcatcctgctggtggaggtgcctgacatcttcaggatgggcgtgacccgcttcttcggccagaccatcctgggcggccccttccacgtgctgatcatcacctacgccttcatggtgctggtgaccatggtgatgaggctcatcagcgccagcggggaggtggtgcccatgagctttgccctggtgctgggctggtgcaatgtgatgtactttgcccggggcttccagatgctgggccccttcaccatcatgatccagaagatgatctttggagacctgatgaggttctgctggctgatggctgtggtgatcctgggctttgccagcgccttctacatcatcttccagacagaagatcctgaggagctgggccacttctatgactaccccatggccctcttcagcacctttgagctgttcctgaccatcattgatggccctgccaactacaacgtggacctgcccttcatgtacagcatcacctacgccgcctttgccatcatcgccaccctgctgatgctgaacctgctgattgccatgatgggagacacccactggagggtggcccacgagagagatgagctgtggagggcccagatcgtggccaccaccgtgatgctggagaggaagctgccccgctgcctgtggcccaggagcggcatctgtggccgggagtatggcctgggggaccgctggttcctgcgggtggaggaccggcaggacctgaaccggcagaggatccagagatatgcccaggccttccacacccggggcagcgaggacctggacaaggacagcgtggagaagctggagctgggctgccccttcagcccccacctgagcctgcccatgcccagcgtgagccgcagcaccagccgcagcagcgccaactgggagcggctgcggcagggcaccctgcggcgggacctgcggggcatcatcaacagaggcctggaggatggagagagctgggagtaccagatctag

SEQ ID NO: 173869 - DNA, 168 bp, Artificial Sequence
  Description of Artificial Sequence: Synthetic coding sequence
atgagcaccagcaggaagctgaagagccacggcatgagaagaagcaagagccgcagcccccacaagggcgtgaagagaggaggcagcaagaggaagtacagaaaaggaaacctgaagagcaggaagagaggagatgatgccaacagaaactaccgcagccacctgtag

SEQ ID NO: 173870 - DNA, 417 bp, Artificial Sequence
  Description of Artificial Sequence: Synthetic coding sequence
atggacacccagacccacagcctgcccatcacccacacccagctgcacagcaacagccagccccagagcaggacctgcaccaggcactgccagaccttcagccagagctgccggcagagccaccggggcagccgcagccagagcagcagccagagccctgccagccacaggaaccccaccggggcccacagcagcagcggccaccagagccagagccccaacaccagccccccacccaagaggcacaagaagaccatgaacagccaccacagccccatgaggcccaccatcctgcactgccgctgccccaagaacaggaagaacctggagggcaagctgaagaagaagaagatggccaagaggatccagcaggtgtacaagaccaagaccaggagcagcggctggaagagcaactag

SEQ ID NO: 173871 - DNA, 1731 bp, Artificial Sequence
  Description of Artificial Sequence: Synthetic coding sequence
atggctgtgctcttcttccacaccatgagatacaagagccaggaccccaggaacccccacaatgacagatttgtgctgagcaagggccatgctgcccccatcctgtatgctgtgtgggccgaggccggcttcctggccgaggccgagctgctgaacctgaggaagatcagcagtgacctggatggccaccctgtgcccaagcaggccttcacagatgtggccaccggcagcctgggccagggcctgggcgccgcctgtggcatggcctacacaggcaagtactttgacaaggccagctacagagtgtactgcctgctgggagatggagagctgtctgagggctctgtgtgggaggccatggcctttgccagcatctacaagctggacaacctggtggccatcctggacatcaaccggctgggccagagcgaccctgcccccctgcagcaccagatggacatctaccagaagagatgtgaggccttcggctggcacgccatcatcgtggatggccacagcgtggaggagctgtgcaaggccttcggccaggccaagcaccagcccacagccatcatcgccaagaccttcaagggccggggcatcaccggggtggaggacaaggagagctggcacggcaagcccctgcccaagaacatggccgagcagatcatccaggagatctacagccagatccagagcaagaagaagatcctggccaccccaccccaggaggatgcccccagcgtggacatcgccaacatccgcatgcccagcctgcccagctacaaggtgggggacaagatcgccaccaggaaggcctacggccaggccctggccaagctgggccacgccagtgaccgcatcatcgccctggatggagacaccaagaacagcaccttcagcgagatcttcaagaaggagcacccagaccgcttcatcgagtgctacatcgccgagcagaacatggtgtccattgctgtgggctgtgccaccaggaacagaacagtgcccttctgcagcacctttgctgccttcttcacccgggcctttgaccagatccgcatggccgccatcagcgagagcaacatcaacctgtgtggcagccactgcggcgtgtccatcggggaggatggccccagccagatggccctggaggacctggccatgttccgctctgtgcccaccagcacagtgttctaccccagtgatggagtggccacagagaaggctgtggagctggccgccaacaccaagggcatctgcttcatccgcaccagcaggccagaaaatgccatcatctacaacaacaatgaagacttccaggtgggccaggccaaggtggtgctgaagagcaaggatgaccaggtgacagtgattggagctggggtgaccctgcacgaggccctggccgctgctgagctgctgaagaaggagaagatcaacatccgggtgctggaccccttcaccatcaagcccctggacaggaagctgatcctggacagcgcccgggccaccaagggccgcatcctgactgtggaggaccactactatgaaggaggcattggagaggccgtgtcctctgctgtggtgggggagcccggcatcaccgtgacccacctggccgtgaacagagtgcccaggtctgggaagccagctgagctgctgaagatgtttggcatcgacagagatgccatcgcccaggccgtgcggggcctcatcaccaaggcctag

SEQ ID NO: 173872 - DNA, 1374 bp, Artificial Sequence
  Description of Artificial Sequence: Synthetic coding sequence
atggcctttgccagcatctacaagctggacaacctggtggccatcctggacatcaaccggctgggccagagcgaccctgcccccctgcagcaccagatggacatctaccagaagagatgtgaggccttcggctggcacgccatcatcgtggatggccacagcgtggaggagctgtgcaaggccttcggccaggccaagcaccagcccacagccatcatcgccaagaccttcaagggccggggcatcactggagtggaggacaaggagagctggcacggcaagcccctgcccaagaacatggccgagcagatcatccaggagatctacagccagatccagagcaagaagaagatcctggccaccccaccccaggaggatgcccccagcgtggacatcgccaacatccgcatgcccagcctgcccagctacaaggtgggggacaagatcgccaccaggaaggcctacggccaggccctggccaagctgggccacgccagtgaccgcatcatcgccctggatggagacaccaagaacagcaccttcagcgagatcttcaagaaggagcacccagaccgcttcatcgagtgctacatcgccgagcagaacatggtgtccattgctgtgggctgtgccaccaggaacagaacagtgcccttctgcagcacctttgctgccttcttcacccgggcctttgaccagatccgcatggccgccatcagcgagagcaacatcaacctgtgtggcagccactgcggcgtgtccattggagaagatggccccagccagatggccctggaggacctggccatgttccgctctgtgcccaccagcaccgtcttctaccccagtgatggagtggccacagagaaggctgtggagctggccgccaacaccaagggcatctgcttcatccgcaccagcaggccagaaaatgccatcatctacaacaacaatgaagacttccaggtgggccaggccaaggtggtgctgaagagcaaggatgaccaggtgaccgtcatcggggccggcgtgaccctgcacgaggccctggccgctgctgagctgctgaagaaggagaagatcaacatccgggtgctggaccccttcaccatcaagcccctggacaggaagctgatcctggacagcgcccgggccaccaagggccgcatcctgactgtggaggaccactactatgagggcggcatcggggaggccgtgagcagcgctgtggtgggggagcccggcatcaccgtgacccacctggccgtgaacagagtgcccaggtctgggaagccagctgagctgctgaagatgtttggaattgacagagatgccatcgcccaggccgtgcggggcctcatcaccaaggcctag

SEQ ID NO: 173873 - DNA, 1872 bp, Artificial Sequence
  Description of Artificial Sequence: Synthetic coding sequence
atggagagctaccacaagccagaccagcagaagctgcaggccctgaaggacacagccaaccggctgcgcatcagcagcatccaggccaccacagctgctggcagcggccaccccaccagctgctgcagcgctgctgagatcatggctgtgctcttcttccacaccatgagatacaagagccaggaccccaggaacccccacaatgacagatttgtgctgagcaaaggacatgctgcccccatcctgtatgctgtgtgggccgaggccggcttcctggccgaggccgagctgctgaacctgaggaagatcagcagtgacctggatggccaccctgtgcccaagcaggccttcacagatgtggccaccggcagcctgggccagggcctgggcgccgcctgtggcatggcctacaccgggaagtactttgacaaggccagctacagagtgtactgcctgctgggagatggagagctgtctgagggctctgtgtgggaggccatggcctttgccagcatctacaagctggacaacctggtggccatcctggacatcaaccggctgggccagagcgaccctgcccccctgcagcaccagatggacatctaccagaagagatgtgaggccttcggctggcacgccatcatcgtggatggccacagcgtggaggagctgtgcaaggccttcggccaggccaagcaccagcccacagccatcatcgccaagaccttcaagggccggggcatcactggagtggaggacaaggagagctggcacggcaagcccctgcccaagaacatggccgagcagatcatccaggagatctacagccagatccagagcaagaagaagatcctggccaccccaccccaggaggatgcccccagcgtggacatcgccaacatccgcatgcccagcctgcccagctacaaggtgggggacaagatcgccaccaggaaggcctacggccaggccctggccaagctgggccacgccagtgaccgcatcatcgccctggatggagacaccaagaacagcaccttcagcgagatcttcaagaaggagcacccagaccgcttcatcgagtgctacatcgccgagcagaacatggtgtccattgctgtgggctgtgccaccaggaacagaacagtgcccttctgcagcacctttgctgccttcttcacccgggcctttgaccagatccgcatggccgccatcagcgagagcaacatcaacctgtgtggcagccactgcggcgtgtccattggagaagatggccccagccagatggccctggaggacctggccatgttccgctctgtgcccaccagcaccgtcttctaccccagtgatggagtggccacagagaaggctgtggagctggccgccaacaccaagggcatctgcttcatccgcaccagcaggccagaaaatgccatcatctacaacaacaatgaagacttccaggtgggccaggccaaggtggtgctgaagagcaaggatgaccaggtgaccgtcatcggggccggcgtgaccctgcacgaggccctggccgctgctgagctgctgaagaaggagaagatcaacatccgggtgctggaccccttcaccatcaagcccctggacaggaagctgatcctggacagcgcccgggccaccaagggccgcatcctgactgtggaggaccactactatgagggcggcatcggggaggccgtgagcagcgctgtggtgggggagcccggcatcaccgtgacccacctggccgtgaacagagtgcccaggtctgggaagccagctgagctgctgaagatgtttggaattgacagagatgccatcgcccaggccgtgcggggcctcatcaccaaggcctag

SEQ ID NO: 173874 - DNA, 1872 bp, Artificial Sequence; identical to SEQ ID NO: 173873
  Description of Artificial Sequence: Synthetic coding sequence

SEQ ID NO: 173875 - DNA, 1896 bp, Artificial Sequence
  Description of Artificial Sequence: Synthetic coding sequence
atggagagctaccacaagccagaccagcagaagctgcaggccctgaaggacacagccaaccggctgcgcatcagcagcatccaggccaccacagctgctggcagcggccaccccaccagctgctgcagcgctgctgagatcatggctgtgctcttcttccacaccatgagatacaagagccaggaccccaggaacccccacaatgacagatttgtgctgagcaaaggacatgctgcccccatcctgtatgctgtgtgggccgaggccggcttcctggccgaggccgagctgctgaacctgaggaagatcagcagtgacctggatggccaccctgtgcccaagcaggccttcacagatgtggccaccggcagcctgggccagggcctgggcgccgcctgtggcatggcctacaccgggaagtactttgacaaggccagcctgcccagctcctgggactacagctacagagtgtactgcctgctgggagatggagagctgtctgagggctctgtgtgggaggccatggcctttgccagcatctacaagctggacaacctggtggccatcctggacatcaaccggctgggccagagcgaccctgcccccctgcagcaccagatggacatctaccagaagagatgtgaggccttcggctggcacgccatcatcgtggatggccacagcgtggaggagctgtgcaaggccttcggccaggccaagcaccagcccacagccatcatcgccaagaccttcaagggccggggcatcactggagtggaggacaaggagagctggcacggcaagcccctgcccaagaacatggccgagcagatcatccaggagatctacagccagatccagagcaagaagaagatcctggccaccccaccccaggaggatgcccccagcgtggacatcgccaacatccgcatgcccagcctgcccagctacaaggtgggggacaagatcgccaccaggaaggcctacggccaggccctggccaagctgggccacgccagtgaccgcatcatcgccctggatggagacaccaagaacagcaccttcagcgagatcttcaagaaggagcacccagaccgcttcatcgagtgctacatcgccgagcagaacatggtgtccattgctgtgggctgtgccaccaggaacagaacagtgcccttctgcagcacctttgctgccttcttcacccgggcctttgaccagatccgcatggccgccatcagcgagagcaacatcaacctgtgtggcagccactgcggcgtgtccattggagaagatggccccagccagatggccctggaggacctggccatgttccgctctgtgcccaccagcaccgtcttctaccccagtgatggagtggccacagagaaggctgtggagctggccgccaacaccaagggcatctgcttcatccgcaccagcaggccagaaaatgccatcatctacaacaacaatgaagacttccaggtgggccaggccaaggtggtgctgaagagcaaggatgaccaggtgaccgtcatcggggccggcgtgaccctgcacgaggccctggccgctgctgagctgctgaagaaggagaagatcaacatccgggtgctggaccccttcaccatcaagcccctggacaggaagctgatcctggacagcgcccgggccaccaagggccgcatcctgactgtggaggaccactactatgagggcggcatcggggaggccgtgagcagcgctgtggtgggggagcccggcatcaccgtgacccacctggccgtgaacagagtgcccaggtctgggaagccagctgagctgctgaagatgtttggaattgacagagatgccatcgcccaggccgtgcggggcctcatcaccaaggcctag

SEQ ID NO: 173876 - DNA, 1182 bp, Artificial Sequence
  Description of Artificial Sequence: Synthetic coding sequence
atggccctgaaggtggccaccgtggccggcagcgctgccaaggctgtgctgggccctgccctgctgtgccggccctgggaggtgctgggcgcccacgaggtgcccagcaggaacatcttcagcgagcagaccatcccccccagcgccaagtatggaggccgccacacagtgaccatgatccctggagatggcatcggccctgagctgatgctgcacgtgaagtctgtgttcagacatgcctgtgtgcctgtggactttgaggaggtgcacgtgagcagcaatgctgatgaggaggacatcagaaatgccatcatggccatcagaagaaacagagtggccctgaagggcaacatcgagaccaaccacaacctgccccccagccacaagagcaggaacaacatcctgcggaccagcctggacctgtatgccaacgtcatccactgcaagagcctgcccggggtggtgaccaggcacaaggacatcgacatcctgattgtgcgggagaacacagaaggagagtacagcagcctggagcatgaatctgtggccggcgtggtggagagcctgaagatcatcaccaaggccaagagcctgagaattgctgaatatgccttcaagctggcccaggagagcggcaggaagaaggtgacagctgtgcacaaggccaacatcatgaagctgggagatggcctcttcctgcagtgctgccgggaggtggccgcccgctacccccagatcacctttgagaacatgattgtggacaacaccaccatgcagctggtgtcccggccccagcagtttgatgtgatggtgatgcccaacctgtatggcaacatcgtgaacaacgtgtgtgccggcctggtgggcggccctggcctggtggccggggccaactacggccacgtgtatgctgtgtttgaaacagccaccaggaacacaggcaagagcatcgccaacaagaacatcgccaaccccacagccaccctgctggccagctgcatgatgctggaccacctgaagctgcacagctatgccaccagcatcaggaaggctgtgctggcctccatggacaatgaaaacatgcacaccccagacatcggcggccagggcaccaccagcgaggccatccaggacgtcatccgccacatccgggtcatcaatggccgggctgtggaggcctag

SEQ ID NO: 173877 - DNA, 1791 bp, Artificial Sequence
  Description of Artificial Sequence: Synthetic coding sequence
atggctgatgctgaggcccgggcagagttccctgaggaggcccggccagaccggggcaccctgcaggtgctgcaggacatggccagccggctgcgcatccacagcatccgggccacctgcagcaccagcagcggccaccccaccagctgcagcagcagcagcgagatcatgtctgtgctcttcttctacatcatgagatacaagcagagcgaccctgaaaatccagacaatgacagatttgtgctggccaagaggctgagctttgtggatgtggccaccggctggctgggccagggcctgggcgtggcctgtggcatggcctacacaggcaagtactttgaccgggccagctacagagtcttctgcctgatgtctgatggagagagcagcgagggctctgtgtgggaggccatggcctttgccagctactacagcctggacaacctggtggccatctttgatgtgaaccggctgggccacagcggggccctgcctgctgagcactgcatcaacatctaccagaggcgctgtgaggccttcggctggaacacctacgtggtggatggaagagatgtggaggccctgtgccaggtgttctggcaggccagccaggtgaagcacaagcccacagctgtggtggccaagaccttcaagggccggggcacccccagcattgaagatgctgagagctggcacgccaagcccatgccccgggagcgggcagatgccatcatcaagctgattgagagccagatccagaccagcaggaacctggacccccagccccccatcgaggacagccctgaggtgaacatcacagatgtgaggatgaccagccccccagactacagagtgggggacaagatcgccaccaggaaggcctgtggcctggccctggccaagctgggctacgccaacaacagagtggtggtgctggatggagacacccgctacagcaccttcagcgagatcttcaacaaggagtacccagagcgcttcatcgagtgcttcatggccgagcagaacatggtgtctgtggccctgggctgtgccagccggggccgcaccatcgcctttgccagcacctttgctgccttcctgacccgggcctttgaccacatccgcatcggcggcctggccgagagcaacatcaacatcatcggcagccactgcggcgtgtctgtgggagatgatggagccagccagatggccctggaggacatcgccatgttccgcaccatccccaagtgcaccatcttctaccccacagatgctgtgtccacagagcacgctgtggccctggccgccaatgccaagggcatgtgcttcatccgcaccaccaggcctgagaccatggtgatctacaccccccaggagagatttgaaattggccaggccaaggtgctgcggcactgtgtgtctgacaaggtgaccgtcatcggggccggcatcaccgtgtatgaggccctggccgctgctgatgagctgagcaagcaggacatcttcatccgggtcatcgacctcttcaccatcaagcccctggatgtggccaccatcgtgagcagcgccaaggccacagagggccgcatcatcaccgtggaggaccactacccccagggcggcatcggggaggccgtgtgtgccgctgtgtccatggaccctgacatccaggtgcacagcctggccgtgtctggagtgccccagagcggcaagtctgaggagctgctggacatgtatggcatcagcgcccggcacatcatcgtggccgtgaagtgcatgctgctgaactag

SEQ ID NO: 173878 - DNA, 1674 bp, Artificial Sequence
  Description of Artificial Sequence: Synthetic coding sequence
atgtctgtgctcttcttctacatcatgagatacaagcagagcgaccctgaaaatccagacaatgacagatttgtgctggccaagaggctgagctttgtggatgtggccaccggctggctgggccagggcctgggcgtggcctgtggcatggcctacacaggcaagtactttgaccgggccagctacagagtcttctgcctgatgtctgatggagagagcagcgagggctctgtgtgggaggccatggcctttgccagctactacagcctggacaacctggtggccatctttgatgtgaaccggctgggccacagcggggccctgcctgctgagcactgcatcaacatctaccagaggcgctgtgaggccttcggctggaacacctacgtggtggatggaagagatgtggaggccctgtgccaggtgttctggcaggccagccaggtgaagcacaagcccacagctgtggtggccaagaccttcaagggccggggcacccccagcattgaagatgctgagagctggcacgccaagcccatgccccgggagcgggcagatgccatcatcaagctgattgagagccagatccagaccagcaggaacctggacccccagccccccatcgaggacagccctgaggtgaacatcacagatgtgaggatgaccagccccccagactacagagtgggggacaagatcgccaccaggaaggcctgtggcctggccctggccaagctgggctacgccaacaacagagtggtggtgctggatggagacacccgctacagcaccttcagcgagatcttcaacaaggagtacccagagcgcttcatcgagtgcttcatggccgagcagaacatggtgtctgtggccctgggctgtgccagccggggccgcaccatcgcctttgccagcacctttgctgccttcctgacccgggcctttgaccacatccgcatcggcggcctggccgagagcaacatcaacatcatcggcagccactgcggcgtgtctgtgggagatgatggagccagccagatggccctggaggacatcgccatgttccgcaccatccccaagtgcaccatcttctaccccacagatgctgtgtccacagagcacgctgtggccctggccgccaatgccaagggcatgtgcttcatccgcaccaccaggcctgagaccatggtgatctacaccccccaggagagatttgaaattggccaggccaagggcgtgtccatgctgcaggacagctggagcagcgtcatctcctaccagaaggtgctgcggcactgtgtgtctgacaaggtgacagtgattggagctggcatcaccgtgtatgaggccctggccgctgctgatgagctgagcaagcaggacatcttcatccgggtgattgacctcttcaccatcaagcccctggatgtggccaccatcgtgtcctctgccaaggccacagagggccgcatcatcaccgtggaggaccactacccccagggcggcattggagaggccgtgtgtgccgctgtgtccatggaccctgacatccaggtgcacagcctggccgtgtctggagtgccccagagcggcaagtctgaggagctgctggacatgtatggcatcagcgcccggcacatcatcgtggccgtgaagtgcatgctgctgaactag

SEQ ID NO: 173879 - DNA, 1623 bp, Artificial Sequence
  Description of Artificial Sequence: Synthetic coding sequence
atgtctgtgctcttcttctacatcatgagatacaagcagagcgaccctgaaaatccagacaatgacagatttgtgctggccaagaggctgagctttgtggatgtggccaccggctggctgggccagggcctgggcgtggcctgtggcatggcctacacaggcaagtactttgaccgggccagctacagagtcttctgcctgatgtctgatggagagagcagcgagggctctgtgtgggaggccatggcctttgccagctactacagcctggacaacctggtggccatctttgatgtgaaccggctgggccacagcggggccctgcctgctgagcactgcatcaacatctaccagaggcgctgtgaggccttcggctggaacacctacgtggtggatggaagagatgtggaggccctgtgccaggtgttctggcaggccagccaggtgaagcacaagcccacagctgtggtggccaagaccttcaagggccggggcacccccagcattgaagatgctgagagctggcacgccaagcccatgccccgggagcgggcagatgccatcatcaagctgattgagagccagatccagaccagcaggaacctggacccccagccccccatcgaggacagccctgaggtgaacatcacagatgtgaggatgaccagccccccagactacagagtgggggacaagatcgccaccaggaaggcctgtggcctggccctggccaagctgggctacgccaacaacagagtggtggtgctggatggagacacccgctacagcaccttcagcgagatcttcaacaaggagtacccagagcgcttcatcgagtgcttcatggccgagcagaacatggtgtctgtggccctgggctgtgccagccggggccgcaccatcgcctttgccagcacctttgctgccttcctgacccgggcctttgaccacatccgcatcggcggcctggccgagagcaacatcaacatcatcggcagccactgcggcgtgtctgtgggagatgatggagccagccagatggccctggaggacatcgccatgttccgcaccatccccaagtgcaccatcttctaccccacagatgctgtgtccacagagcacgctgtggccctggccgccaatgccaagggcatgtgcttcatccgcaccaccaggcctgagaccatggtgatctacaccccccaggagagatttgaaattggccaggccaaggtgctgcggcactgtgtgtctgacaaggtgaccgtcatcggggccggcatcaccgtgtatgaggccctggccgctgctgatgagctgagcaagcaggacatcttcatccgggtcatcgacctcttcaccatcaagcccctggatgtggccaccatcgtgagcagcgccaaggccacagagggccgcatcatcaccgtggaggaccactacccccagggcggcatcggggaggccgtgtgtgccgctgtgtccatggaccctgacatccaggtgcacagcctggccgtgtctggagtgccccagagcggcaagtctgaggagctgctggacatgtatggcatcagcgcccggcacatcatcgtggccgtgaagtgcatgctgctgaactag

SEQ ID NO: 173880 - DNA, 894 bp, Artificial Sequence
  Description of Artificial Sequence: Synthetic coding sequence
atgtctgcctgggccgccgccagcctgagcagagctgctgcccgctgcctgctggcccggggccctggggtgcgggccgccccaccccgggacccccggcccagccaccctgagccccggggctgtggggccgcccctggccgcaccctgcacttcaccgctgctgtgcctgctggccacaacaagtggagcaaggtgcgccacatcaagggccccaaggatgtggagaggagccgcatcttcagcaagctgtgcctgaacatccggctggccgtgaaggagggcggccccaaccctgagcacaacagcaacctggccaacatcctggaggtgtgccgcagcaagcacatgcccaagagcaccatcgagacagccctgaagatggagaagagcaaggacacctacctgctgtatgagggccggggccctgggggcagcagcctgctgattgaggccctgagcaacagcagccacaagtgccaggccgacatccgccacatcctgaacaagaatggaggagtgatggctgtgggcgcccggcacagctttgacaagaagggcgtgattgtggtggaggtggaggaccgggagaagaaggctgtgaacctggagcgggccctggagatggccattgaagctggagcagaagatgtgaaggagacagaagatgaggaggagagaaatgtgttcaagttcatctgtgatgccagcagcctgcaccaggtgaggaagaagctggacagcctgggcctgtgcagcgtgtcctgtgccctggagttcatccccaacagcaaggtgcagctggccgagccagacctggagcaggccgcccacctgatccaggccctgagcaaccatgaagatgtgattcatgtgtatgacaacatcgagtag

SEQ ID NO: 173881 - DNA, 687 bp, Artificial Sequence
  Description of Artificial Sequence: Synthetic coding sequence
atgtctgtgtctgagatctttgtggagctgcagggcttcctggccgctgagcaggacatccgggaggagatcaggaaggtggtgcagagcctggagcagacagcccgggagatcctgaccctgctgcagggcgtgcaccagggcgccggcttccaggacatccccaagcgctgcctgaaggcccgggagcactttggaacagtgaagacccacctgaccagcctgaagaccaagtttcctgctgagcagtactaccgcttccacgagcactggaggtttgtgctgcagaggctggtgttcctggccgcctttgtggtgtacctggagacagagaccctggtgacccgggaggccgtgacagagatcctgggcattgaaccagaccgggagaagggcttccacctggatgtggaggactacctgagcggcgtgctgatcctggccagcgagctgagccggctgtctgtgaacagcgtgacagctggggactacagccggcccctgcacatcagcaccttcatcaatgagctggacagcggcttccggctgctgaacctgaagaatgacagcctgaggaagagatatgatggcctgaagtatgatgtgaagaaggtggaggaggtggtgtatgacctgagcatccggggcttcaacaaggagacagctgctgcctgtgtggagaagtag

SEQ ID NO: 173882 - DNA, 585 bp, Artificial Sequence
  Description of Artificial Sequence: Synthetic coding sequence
atgtctgtgtctgagatctttgtggagctgcagggcttcctggccgctgagcaggacatccccaagcgctgcctgaaggcccgggagcactttggaacagtgaagacccacctgaccagcctgaagaccaagtttcctgctgagcagtactaccgcttccacgagcactggaggtttgtgctgcagaggctggtgttcctggccgcctttgtggtgtacctggagacagagaccctggtgacccgggaggccgtgacagagatcctgggcattgaaccagaccgggagaagggcttccacctggatgtggaggactacctgagcggcgtgctgatcctggccagcgagctgagccggctgtctgtgaacagcgtgacagctggggactacagccggcccctgcacatcagcaccttcatcaatgagctggacagcggcttccggctgctgaacctgaagaatgacagcctgaggaagagatatgatggcctgaagtatgatgtgaagaaggtggaggaggtggtgtatgacctgagcatccggggcttcaacaaggagacagctgctgcctgtgtggagaagtag

SEQ ID NO: 173883 - DNA, 447 bp, Artificial Sequence
  Description of Artificial Sequence: Synthetic coding sequence
atgtctgtgtctgagatctttgtggagctgcagggcttcctggccgctgagcaggacatccgggaggagatcaggaaggtggtgcagagcctggagcagacagcccgggagatcctgaccctgctgcagggcgtgcaccagggcgccggcttccaggacatccccaagcgctgcctgaaggcccgggagcactttggaacagtgaagacccacctgaccagcctgaagaccaagtttcctgctgagcagtactaccgcttccacgagcactggaggtttgtgctgcagaggctggtgttcctggccgcctttgtggtgtacctggagacagagaccctggtgacccgggaggccgtgacagagatcctgggcattgaagctgtgtgccagcagagggactgctggaggctgctgcccaccccaccccacctgcacctgcaccagtag

SEQ ID NO: 173884 - DNA, 873 bp, Artificial Sequence
  Description of Artificial Sequence: Synthetic coding sequence
atgagcaacaaggagggcagcggcggcttcaggaagaggaagcatgacaacttcccccacaaccagaggcgggagggcaaggatgtgaacagcagcagccctgtgatgctggccttcaagagcttccagcaggagctggatgcccggcatgacaagtatgagcggctggtgaagctgagccgggacatcaccgtggagagcaagaggaccatcttcctgctgcaccgcatcaccagcgccccagacatggaggacatcctgacagagagcgagatcaagctggatggagtgcggcagaagatcttccaggtggcccaggagctgtctggagaggacatgcaccagttccaccgggccatcaccaccggcctgcaggagtatgtggaggccgtgtccttccagcacttcatcaagaccaggagcctcatctccatggatgagatcaacaagcagctgatcttcaccacagaagataatggcaaggagaacaagacccccagcagtgatgcccaggacaagcagtttggcacctggaggctgcgggtgacccctgtggactacctgctgggcgtggccgacctgactggagagctgatgaggatgtgcatcaacagcgtgggcaatggagacatcgacaccccatttgaggtgtcccagttcctgcggcaggtgtatgatggcttctccttcatcggcaacacaggcccctatgaggtgtccaagaagctgtacaccctgaagcagagcctggccaaggtggagaatgcctgctacgccctgaaggtgcggggcagcgagatccccaagcacatgctggctgatgtgttttctgtgaagacagagatgattgaccaggaggagggcatctcctag

SEQ ID NO: 173885 - DNA, 492 bp, Artificial Sequence
  Description of Artificial Sequence: Synthetic coding sequence
atgagcaacaaggagggcagcggcggcttcaggaagaggaagcatgacaacttcccccacaaccagaggcgggagggcaaggatgtgaacagcagcagccctgtgatgctggccttcaagagcttccagcaggagctggatgcccggcatgacaagtatgagcggctggtgaagctgagccgggacatcaccgtggagagcaagaggaccatcttcctgctgcaccgcatcaccagcagccagtacctggaccacagcgccccagacatggaggacatcctgacagaaagtgagatcaagctggatggagtgcggcagaagatcttccaggtggcccaggagctgagcggggaggacatgcaccagttccaccgggccatcaccaccggcctgcaggagtatgtggaggccgtgtccttccagcacttcatcaagaccaggagcctcatctccatggatgagatcaacaagcagctgatcttcaccacctag

SEQ ID NO: 173886 - DNA, 273 bp, Artificial Sequence
  Description of Artificial Sequence: Synthetic coding sequence
atggaccccctgcgggcccagcagctggccgctgagctggaggtggagatgatggctgacatgtacaacaggatgaccagcgcctgccacaggaaatgtgtgcccccccactacaaggaggccgagctgagcaaaggagagagcgtgtgcctggacagatgtgtgtccaagtacctggacatccacgagaggatgggcaagaagctgacagagctgtccatgcaggatgaggagctgatgaagagggtgcagcagagcagcggccctgcctag

SEQ ID NO: 173887 - DNA, 273 bp, Artificial Sequence; identical to SEQ ID NO: 173886
  Description of Artificial Sequence: Synthetic coding sequence

SEQ ID NO: 173888 - DNA, 273 bp, Artificial Sequence; identical to SEQ ID NO: 173886
  Description of Artificial Sequence: Synthetic coding sequence

SEQ ID NO: 173889 - DNA, 927 bp, Artificial Sequence
  Description of Artificial Sequence: Synthetic coding sequence
atgaagcactatgaggtggagatcctggatgccaagacccgggagaagctgtgcttcctggacaaggtggagccccacgccaccatcgccgagatcaagaacctcttcaccaagacccacccccagtggtacccagcccggcagagcctgcggctggaccccaagggcaagagcctgaaggatgaagatgtgctgcagaagctgcctgtgggcaccacagccaccctgtacttccgggacctgggcgcccagatctcctgggtgacagtgttcctgacagaatatgccggccccctcttcatctacctgctcttctacttccgggtgcccttcatctacggccacaagtatgacttcaccagcagccgccacacagtggtgcacctggcctgcatctgccacagcttccactacatcaagaggctgctggagaccctgtttgtgcaccgcttcagccacggcaccatgcccctgaggaacatcttcaagaactgcacctactactggggctttgctgcctggatggcctactacatcaaccaccccctgtacaccccacccacctatggagcccagcaggtgaagctggccctggccatctttgtgatctgccagctgggcaacttcagcatccacatggccctgcgggacctgcggcctgctggcagcaagaccaggaagatcccctaccccaccaagaaccccttcacctggctgttcctgctggtgtcctgccccaactacacctatgaggtgggctcctggattggatttgccatcatgacccagtgcctgcctgtggccctcttcagcctggtgggcttcacccagatgaccatctgggccaagggcaagcacaggagctacctgaaggagttccgggactacccacccctgaggatgcccatcatccccttcctgctgtag

SEQ ID NO: 173890 - DNA, 516 bp, Artificial Sequence
  Description of Artificial Sequence: Synthetic coding sequence
atggaggagtatgcccgggagccctgcccctggagaattgtggatgactgtggcggggccttcaccatgggcaccatcggcggcggcatcttccaggccatcaagggcttcaggaacagccctgtgggcgtgaaccaccggctgcggggcagcctgacagccatcaagacccgggccccccagctgggcggcagctttgctgtgtggggcggcctcttctccatgattgactgcagcatggtgcaggtgcggggcaaggaggacccctggaacagcatcaccagcggggccctgactggagccatcctggccgccagaaatggacctgtggccatggtgggcagcgctgccatgggcggcatcctgctggccctgattgagggcgccggcatcctgctgaccaggtttgccagcgcccagttccccaacggcccccagtttgctgaggaccccagccagctgcccagcacccagctgcccagcagcccctttggagactaccggcagtaccagtag

SEQ ID NO: 173891 - DNA, 519 bp, Artificial Sequence
  Description of Artificial Sequence: Synthetic coding sequence
atggaggagtatgcccgggagccctgcccctggagaattgtggatgactgtggcggggccttcaccatgggcgtcatcggcggcggcgtcttccaggccatcaagggcttcagaaatgcccctgtgggcatccgccaccggctgcggggcagcgccaatgctgtgcgcatccgggccccccagatcggcggcagctttgctgtgtggggcggcctcttcagcaccatcgactgtggcctggtgcggctgcggggcaaggaggacccctggaacagcatcaccagcggggccctgactggagctgtgctggccgcccggagcggccccctggccatggtgggcagcgccatgatgggcggcatcctgctggccctgattgagggcgtgggcatcctgctgacccgctacacagcccagcagttcagaaatgccccacccttcctggaggaccccagccagctgccccccaaggatggcaccccagcccctggctaccccagctaccagcagtaccactag

SEQ ID NO: 173892 - DNA, 669 bp, Artificial Sequence
  Description of Artificial Sequence: Synthetic coding sequence
atggaggagtatgcccgggagccctgcccctggagaattgtggatgactgtggcggggccttcaccatgggcgtcatcggcggcggcgtcttccaggccatcaagggcttcagaaatgcccctgtgtgccgcctgctgtctgaggcccccctcttcatctacagctgcagccgctctgtgagccccaccgtgaatgtgagcagcgagagagctgagagccggcccaccctcttcatggctgtgtccctgcacatggcctggtgcctggcccacatcggcatccgccaccggctgcggggcagcgccaatgctgtgcgcatccgggccccccagatcggcggcagctttgctgtgtggggcggcctcttcagcaccatcgactgtggcctggtgcggctgcggggcaaggaggacccctggaacagcatcaccagcggggccctgactggagctgtgctggccgcccggagcggccccctggccatggtgggcagcgccatgatgggcggcatcctgctggccctgattgagggcgtgggcatcctgctgacccgctacacagcccagcagttcagaaatgccccacccttcctggaggaccccagccagctgccccccaaggatggcaccccagcccctggctaccccagctaccagcagtaccactag

SEQ ID NO: 173893 - DNA, 585 bp, Artificial Sequence
  Description of Artificial Sequence: Synthetic coding sequence
atggctgctgctgccccaaatgctgggggcagcgcccctgagacagctggcagcgctgaggcccccctgcagtacagcctgctgctgcagtacctggtgggggacaagaggcagccccggctgctggagcccggcagcctgggcggcatccccagccctgccaagtctgaggagcagaagatgattgagaaggccatggagagctgtgccttcaaggccgccctggcctgtgtgggcggctttgtgctgggcggggcctttggagtcttcaccgctggcatcgacaccaacgtgggctttgaccccaaggacccctaccgcacccccacagccaaggaggtgctgaaggacatgggccagaggggcatgtcctatgccaagaactttgccatcgtgggcgccatgttcagctgcacagagtgcctgattgagagctaccggggcaccagtgactggaagaacagcgtcatcagcggctgcatcaccggcggggccatcggcttccgggccggcctgaaggccggggccatcggctgcggcggctttgctgccttctctgctgccatcgactactacctgaggtag

SEQ ID NO: 173894 - DNA, 630 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgaccggggccgccttcggggccatgaatggcctgcggctgggcctgaaggagacccagaacatggcctggagcaagcccagaaatgtgcagatcctgaacatggtgacccggcagggcgccctgtgggccaacaccctgggcagcctggccctgctgtacagcgcctttggagtcatcatcgagaagaccagaggagcagaagatgacctgaacacagtggccgccggcaccatgacaggcatgctgtacaagtgcacaggaggcctgcggggcatcgcccggggcggcctgaccggcctgaccctgaccagcctgtatgccctgtacaacaactgggagcacatgaagggcagcctgctgcagcagagcctgtag

SEQ ID NO: 173895 - DNA, 486 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgacagccctgctgtacagcgcctttggagtcatcatcgagaagaccagaggagcagaagatgacctgaacacagtggccgccggcaccatgacaggcatgctgtacaagtgcacaggaggcctgcggggcatcgcccggggcggcctgaccggcctgaccctgaccagcctgtatgccctgtacaacaactgggagcacatgaagggcagcctgctgcagcagagcctgtag

SEQ ID NO: 173896 - DNA, 519 bp, Artificial Sequence
  Description of Artificial Sequence: Synthetic coding sequence
atggagggcggcggcggcagcggcaacaagaccaccggcggcctggccggcttctttggagctggaggagctggctacagccatgctgacctggccggcgtgcccctgaccggcatgaaccccctgagcccctacctgaatgtggacccccgctacctggtgcaggacacagatgagttcatcctgcccaccggggccaacaagacccggggccgctttgagctggccttcttcaccatcggcggctgctgcatgaccggggccctgtgggccaacaccctgggcagcctggccctgctgtacagcgccttcggggtcatcatcgagaagaccagaggagcagaagatgacctgaacacagtggccgccggcaccatgacaggcatgctgtacaagtgcaccggcggcctgcggggcatcgcccggggcggcctgaccggcctgaccctgaccagcctgtatgccctgtacaacaactgggagcacatgaagggcagcctgctgcagcagagcctgtag

SEQ ID NO: 173897 - DNA, 381 bp, Artificial Sequence
  Description of Artificial Sequence: Synthetic coding sequence
atgaccggggccgccttcggggccatgaatggcctgcggctgggcctgaaggagacccagaacatggcctggagcaagcccagaaatgtgcagatcctgaacatggtgacccggcagggcgccctgtgggccaacaccctgggcagcctggccctgctgtacagcgcctttggagtcatcatcgagaagaccagaggagcagaagatgacctgaacacagtggccgccggcaccatgacaggcatgctgtacaagtgcacagccagcgccagccagagcgccagaattgctgatggcctcatcttcacagagttctgcagcgtggcccggctgcagggcagcggcaccatcctggcccactacaacctgcacctgccctag

SEQ ID NO: 173898 - DNA, 324 bp, Artificial Sequence
  Description of Artificial Sequence: Synthetic coding sequence
tgaggaggcagcggcaacaagaccactggaggcctggccggcttcttcggggccggcggggccggctacagccacgccgacctggccggcgtgccccccctgctgtacagcgcctttggagtcatcatcgagaagaccagaggagcagaagatgacctgaacacagtggccgccggcaccatgacaggcatgctgtacaagtgcacaggaggcctgcggggcatcgcccggggcggcctgaccggcctgaccctgaccagcctgtatgccctgtacaacaactgggagcacatgaagggcagcctgctgcagcagagcctgtag

SEQ ID NO: 173899 - DNA, 1359 bp, Artificial Sequence
  Description of Artificial Sequence: Synthetic coding sequence
atggctgctgctgccctgcggagcggctggtgccgctgcccccggcgctgcctgggcagcggcatccagttcctgagcagccacaacctgccccacggcagcacctaccagatgagaagacctggaggagagctgcccctgagcaagagctacagcagcggcaacaggaagggcttcctgagcggcctgctggacaacgtgaagcaggagctggccaagaacaaggagatgaaggagagcatcaagaagttcagagatgaggcccggcggctggaggagagtgatgtgctgcaggaggcccggaggaagtacaagaccattgaaagtgaaacagtgaggaccagcgaggtgctgaggaagaagctgggggagctgaccggcaccgtgaaggagagcctgcacgaggtgtccaagagtgacctgggcaggaagatcaaggagggcgtggaggaggccgccaagacagccaagcagagcgctgagagcgtgtccaaaggaggagagaagctgggccgcacagctgccttccgggccctgagccagggcgtggagagcgtgaagaaggagattgatgattctgtgctgggccagacaggcccctaccgccggccccagaggctgaggaagaggacagaatttgctggggacaagttcaaggaggagaaggtgtttgagcccaatgaggaggccctgggcgtggtgctgcacaaggacagcaagtggtaccagcagtggaaggacttcaaggagaacaacgtggtgttcaaccgcttctttgagatgaagatgaagtatgatgaaagtgacaatgccttcatccgggccagccgggccctgacagacaaggtgacagacctgctgggcggcctcttcagcaagacagagatgtctgaggtgctgacagagatcctgcgggtggaccctgcctttgacaaggaccgcttcctgaagcagtgtgaaaatgacatcatccccaacgtgctggaggccatgatctctggagagctggacatcctgaaggactggtgctatgaggccacctacagccagctggcccaccccatccagcaggccaaggccctgggcctgcagttccacagccgcatcctggacatcgacaacgtggacctggccatgggcaagatgatggagcagggccctgtgctgatcatcaccttccaggcccagctggtgatggtggtgaggaaccccaagggggaggtggtggagggggaccctgacaaggtgctgaggatgctgtatgtgtgggccctgtgccgggaccaggatgagctgaacccctatgctgcctggaggctgctggacatcagcgccagcagcacagagcagatcctgtag

SEQ ID NO: 173900 - DNA, 294 bp, Artificial Sequence
  Description of Artificial Sequence: Synthetic coding sequence
atggacagcagcagcagcagcagcgctgctggcctgggcgctgtggacccccagctgcagcacttcatcgaggtggagacccagaagcagcgcttccagcagctggtgcaccagatgacagagctgtgctgggagaagtgcatggacaagccaggccccaagctggacagcagagctgaggcctgctttgtgaactgtgtggagcgcttcatcgacaccagccagttcatcctgaaccggctggagcagacccagaagagcaagcctgtgttcagcgagagcctgagtgactag

SEQ ID NO: 173901 - DNA, 270 bp, Artificial Sequence
  Description of Artificial Sequence: Synthetic coding sequence
atggccgcccagatccctgagagtgaccagatcaagcagttcaaggagttcctgggcacctacaacaagctgacagagacctgcttcctggactgtgtgaaggacttcaccacccgggaggtgaagccagaggagaccacctgcagcgagcactgcctgcagaagtacctgaagatgacccagaggatctccatgaggttccaggagtaccacatccagcagaatgaggccctggccgccaaggccggcctgctgggccagcccaggtag

SEQ ID NO: 173902 - DNA, 270 bp, Artificial Sequence; identical to SEQ ID NO: 173901
  Description of Artificial Sequence: Synthetic coding sequence

SEQ ID NO: 173903 - DNA, 135 bp, Artificial Sequence
  Description of Artificial Sequence: Synthetic coding sequence
atggccgcccagatccctgagagtgaccagatcaagcagttcaaggagttcctgggcacctacaacaagctgacagagacctgcttcctggactgtgtgaaggacttcaccacccgggaggtgaagccagagtag

SEQ ID NO: 173904 - DNA, 270 bp, Artificial Sequence; identical to SEQ ID NO: 173901
  Description of Artificial Sequence: Synthetic coding sequence

SEQ ID NO: 173905 - DNA, 270 bp, Artificial Sequence; identical to SEQ ID NO: 173901
  Description of Artificial Sequence: Synthetic coding sequence

SEQ ID NO: 173906 - DNA, 381 bp, Artificial Sequence
  Description of Artificial Sequence: Synthetic coding sequence
atgcccttcttcggcaacaccttcagccccaagaagaccccacccaggaagagcgccagcctgagcaacctgcacagcctggacaggagcacccgggaggtggagctgggcctggagtatggcagccccaccatgaacctggccggccagagcctgaagtttgaaaatggccagtggattgctgagactggagtgtctgggggcgtggacagaagagaggtgcagaggctgcggcggaggaaccagcagctggaggaggagaacaacctgctgcggctgaaggtggacatcctgctggacatgctgtctgagagcacagctgagagccacctgatggagaaggagctggatgagctgcgcatcagcaggaagaggaagtag

SEQ ID NO: 173907 - DNA, 1086 bp, Artificial Sequence
  Description of Artificial Sequence: Synthetic coding sequence
atgggaaatgtgctggccgccagcagccccccagctggccccccacctcctccagccccagccctggtgggcctgcccccacctccacccagccccccaggcttcaccctgccccccctgggcggcagcctgggcgccggcaccagcaccagccgcagcagcgagaggacccctggggccgccacagccagcgccagcggggctgctgaagatggagcctgtggctgcctgcccaaccctggcacctttgaggagtgccacaggaagtgcaaggagctgttccccatccagatggagggcgtgaagctgactgtgaacaagggcctgagcaaccacttccaggtgaaccacacagtggccctgagcaccatcggggagagcaactaccactttggagtgacctacgtgggcaccaagcagctgagccccacagaggccttccctgtgctggtgggggacatggacaacagcggcagcctgaatgcccaggtgatccaccagctgggccctggcctgcggagcaagatggccatccagacccagcagagcaagtttgtgaactggcaggtggatggagagtaccggggcagtgacttcaccgctgctgtgaccctgggcaacccagatgtgctggtgggcagcggcatcctggtggcccactacctgcagagcatcaccccctgcctggccctgggcggggagctggtgtaccacagaagacctggagaggagggcaccgtgatgagcctggccggcaagtacaccctgaacaactggctggccaccgtgaccctgggccaggccggcatgcacgccacctactaccacaaggccagtgaccagctgcaggtgggcgtggagtttgaggccagcaccaggatgcaggacacctctgtgtcctttggctaccagctggacctgcccaaggccaacctgctcttcaagggctctgtggacagcaactggatcgtgggcgccaccctggagaagaagctgccccccctgcccctgaccctggccctgggcgccttcctgaaccacaggaagaacaagttccagtgtggcttcggcctgaccatcggctag

SEQ ID NO: 173908 - DNA, 1086 bp, Artificial Sequence; identical to SEQ ID NO: 173907
  Description of Artificial Sequence: Synthetic coding sequence

SEQ ID NO: 173909 - DNA, 1086 bp, Artificial Sequence; identical to SEQ ID NO: 173907
  Description of Artificial Sequence: Synthetic coding sequence

SEQ ID NO: 173910 - DNA, 453 bp, Artificial Sequence
  Description of Artificial Sequence: Synthetic coding sequence
atgcccagcagcggctctgtgagccgcagccggcagaggggccgctccatggccagccggggctttgatggcagccggcggggcagcctgcggcgggccggggcccgggagccccccagcgaggtgattgaagctgctgcccaggccagcggcagctgctggagcagccccttcttcagcgccagcaccccatctgctgctgccactggagtgcccggccccacagacatggctgctgtgctgcagcaggtgctggagaggacagagctgaacaagctgcccaagtctgtgcagaacaagctggagaagttcctggccgaccagcagagcgagattgatggcctgaagggcagacatgagaagttcaaggtggagagcgagcagcagtactttgaaattgagaagaggctgagccacagccaggagcggctggtgaatgagacccgggagtag

SEQ ID NO: 173911 - DNA, 7092 bp, Artificial Sequence
  Description of Artificial Sequence: Synthetic coding sequence
atggctgctgtgctgcagcaggtgctggagaggacagagctgaacaagctgcccaagtctgtgcagaacaagctggagaagttcctggccgaccagcagagcgagattgatggcctgaagggcagacatgagaagttcaaggtggagagcgagcagcagtactttgaaattgagaagaggctgagccacagccaggagcggctggtgaatgagacccgggagtgccagagcctgcggctggagctggagaagctgaacaaccagctgaaggccctgacagagaagaacaaggagctggagatcgcccaggacagaaatattgccatccagagccagttcaccaggaccaaggaggagctggaggccgagaagagggacctgatccgcaccaatgaaaggctgagccaggagctggagtacctgacagaagatgtgaagaggctgaatgagaagctgaaggagagcaacaccaccaagggggagctgcagctgaagctggatgagctgcaggccagtgatgtgtctgtgaagtaccgggagaagaggctggagcaggagaaggagctgctgcacagccagaacacctggctgaacacagagctgaagaccaagacagatgagctgctggccctgggccgggagaagggaaatgagatcctggagctgaagtgcaacctggagaacaagaaggaggaggtgtcccggctggaggagcagatgaatggcctgaagaccagcaatgagcacctgcagaagcacgtggaggacctgctgaccaagctgaaggaggccaaggagcagcaggcctccatggaggagaagttccacaatgagctgaatgcccacatcaagctgagcaacctgtacaagtctgctgctgatgacagcgaggccaagagcaatgagctgaccagggctgtggaggagctgcacaagctgctgaaggaggccggggaggccaacaaggccatccaggaccacctgctggaggtggagcagagcaaggaccagatggagaaggagatgctggagaagattggccgcctggagaaggagctggagaatgccaatgacctgctgagcgccaccaagaggaagggggccatcctgtctgaggaggagctggccgccatgagccccacagctgctgctgtggccaagatcgtgaagccaggcatgaagctgacagagctgtacaatgcctacgtggagacccaggaccagctgctgctggagaagctggagaacaagaggatcaacaagtacctggatgagatcgtgaaggaggtggaggccaaggcccccatcctgaagaggcagcgggaggagtatgaaagagcccagaaggctgtggccagcctgtctgtgaagctggagcaggccatgaaggagatccagaggctgcaggaggacacagacaaggccaacaagcagagctctgtgctggagcgggacaacagaaggatggagatccaggtgaaggacctgagccagcagatccgggtgctgctgatggagctggaggaggcccggggcaaccacgtgatcagagatgaggaggtgtcctctgctgacatcagcagcagcagcgaggtgatcagccagcacctggtgtcctacagaaatattgaggagctgcagcagcagaaccagaggctgctggtggccctgcgggagctgggggagacccgggagcgggaggagcaggagaccaccagcagcaagatcacagagctgcagctgaagctggagagcgccctgacagagctggagcagctgaggaagagccggcagcaccagatgcagctggtggacagcatcgtgcggcagagggacatgtaccgcatcctgctgagccagaccaccggggtggccatccccctgcacgccagcagcctggatgatgtgtccctggccagcacccccaagaggcccagcaccagccagacagtgtccaccccagcccctgtgcctgtgattgagagcacagaggccatcgaggccaaggccgccctgaagcagctgcaggagatctttgagaactacaagaaggagaaggccgagaatgagaagatccagaatgagcagctggagaagctgcaggagcaggtgacagacctgcggagccagaacaccaagatcagcacccagctggactttgccagcaagagatatgagatgctgcaggacaacgtggagggctaccgccgggagatcaccagcctgcatgaaagaaaccagaagctgacagccaccacccagaagcaggagcagatcatcaacaccatgacccaggacctgcggggggccaatgagaagctggccgtggccgaggtgcgggcagagaacctgaagaaggagaaggagatgctgaagctgtctgaggtgcggctgagccagcagcgggagagcctgctggccgagcagaggggccagaacctgctgctgaccaacctgcagaccatccagggcatcctggagaggagtgaaacagagaccaagcagaggctgagcagccagatcgagaagctggagcacgagatcagccacctgaagaagaagctggagaatgaggtggagcagaggcacaccctgaccaggaacctggatgtgcagctgctggacaccaagaggcagctggacacagagaccaacctgcacctgaacaccaaggagctgctgaagaatgcccagaaggagatcgccaccctgaagcagcacctgagcaacatggaggtgcaggtggccagccagagcagccagaggacaggcaagggccagcccagcaacaaggaggatgtggatgacctggtgtcccagctgcggcagacagaggagcaggtgaatgacctgaaggagcggctgaagaccagcaccagcaatgtggagcagtaccaggccatggtgaccagcctggaggagagcctgaacaaggagaagcaggtgacagaggaggtgaggaagaacatcgaggtgcggctgaaggagagcgctgagttccagacccagctggagaagaagctgatggaggtggagaaggagaagcaggagctgcaggatgacaagagaagagccatcgagagcatggagcagcagctgtctgagctgaagaagaccctgagctctgtgcagaatgaggtgcaggaggccctgcagagggccagcacagccctgagcaatgagcagcaggcccggcgggactgccaggagcaggccaagattgctgtggaggcccagaacaagtatgaaagagagctgatgctgcacgccgcagatgtggaggccctgcaggccgccaaggagcaggtgtccaagatggcctctgtgcggcagcacctggaggagaccacccagaaggccgagagccagctgctggagtgcaaggcctcctgggaggagcgggagaggatgctgaaggatgaggtgtccaaatgtgtgtgccgctgtgaggacctggagaagcagaaccggctgctgcatgaccagatcgagaagctgagtgacaaggtggtggcctctgtgaaggagggcgtgcagggccccctgaatgtgtccctgtctgaggagggcaagagccaggagcagatcctggagatcctgcgcttcatccggcgggagaaggagattgctgagaccaggtttgaggtggcccaggtggagagcctgcgctaccggcagagggtggagctgctggagcgggagctgcaggagctgcaggacagcctgaatgctgagcgggagaaggtgcaggtgacagccaagaccatggcccagcacgaggagctgatgaagaagacagagaccatgaatgtggtgatggagaccaacaagatgctgcgggaggagaaggagcggctggagcaggacctgcagcagatgcaggccaaggtgaggaagctggagctggacatcctgcccctgcaggaggccaatgctgagctgtctgagaagagcggcatgctgcaggccgagaagaagctgctggaggaggatgtgaagcgctggaaggccaggaaccagcacctggtgtcccagcagaaggaccctgacacagaggagtacaggaagctgctgtctgagaaggaggtgcacaccaagaggatccagcagctgacagaggagatcggccgcctgaaggccgagatcgcccggagcaatgccagcctgaccaacaaccagaacctgatccagagcctgaaggaggacctgaacaaggtgaggacagagaaggagaccatccagaaggacctggatgccaagatcatcgacatccaggagaaggtgaagaccatcacccaggtgaagaagattggaagacgctacaagacccagtatgaggagctgaaggcccagcaggacaaggtgatggagaccagcgcccagagcagcggggaccaccaggagcagcacgtgtctgtgcaggagatgcaggagctgaaggagaccctgaaccaggccgagaccaagagcaagagcctggagagccaggtggagaacctgcagaagaccctgtctgagaaggagacagaggccaggaacctgcaggagcagacagtgcagctgcagagcgagctgagccggctgcggcaggacctgcaggacaggaccacccaggaggagcagctgcggcagcagatcacagagaaggaggagaagaccaggaaggccatcgtggccgccaagagcaagatcgcccacctggccggcgtgaaggaccagctgaccaaggaaaatgaggagctgaagcagagaaatggagccctggaccagcagaaggatgagctggatgtgcgcatcacagccctgaagagccagtatgagggccgcatcagccggctggagcgggagctgcgggagcaccaggagcggcacctggagcagagagatgagccccaggagcccagcaacaaggtgcctgagcagcagaggcagatcaccctgaagaccaccccagccagcggggagcggggcatcgccagcaccagtgaccccccaacagccaacatcaagcccacccctgtggtgtccacccccagcaaggtgacagctgctgccatggccggcaacaagagcaccccccgggccagcatccggcccatggtgaccccagccaccgtgaccaaccccaccaccacccccacagccaccgtgatgcccaccacccaggtggagagccaggaggccatgcagagcgagggccctgtggagcacgtgcctgtgtttggcagcaccagcggctctgtgcgcagcaccagccccaacgtgcagcccagcatcagccagcccatcctgactgtgcagcagcagacccaggccacagcctttgtgcagcccacccagcagagccacccccagatcgagcccgccaaccaggagctgagcagcaacatcgtggaggtggtgcagagcagccctgtggagcggcccagcaccagcacagctgtgtttggcaccgtgtctgccacccccagcagcagcctgcccaagaggacccgggaggaggaggaggacagcaccatcgaggccagtgaccaggtgtctgatgacacagtggagatgcccctgcccaagaagctgaagtctgtgacccctgtgggcacagaggaggaggtgatggccgaggagagcacagatggagaggtggagacccaggtgtacaaccaggacagccaggacagcatcggggagggcgtgacccagggcgactacacccccatggaggacagcgaggagaccagccagagcctgcagattgacctgggccccctgcagagcgaccagcagaccaccaccagcagccaggacggccagggcaaaggagatgatgtgattgtcatcgacagtgatgatgaggaggaggatgatgatgaaaatgatggagaacatgaagattatgaagaagatgaggaggatgatgatgatgatgaagatgacaccggcatgggagatgaaggagaggacagcaatgaaggcaccggcagcgcagatggaaatgatggctatgaagcagatgatgctgagggcggagatggaacagaccccggcacagaaacagaggagagcatgggcggcggggagggcaaccacagagctgctgacagccagaacagcggggagggcaacacaggagctgctgagagcagcttcagccaggaggtgtcccgggagcagcagcccagcagcgccagcgagcggcaggccccccgggccccccagagccccaggaggcctccccaccccctgcccccccggctgaccatccacgccccaccccaggagctgggcccccctgtgcagaggatccagatgacccggcggcagagcgtgggccggggcctgcagctgaccccaggcattggaggcatgcagcagcacttctttgatgatgaggacagaacagtgcccagcacccccaccctggtggtgccccacaggacagatggctttgctgaggccatccacagcccccaggtggccggcgtgccccgcttccgcttcggccccccagaggacatgccccagaccagcagcagccacagcgacctgggccagctggccagccagggcggcctgggcatgtatgagacccccctcttcctggcccacgaggaggagagcggcggccgctctgtgcccaccacccccctgcaggtggccgcccctgtgacagtgttcacagagagcaccaccagtgatgccagcgagcacgccagccagagcgtgcccatggtgaccaccagcacaggcaccctgagcaccaccaatgaaacagccactggagatgatggagatgaggtgtttgtggaggccgagagcgagggcatcagcagcgaggccggcctggagattgacagccagcaggaggaggagcctgtgcaggccagtgatgaaagtgacctgcccagcaccagccaggacccccccagcagcagctctgtggacaccagcagcagccagcccaagcccttccggcgggtgcggctgcagaccaccctgcggcagggcgtgcggggccggcagttcaaccggcagaggggcgtgtcccatgccatgggcggccggggcggcatcaacagaggcaacatcaactag

SEQ ID NO: 173912 - DNA, 453 bp, Artificial Sequence; identical to SEQ ID NO: 173910
  Description of Artificial Sequence: Synthetic coding sequence

SEQ ID NO: 173913 - DNA, 510 bp, Artificial Sequence
  Description of Artificial Sequence: Synthetic coding sequence
atggccccaccctgggtgcctgccatgggcttcaccctggcccccagcctgggctgctttgtgggcagcagatttgtgcatggagagggcctgcgctggtacgccggcctgcagaagcccagctggcaccccccccactgggtgctgggccctgtgtggggcaccctgtacagcgccatgggctacggcagctacctggtgtggaaggagctgggcggcttcacagagaaggctgtggtgcccctgggcctgtacacaggccagctggccctgaactgggcctggccacccatcttcttcggggcccggcagatgggctgggccctggtggacctgctgctggtgtctggagctgctgctgccaccaccgtggcctggtaccaggtgagccccctggccgcccggctgctgtacccctacctggcctggctggccttcaccaccaccctgaactactgtgtgtggagggacaaccacggctggaggggcggccgccgcctgcctgagtag

SEQ ID NO: 173914 - DNA, 510 bp, Artificial Sequence; identical to SEQ ID NO: 173913
  Description of Artificial Sequence: Synthetic coding sequence

SEQ ID NO: 173915 - DNA, 309 bp, Artificial Sequence
  Description of Artificial Sequence: Synthetic coding sequence
atggccccccacctgctgtggtgccccaccaacggcctgggcctgggcggcagccctgctggccagtggggcggcggcagccactaccggggcctggtgcctggagagcccgccggccggcccccagccctgcccctgcccggcctggccggcctgcatgaccacacccagctgctgaggatggccggccagccctggctggcctggggcacagctgctgcccgggtgtctgcccggcccacccgggactgcagctgcaccagccgctgccaccacgcctgtgatgtggtggccgtgaccctgtcctag

SEQ ID NO: 173916 - DNA, 324 bp, Artificial Sequence
  Description of Artificial Sequence: Synthetic coding sequence
atggccccaccctgggtgcctgccatgggcttcaccctggcccccagcctgggctgctttgtgggcagcagatttgtgcatggagagggcctgcgctggtacgccggcctgcagaagcccagctggcaccccccccactgggtgctgggccctgtgtggggcaccctgtacagcgccatgggctacggcagctacctggtgtggaaggagctgggcggcttcacagagaaggctgtggtgcccctgggcctgtacacaggccagctggccctgaactgggcctggccacccatcttcttcggggcccggcagatgggctggtag

SEQ ID NO: 173917 - DNA, 609 bp, Artificial Sequence
  Description of Artificial Sequence: Synthetic coding sequence
atgtgctatggaaaatgtgcccgctgcatcggccacagcctggtgggcctggccctgctgtgcatcgccgccaacatcctgctgtacttccccaacggggagaccaagtatgccagcgagaaccacctgagcagatttgtgtggttcttctctggaattgtgggcggcggcctgctgatgctgctgcctgcctttgtgttcatcggcctggagcaggatgactgctgcggctgctgcggccacgagaactgtgggaagagatgtgccatgctgagctctgtgctggccgccctgattggaattgctggcagcggctactgtgtgattgtggccgccctgggcctggccgagggccccctgtgcctggacagcctgggccagtggaactacacctttgccagcacagagggccagtacctgctggacaccagcacctggagcgagtgcacagagcccaagcacatcgtggagtggaatgtgtccctcttcagcatcctgctggccctgggcggcatcgagttcatcctgtgcctgatccaggtgatcaatggagtgctgggcggcatctgtggcttctgctgcagccaccagcagcagtatgactgctag

SEQ ID NO: 173918 - DNA, 699 bp, Artificial Sequence
  Description of Artificial Sequence: Synthetic coding sequence
atgtgctatggaaaatgtgcccgctgcatcggccacagcctggtgggcctggccctgctgtgcatcgccgccaacatcctgctgtacttccccaacggggagaccaagtatgccagcgagaaccacctgagcagatttgtgtggttcttctctggaattgtgggcggcggcctgctgatgctgctgcctgcctttgtgttcatcggcctggagcaggatgactgctgcggctgctgcggccacgagaactgtgggaagagatgtgccatgctgagctctgtgctggccgccctgattggaattgctggcagcggctactgtgtgattgtggccgccctgggcctggccgagggccccctgtgcctggacagcctgggccagtggaactacacctttgccagcacagagggccagtacctgctggacaccagcacctggagcgagtgcacagagcccaagcacatcgtggagtggaatgtgtccctcttcagcatcctgctggccctgggcggcatcgagttcatcctgtgcctgatccaggtgatcaatggagtgctgggcggcatctgtggcttctgctgcagccaccagcagcagatgacagccaagaggaccaaccctggccagagccacaacctgcccctcttccactgcaacctgtacatcagcctggtgttcatctgcaagaccctgtactag

SEQ ID NO: 173919 - DNA, 609 bp, Artificial Sequence
  Description of Artificial Sequence: Synthetic coding sequence
atgtgcacaggaggctgtgcccgctgcctgggcggcaccctcatccccctggccttcttcggcttcctggccaacatcctgctcttcttccctgggggcaaggtgattgatgacaatgaccacctgagccaggagatctggttctttggaggcatcctgggcagcggcgtgctgatgatcttccctgccctggtgttcctgggcctgaagaacaatgactgctgcggctgctgcggaaatgaaggctgcggcaagagatttgccatgttcaccagcaccatctttgctgtggtgggcttcctgggcgccggctacagcttcatcatcagcgccatcagcatcaacaagggccccaagtgcctgatggccaacagcacctggggctaccccttccatgatggagactacctgaatgatgaggccctgtggaacaagtgccgggagcccctgaatgtggtgccctggaacctgaccctcttcagcatcctgctggtggtgggcggcatccagatggtgctgtgtgccatccaggtggtgaatggcctgctgggcaccctgtgtggggactgccagtgctgcggctgctgcggaggagatggccctgtgtag

SEQ ID NO: 173920 - DNA, 594 bp, Artificial Sequence
  Description of Artificial Sequence: Synthetic coding sequence
atgtgcacaggaaaatgtgcccgctgtgtgggcctgagcctcatcaccctgtgcctggtgtgcatcgtggccaatgccctgctgctggtgcccaacggggagacctcctggaccaacaccaaccacctgagcctgcaggtgtggctgatgggcggcttcatcggcggcggcctgatggtgctgtgccccggcattgctgctgtgcgggccggcggcaagggctgctgcggggccggctgctgcggcaaccgctgcaggatgctgcggagcgtcttcagcagcgccttcggcgtgctgggcgccatctactgcctgtctgtgtctggggccggcctgagaaatggcccccgctgcctgatgaatggagagtggggctaccactttgaggacacagctggggcctacctgctgaacagaaccctgtgggacagatgtgaggccccaccccgggtggtgccctggaatgtgaccctcttcagcctgctggtggccgccagctgcctggagatcgtgctgtgtggcatccagctggtgaatgccaccatcggggtcttctgtggggactgcaggaagaagcaggacaccccccactag

SEQ ID NO: 173921 - DNA, 438 bp, Artificial Sequence
  Description of Artificial Sequence: Synthetic coding sequence
atgtctgccagcgctgccactggagtgtttgtgctgagcctgagcgccatccctgtgacctacgtgttcaaccacctggccgcccagcacgacagctggaccatcgtgggcgtggccgccctgatcctcttcctggtggccctgctggcccgggtgctggtgaagaggaagccaccccgggaccccctcttctacgtgtatgctgtgtttggcttcacctctgtggtgaacctgatcatcggcctggagcaggacggcatcattgatggcttcatgacccactacctgcgggagggggagccctacctgaacacagcctacggccacatgatctgctactgggatggcagcgcccactacctgatgtacctggtgatggtggccgccatcgcctgggagtgctggcacatctgcagcatcctcttcctgaccctgtag

SEQ ID NO: 173922 - DNA, 1113 bp, Artificial Sequence
  Description of Artificial Sequence: Synthetic coding sequence
atgtctgccagcgctgccactggagtgtttgtgctgagcctgagcgccatccctgtgacctacgtgttcaaccacctggccgcccagcacgacagctggaccatcgtgggcgtggccgccctgatcctcttcctggtggccctgctggcccgggtgctggtgaagaggaagccaccccgggaccccctcttctacgtgtatgctgtgtttggcttcacctctgtggtgaacctgatcatcggcctggagcaggacggcatcattgatggcttcatgacccactacctgcgggagggggagccctacctgaacacagcctacggccacatgatctgctactgggatggcagcgcccactacctgatgtacctggtgatggtggccgccatcgcctgggaggagacctaccgcaccatcggcctgtactgggtgggcagcatcatcatgtctgtggtggtgtttgtgcccggcaacatcgtgggcaagtatggcacccgcatctgcccagccttcttcctgagcatcccctacacctgcctgcctgtgtgggccggcttccgcatctacaaccagcccagcgagaactacaactaccccagcaaggtgatccaggaggcccaggccaaggacctgctgcggcggccctttgacctgatgctggtggtgtgcctgctgctggccaccggcttctgcctcttccggggcctgattgccctggactgccccagcgagctgtgccgcctgtacacccagttccaggagccctacctgaaggaccctgctgcctaccccaagatccagatgctggcctacatgttctacagcgtgccctactttgtgacagccctgtatggcctggtggtgcccggctgctcctggatgccagacatcaccctcatccacgccggcggcctggcccaggcccagttcagccacatcggggccagcctgcacgccaggacagcctacgtgtacagagtgcctgaggaggccaagatcctcttcctggccctgaacatcgcctacggcgtgctgccccagctgctggcctaccgctgcatctacaagccagagttcttcatcaagaccaaggccgaggagaaggtggagtag

SEQ ID NO: 173923 - DNA, 1020 bp, Artificial Sequence
  Description of Artificial Sequence: Synthetic coding sequence
atgtctgccagcgctgccactggagtgtttgtgctgagcctgagcgccatccctgtgacctacgtgttcaaccacctggccgcccagcacgacagctggaccatcgtgggcgtggccgccctgatcctcttcctggtggccctgctggcccgggtgctggtgaagaggaagccaccccgggaccccctcttctacgtgtatgctgtgtttggcttcacctctgtggtgaacctgatcatcggcctggagcaggacggcatcattgatggcttcatgacccactacctgcgggagggggagccctacctgaacacagcctacggccacatgatctgctactgggatggcagcgcccactacctgatgtacctggtgatggtggccgccatcgcctgggaggagacctaccgcaccatcggcctgtactgggtgggcagcatcatcatgtctgtggtggtgtttgtgcccggcaacatcgtgggcaagtatggcacccgcatctgcccagccttcttcctgagcatcccctacacctgcctgcctgtgtgggccggcttccgcatctacaaccagcccagcgagaactacaactaccccagcaaggtgatccaggaggcccaggccaaggacctgctgcggcggccctttgacctgatgctggtggtgtgcctgctgctggccaccggcttctgcctcttccggggcctgatgctggcctacatgttctacagcgtgccctactttgtgacagccctgtatggcctggtggtgcccggctgctcctggatgccagacatcaccctcatccatgctgggggcctggcccaggcccagttcagccacatcggggccagcctgcacgccaggacagcctacgtgtacagagtgcctgaggaggccaagatcctcttcctggccctgaacatcgcctatggagtgctgccccagctgctggcctaccgctgcatctacaagccagagttcttcatcaagaccaaggccgaggagaaggtggagtag

SEQ ID NO: 173924 - DNA, 1122 bp, Artificial Sequence
  Description of Artificial Sequence: Synthetic coding sequence
atgtctgccagcgctgccactggagtgtttgtgctgagcctgagcgccatccctgtgacctacgtgttcaaccacctggccgcccagcacgacagctggaccatcgtgggcgtggccgccctgatcctcttcctggtggccctgctggcccgggtgctggtgaagaggaagccaccccgggaccccctcttctacgtgtatgctgtgtttggcttcacctctgtggtgaacctgatcatcggcctggagcaggacggcatcattgatggcttcatgacccactacctgcgggagggggagccctacctgaacacagcctacggccacatgatctgctactgggatggcagcgcccactacctgatgtacctggtgatggtggccgccatcgcctgggactgctaccgggagacctaccgcaccatcggcctgtactgggtgggcagcatcatcatgtctgtggtggtgtttgtgcccggcaacatcatcggcaagtatggcacccgcatctgcccagccttcttcctgagcatcccctacacctgcctgcctgtgtgggccggcttccgcatctacaaccagcccagcgagaactacaactaccccagcaaggtgatccaggaggcccaggccaaggacctgctgcggcggccctttgacctgatgctggtggtgtgcctgctgctggccaccggcttctgcctcttccggggcctcatcgccctggactgccccagcgagctgtgccgcctgtacacccagttccaggagccctacctgaaggaccctgctgcctaccccaagatccagatgctggcctacatgttctacagcgtgccctactttgtgacagccctgtatggcctggtggtgcccggctgctcctggatgccagacatcaccctcatccatgctgggggcctggcccaggcccagttcagccacatcggggccagcctgcacgccaggacagcctacgtgtacagagtgcctgaggaggccaagatcctcttcctggccctgaacatcgcctatggagtgctgccccagctgctggcctaccgctgcatctacaagccagagttcttcatcaagaccaaggccgaggagaaggtggagtag

SEQ ID NO: 173925 - DNA, 567 bp, Artificial Sequence
  Description of Artificial Sequence: Synthetic coding sequence
atgtctgccagcgctgccactggagtgtttgtgctgagcctgagcgccatccctgtgacctacgtgttcaaccacctggccgcccagcacgacagctggaccatcgtgggcgtggccgccctgatcctcttcctggtggccctgctggcccgggtgctggtgaagaggaagccaccccgggaccccctcttctacgtgtatgctgtgtttggcttcacctctgtggtgaacctgatcatcggcctggagcaggacggcatcattgatggcttcatgacccactacctgcgggagggggagccctacctgaacacagcctacggccacatgatctgctactgggatggcagcgcccactacctgatgtacctggtgatggtggccgccatcgcctgggaggagacctaccgcaccatcggcctgtactgggtgggcagcatcatcatgtctgtggtggtgtttgtgcccggcaacatcgtggatgctggcatctacgtgctcttctgcagcctgctgtgtgactgcaccgtgtggctgagcggctcctggatgttcctggatgcctag

SEQ ID NO: 173926 - DNA, 1020 bp, Artificial Sequence; identical to SEQ ID NO: 173923
  Description of Artificial Sequence: Synthetic coding sequence

SEQ ID NO: 173927 - DNA, 1056 bp, Artificial Sequence
  Description of Artificial Sequence: Synthetic coding sequence
atggacatcccccccctggccggcaagattgctgccctgagcctgagcgccctgcctgtgtcctatgccctgaaccacgtgtctgccctgagccaccccctgtgggtggccctgatgtctgccctgatcctgggcctgctgtttgtggccgtgtacagcctgagccacggggaggtgtcctatgaccccctgtatgctgtgtttgctgtgtttgccttcacctctgtggtggacctgatcatcgccctgcaggaggacagctatgtggtgggcttcatggagttctacaccaaggagggggagccctacctgaggacagcccacggcgtcttcatctgctactgggatggcaccgtgcactacctgctgtacctggccatggccggggccatctgcaggaggaagcgctacagaaactttggcctgtactggctgggcagctttgccatgagcatcctggtgttcctgactggaaacatcctgggcaagtacagcagcgagatccggcctgccttcttcctgaccatcccctacctgctggtgccctgctgggccggcatgaaggtgttcagccagccccgggccctgacccgctgcacagccaacatggtgcaggaggagcagaggaagggcctgctgcagaggcctgctgacctggccctggtgatctacctgatcctggccggcttcttcaccctcttccggggcctggtggtgctggactgccccacagatgcctgctttgtgtacatctaccagtatgagccctacctgcgggaccctgtggcctaccccaaggtgcagatgctgatgtacatgttttatgtgctgcccttctgtggcctggccgcctatgccctgaccttccctggctgctcctggctgcctgactgggccctggtgtttgctgggggcatcggccaggcccagttcagccacatgggcgcctccatgcacctgcggacccccttcacctaccgctgcctgcagtggccagccttcttccaccagcccccacccagcgaccccctggccctgcacaagaagcagcactag

SEQ ID NO: 173928 - DNA, 1134 bp, Artificial Sequence
  Description of Artificial Sequence: Synthetic coding sequence
atggacatcccccccctggccggcaagattgctgccctgagcctgagcgccctgcctgtgtcctatgccctgaaccacgtgtctgccctgagccaccccctgtgggtggccctgatgtctgccctgatcctgggcctgctgtttgtggccgtgtacagcctgagccacggggaggtgtcctatgaccccctgtatgctgtgtttgctgtgtttgccttcacctctgtggtggacctgatcatcgccctgcaggaggacagctatgtggtgggcttcatggagttctacaccaaggagggggagccctacctgaggacagcccacggcgtcttcatctgctactgggatggcaccgtgcactacctgctgtacctggccatggccggggccatctgcaggaggaagcgctacagaaactttggcctgtactggctgggcagctttgccatgagcatcctggtgttcctgactggaaacatcctgggcaagtacagcagcgagatccggcctgccttcttcctgaccatcccctacctgctggtgccctgctgggccggcatgaaggtgttcagccagccccgggccctgacccgctgcacagccaacatggtgcaggaggagcagaggaagggcctgctgcagaggcctgctgacctggccctggtgatctacctgatcctggccggcttcttcaccctcttccggggcctggtggtgctggactgccccacagatgcctgctttgtgtacatctaccagtatgagccctacctgcgggaccctgtggcctaccccaaggtgcagatgctgatgtacatgttttatgtgctgcccttctgtggcctggccgcctatgccctgaccttccctggctgctcctggctgcctgactgggccctggtgtttgctgggggcatcggccaggcccagttcagccacatgggcgcctccatgcacctgcggacccccttcacctacagagtgcctgaggacacctggggctgcttctttgtgtgcaacctgctgtatgccctgggcccccacctgctggcctaccgctgcctgcagtggccagccttcttccaccagcccccacccagcgaccccctggccctgcacaagaagcagcactag

SEQ ID NO: 173929 - DNA, 642 bp, Artificial Sequence
  Description of Artificial Sequence: Synthetic coding sequence
atggacatcccccccctggccggcaagattgctgccctgagcctgagcgccctgcctgtgtcctatgccctgaaccacgtgtctgccctgagccaccccctgtgggtggccctgatgtctgccctgatcctgggcctgctgtttgtggccgtgtacagcctgagccacggggaggtgtcctatgaccccctgtatgctgtgtttgctgtgtttgccttcacctctgtggtggacctgatcatcgccctgcaggaggacagctatgtggtgggcttcatggagttctacaccaaggaggtgctgggcggccggcccggcagccccctgccccactgccccagcgagagccccacctgcccccaccgggagagccacacctgtgcccagaggacagagagcagcagcgccaccggcatggccctcttcaccaccagcagcacctggccctggccagcccccagcgctgagggcgctgggggccgggagcgggtggccccagaccccggccgggaggtggccagcagtgatggagtgcccggccagggcggggcccggtctgtgtgcagaagaaaccaggatgccagcctgggcctgcagcccggggtggcccggcggcgcttccagggcaccagccaggtgtag

SEQ ID NO: 173930 - DNA, 1257 bp, Artificial Sequence
  Description of Artificial Sequence: Synthetic coding sequence
atggcccccacccagggcccccgggcccccctggagtttggaggccccctgggcgccgccgccctgctgctgctgctgcctgccaccatgttccacctgctgctggccgcccggagcggccctgcccggctgctgggccccccagccagcctgcccggcctggaggtgctgtggagcccccgggccctgctgctgtggctggcctggctgggcctgcaggccgccctgtacctgctgcctgccaggaaggtggccgagggccaggagctgaaggacaagagccggctgcgctaccccatcaatggcttccaggccctggtgctgacagccctgctggtgggcctgggcatgtctgctggcctgcccctgggcgccctgcctgagatgctgctgcccctggcctttgtggccaccctgacagccttcatcttcagcctcttcctgtacatgaaggcccaggtggcccctgtgtctgccctggcccctgggggcaacagcggcaaccccatctatgacttcttcctgggccgggagctgaacccccgcatctgcttctttgacttcaagtacttctgtgagctgcggcccggcctgattggctgggtgctgatcaacctggccctgctgatgaaggaggccgagctgcggggcagccccagcctggccatgtggctggtgaatggcttccagctgctgtatgtgggagatgccctgtggcatgaggaggccgtgctgaccaccatggacatcacccatgatggcttcggcttcatgctggcctttggagacatggcctgggtgcccttcacctacagcctgcaggcccagttcctgctgcaccacccccagcccctgggcctgcccatggccagcgtcatctgcctgatcaatgccaccggctactacatcttccggggggccaacagccagaagaacaccttcaggaagaaccccagcgacccccgggtggccggcctggagaccatcagcacagccactggaaggaagctgctggtgtctggctggtggggcatggtgcgccaccccaactacctgggggacctgatcatggccctggcctggagcctgccctgtggggtgagccacctgctgccctacttctacctgctgtacttcaccgccctgctggtgcaccgggaggccagagatgagcggcagtgcctgcagaagtatggcctggcctggcaggagtactgcagaagagtgccctaccgcatcatgccctacatctactag

SEQ ID NO: 173931 - DNA, 1176 bp, Artificial Sequence
  Description of Artificial Sequence: Synthetic coding sequence
atggcccccacccagggcccccgggcccccctggagtttggaggccccctgggcgccgccgccctgctgctgctgctgcctgccaccatgttccacctgctgctggccgcccggagcggccctgcccggctgctgggccccccagccagcctgcccggcctggaggtgctgtggagcccccgggccctgctgctgtggctggcctggctgggcctgcaggccgccctgtacctgctgcctgccaggaaggtggccgagggccaggagctgaaggacaagagccggctgcgctaccccatcaatggcttccaggccctggtgctgacagccctgctggtgggcctgggcatgtctgctggcctgcccctgggcgccctgcctgagatgctgctgcccctggcctttgtggccaccctgacagccttcatcttcagcctcttcctgtacatgaaggcccaggtggcccctgtgtctgccctggcccctgggggcaacagcggcaaccccatctatgacttcttcctgggccgggagctgaacccccgcatctgcttctttgacttcaagtacttctgtgagctgcggcccggcctgattggctgggtgctgatcaacctggccctgctgatgaaggaggccgagctgcggggcagccccagcctggccatgtggctggtgaatggcttccagctgctgtatgtgggagatgccctgtggcatgaggaggccgtgctgaccaccatggacatcacccatgatggcttcggcttcatgctggcctttggagacatggcctgggtgcccttcacctacagcctgcaggcccagttcctgctgcaccacccccagcccctgggcctgcccatggccagcgtcatctgcctgatcaatggcctggagaccatcagcacagccaccggcaggaagctgctggtgtctggctggtggggcatggtgcgccaccccaactacctgggggacctgatcatggccctggcctggagcctgccctgtggggtgagccacctgctgccctacttctacctgctgtacttcaccgccctgctggtgcaccgggaggccagagatgagcggcagtgcctgcagaagtatggcctggcctggcaggagtactgccggcgggtgccctaccgcatcatgccctacatctactag

SEQ ID NO: 173932 - DNA, 909 bp, Artificial Sequence
  Description of Artificial Sequence: Synthetic coding sequence
atgtctgctggcctgcccctgggcgccctgcctgagatgctgctgcccctggcctttgtggccaccctgacagccttcatcttcagcctcttcctgtacatgaaggcccaggtggcccctgtgtctgccctggcccctgggggcaacagcggcaaccccatctatgacttcttcctgggccgggagctgaacccccgcatctgcttctttgacttcaagtacttctgtgagctgcggcccggcctgattggctgggtgctgatcaacctggccctgctgatgaaggaggccgagctgcggggcagccccagcctggccatgtggctggtgaatggcttccagctgctgtatgtgggagatgccctgtggcatgaggaggccgtgctgaccaccatggacatcacccatgatggcttcggcttcatgctggcctttggagacatggcctgggtgcccttcacctacagcctgcaggcccagttcctgctgcaccacccccagcccctgggcctgcccatggccagcgtcatctgcctgatcaatgccaccggctactacatcttccggggggccaacagccagaagaacaccttcaggaagaaccccagcgacccccgggtggccggcctggagaccatcagcacagccactggaaggaagctgctggtgtctggctggtggggcatggtgcgccaccccaactacctgggggacctgatcatggccctggcctggagcctgccctgtggggtgagccacctgctgccctacttctacctgctgtacttcaccgccctgctggtgcaccgggaggccagagatgagcggcagtgcctgcagaagtatggcctggcctggcaggagtactgcagaagagtgccctaccgcatcatgccctacatctactag

SEQ ID NO: 173933 - DNA, 1713 bp, Artificial Sequence
  Description of Artificial Sequence: Synthetic coding sequence
atgggcttcctgcagctgctggtggtggccgtgctggccagcgagcaccgggtggccggggctgctgaggtgtttggaaacagcagcgagggcctgattgagttctctgtgggcaagttccgctactttgagctgaaccggcccttccctgaggaggccatcctgcatgacatcagcagcaatgtgaccttcctgatcttccagatccacagccagtaccagaacaccaccgtgtccttcagccccaccctgctgagcaacagcagcgagactggaacagccagcggcctggtgttcatcctgcggcctgagcagagcacctgcacctggtacctgggcaccagcggcatccagcctgtgcagaacatggccatcctgctgagctacagcgagcgggaccctgtgcctgggggctgcaacctggagtttgacctggacatcgaccccaacatctacctggagtacaacttctttgagaccaccatcaagtttgccccagccaacctgggctacgcccggggcgtggaccccccaccctgtgatgctggaacagaccaggacagccgctggaggctgcagtatgatgtgtaccagtacttcctgcctgaaaatgacctgacagaggagatgctgctgaagcacctgcagaggatggtgtctgtgccccaggtgaaggccagcgccctgaaggtggtgaccctgacagccaatgacaagacctctgtgtccttcagcagcctgcccggccagggcgtcatctacaacgtgattgtgtgggaccccttcctgaacaccagcgctgcctacatcccagcccacacctacgcctgcagctttgaagctggggagggcagctgtgccagcctgggccgggtgagcagcaaggtgttcttcaccctgtttgccctgctgggcttcttcatctgcttcttcggccaccgcttctggaagacagagctgttcttcatcggcttcatcatcatgggcttcttcttctacatcctgatcacccggctgacccccatcaagtatgatgtgaacctgatcctgacagctgtgacaggctctgtgggcggcatgttcctggtggccgtgtggtggaggtttggcatcctgagcatctgcatgctgtgtgtgggcctggtgctgggcttcctgatcagctctgtgaccttcttcacccccctgggcaacctgaagatcttccatgatgatggagtcttctgggtgaccttcagctgcatcgccatcctgatccctgtggtgttcatgggctgcctgcgcatcctgaacatcctgacctgtggggtcatcggcagctacagcgtggtgctggccatcgacagctactggagcaccagcctgagctacatcaccctgaatgtgctgaagagggccctgaacaaggacttccaccgggccttcaccaacgtgcccttccagaccaatgacttcatcatcctggccgtgtggggcatgctggccgtgtctggcatcaccctgcagatccggcgggagcggggccggcccttcttccccccccacccctacaagctgtggaagcaggagcgggagcggcgggtgaccaacatcctggaccccagctaccacatcccccccctgcgggagcggctgtatggccgcctgacccagatcaagggcctcttccagaaggagcagcctgctggggagaggacccccctgctgctgtag

SEQ ID NO: 173934 - DNA, 351 bp, Artificial Sequence
  Description of Artificial Sequence: Synthetic coding sequence
atgggcttcctgcagctgctggtggtggccgtgctggccagcgagcaccgggtggccggggctgctgaggtgtttggaaacagcagcgaggtgtacctggtggtgggcctcatcgagttctctgtgggcaagttccgctactttgagctgaaccggcccttccctgaggaggccatcctgcatgacatcagcagcaatgtgaccttcctgatcttccagatccacagccagtaccagaacaccaccgtgtccttcagccccaccctgctgagcaacagcagcgagaccggcacagccagcggcctggtgttcatcctgcggcctgagcagagcacctgcacctggtactag

SEQ ID NO: 173935 - DNA, 1413 bp, Artificial Sequence
  Description of Artificial Sequence: Synthetic coding sequence
atgggcatctggaccagcggcacagacatcttcctgagcctgtgggagatctacgtgagccccaggagccctggctggatggacttcatccagcacctgggcgtgtgctgcctggtggccctgatctctgtgggcctgctgtctgtggccgcctgctggttcctgcccagcatcatcgctgctgctgcctcctggatcatcacctgtgtgctgctgtgctgcagcaagcacgcccgctgcttcatcctgctggtgttcctgagctgtggcctgcgggagggcagaaatgccctgattgctgctggcactggaattgtcatcctgggccacgtggagaacatcttccacaacttcaagggcctgctggatggcatgacctgcaacctgcgggccaagagcttcagcatccacttccccctgctgaagaagtacatcgaggccatccagtggatctacggcctggccacccccctgtctgtgtttgatgacctggtgtcctggaaccagaccctggccgtgtccctcttcagccccagccacgtgctggaggcccagctgaatgacagcaagggggaggtgctgtctgtgctgtaccagatggccaccaccacagaggtgctgagcagcctgggccagaagctgctggcctttgctggcctgagcctggtgctgctgggcaccggcctcttcatgaagcgcttcctgggcccctgtggctggaagtatgagaacatctacatcacccggcagtttgtgcagtttgatgagcgggagcggcaccagcagaggccctgtgtgctgcccctgaacaaggaggagaggaggaaatatgtgatcatccccaccttctggcccacccccaaggagaggaagaacctgggcctcttcttcctgcccatcctgatccacctgtgcatctgggtgctgtttgctgctgtggactacctgctgtaccgcctcatcttctctgtgtccaagcagttccagagcctgcccggctttgaggtgcacctgaagctgcatggagagaagcagggcacccaggacatcatccatgacagcagcttcaacatctctgtgtttgagcccaactgcatccccaagcccaagttcctgctgtctgagacctgggtgcccctgagcgtcatcctgctgatcctggtgatgctgggcctgctgagcagcatcctgatgcagctgaagatcctggtgtctgccagcttctaccccagcgtggagaggaagaggatccagtacctgcacgccaagctgctgaagaagaggagcaagcagcccctgggggaggtgaagaggcggctgagcctgtacctgaccaagatccacttctggctgcctgtgctgaagatgatcaggaagaagcagatggacatggccagcgctgacaagagctag

SEQ ID NO: 173936 - DNA, 567 bp, Artificial Sequence
  Description of Artificial Sequence: Synthetic coding sequence
atgagcaccatgtttgctgacaccctgctgattgtgttcatctctgtgtgcacagccctgctggccgagggcatcacctgggtgctggtgtacagaacagacaagtacaagaggctgaaggccgaggtggagaagcagagcaagaagctggagaagaagaaggagaccatcacagagagcgctggccggcagcagaagaagaagattgagcggcaggaggagaagctgaagaacaacaacagagacctgtccatggtgaggatgaagtccatgtttgccatcggcttctgcttcaccgccctgatgggcatgttcaacagcatctttgatggccgggtggtggccaagctgcccttcacccccctgagctacatccagggcctgagccacaggaacctgctgggagatgacaccacagactgcagcttcatcttcctgtacatcctgtgcaccatgagcatccggcagaacatccagaagatcctgggcctggcccccagcagagctgccaccaagcaggccggcggcttcctgggccccccaccacccagcggcaagttctcctag

SEQ ID NO: 173937 - DNA, 510 bp, Artificial Sequence
  Description of Artificial Sequence: Synthetic coding sequence
atgagcaccatgtttgctgacaccctgctgattgtgttcatctctgtgtgcacagccctgctggccgagggcatcacctgggtgctggtgtacagaacagacaagtacaagaggctgaaggccgaggtggagaagcagagcaagaagctggagaagaagaaggagaccatcacagagagcgctggccggcagcagaaggtgaggatgaagtccatgtttgccatcggcttctgcttcaccgccctgatgggcatgttcaacagcatctttgatggccgggtggtggccaagctgcccttcacccccctgagctacatccagggcctgagccacaggaacctgctgggagatgacaccacagactgcagcttcatcttcctgtacatcctgtgcaccatgagcatccggcagaacatccagaagatcctgggcctggcccccagccgggccgccaccaagcaggccggcggcttcctgggccccccacctccttctgggaagttctcctag

SEQ ID NO: 173938 - DNA, 603 bp, Artificial Sequence
  Description of Artificial Sequence: Synthetic coding sequence
atgatgcactacgtggactacagcatgatgtaccacctgatccggggccagagcgtcatcaagctgtacatcatctacaacatgctggaggtggccgacaggctcttcagcagctttggccaggacatcctggatgccctgtactggacagccacagagcccaaggagaggaagagggcccacatcggctttgtggagatcaagggcagcgtcttcaagaagtttgagaagaacaacctcttccagatgagcaacagcgacatcaaggagcgcttcaccaactacgtgctgctgctgattgtgtgcctgaggaacatggagcagttctcctggaacccagaccacctgtgggtgctcttcccagatgtgtgcatggtgattgccagcgagattgctgtggacatcgtgaagcacgccttcatcaccaagttcaatgacatcacagcagatgtgtacagcgagtaccgggccagcctggcctttgacctggtgagcagccggcagaagaatgcctacacagactacagcgacagcgtggcccggaggatgggcttcatccccctgcccctggccgtgctggtggacatccctgagagcacctag

SEQ ID NO: 173939 - DNA, 1371 bp, Artificial Sequence
  Description of Artificial Sequence: Synthetic coding sequence
atggtgtttggcatcttcctgtgcctggatgccttcctgtatgtgttcaccctgctgcccctgcgggtcttcctggccctcttccggctgctgaccctgccctgctacggcctgcgggaccggcggctgctgcagcctgcccaggtgtgtgacatcctgaagggcgtcatcctggtgatctgctacttcatgatgcactacgtggactacagcatgatgtaccacctgatccggggccagagcgtcatcaagctgtacatcatctacaacatgctggaggtggccgacaggctcttcagcagctttggccaggacatcctggatgccctgtactggacagccacagagcccaaggagaggaagagggcccacatcggggtcatcccccacttcttcatggctgtgctgtatgtgttcctgcacgccatcctgatcatggtgcaggccaccaccctgaatgtggccttcaacagccacaacaagagcctgctgaccatcatgatgagcaacaactttgtggagatcaagggcagcgtcttcaagaagtttgagaagaacaacctcttccagatgagcaacagcgacatcaaggagcgcttcaccaactacgtgctgctgctgattgtgtgcctgaggaacatggagcagttctcctggaacccagaccacctgtgggtgctcttcccagatgtgtgcatggtgattgccagcgagattgctgtggacatcgtgaagcacgccttcatcaccaagttcaatgacatcacagcagatgtgtacagcgagtaccgggccagcctggcctttgacctggtgagcagccggcagaagaatgcctacacagactacagcgacagcgtggcccggaggatgggcttcatccccctgcccctggccgtgctgctgatccgggtggtgaccagcagcatcaaggtgcagggcatcctgtcctatgcctgcgtcatcctcttctacttcggcctcatcagcctgaaggtgctgaacagcatcgtgctgctgggcaagagctgccagtatgtgaaggaggccaagatggaggagaagctgagcaaccccccagccacctgcaccccaggcaagcccagcagcaagagccagaacaagtgcaagcccagccagggcctgagcacagaggagaacctgagcgccagcatcaccaagcagcccatccaccagaaggagaacatcatccccctgctggtgaccagcaacagcgaccagttcctgaccaccccagatggagatgagaaggacatcacccaggacaacagcgagctgaagcacaggagcagcaagaaggacctgctggagattgaccgcttcaccatctgtggcaacagaattgattag

SEQ ID NO: 173940 - DNA, 1704 bp, Artificial Sequence
  Description of Artificial Sequence: Synthetic coding sequence
atggccggcgtgggagatgctgctgcccctggagagggcggcggcggcggcgtggatggcccccagagagatggccgcggggaggccgagcagcccggcggcagcggcggccagggccccccaccagccccccagctgacagagaccctgggcttctatgaaagtgacagaagaagagaaagaagaagaggaagaacagagctgagcctgctgcgcttcctgtctgctgagctgacccggggctacttcctggagcacaatgaggccaagtacacagagcggcgggagcgggtgtacacctgcctgcgcatcccccgggagctggagaagctgatggtgtttggcatcttcctgtgcctggatgccttcctgtatgtgttcaccctgctgcccctgcgggtcttcctggccctcttccggctgctgaccctgccctgctacggcctgcgggaccggcggctgctgcagcctgcccaggtgtgtgacatcctgaagggcgtcatcctggtgatctgctacttcatgatgcactacgtggactacagcatgatgtaccacctgatccggggccagagcgtcatcaagctgtacatcatctacaacatgctggaggtggccgacaggctcttcagcagctttggccaggacatcctggatgccctgtactggacagccacagagcccaaggagaggaagagggcccacatcggggtcatcccccacttcttcatggctgtgctgtatgtgttcctgcacgccatcctgatcatggtgcaggccaccaccctgaatgtggccttcaacagccacaacaagagcctgctgaccatcatgatgagcaacaactttgtggagatcaagggctctgtgttcaagaagtttgagaagaacaacctcttccagatgagcaacagcgacatcaaggagcgcttcaccaactacgtgctgctgctgattgtgtgcctgaggaacatggagcagttctcctggaacccagaccacctgtgggtgctcttcccagatgtgtgcatggtgattgccagcgagattgctgtggacatcgtgaagcacgccttcatcaccaagttcaatgacatcacagcagatgtgtacagcgagtaccgggccagcctggcctttgacctggtgagcagccggcagaagaatgcctacacagactacagcgacagcgtggcccggaggatgggcttcatccccctgcccctggccgtgctgctgatccgggtggtgaccagcagcatcaaggtgcagggcatcctgtcctatgcctgtgtgatcctcttctacttcggcctcatcagcctgaaggtgctgaacagcatcgtgctgctgggcaagagctgccagtatgtgaaggaggccaagatggaggagaagctgagcaaccccccagccacctgcacccctgggaagcccagcagcaagagccagaacaagtgcaagcccagccagggcctgagcacagaggagaacctgagcgccagcatcaccaagcagcccatccaccagaaggagaacatcatccccctgctggtgaccagcaacagcgaccagttcctgaccaccccagatggagatgagaaggacatcacccaggacaacagcgagctgaagcacaggagcagcaagaaggacctgctggagattgaccgcttcaccatctgtggcaacagaattgattag

SEQ ID NO: 173941 - DNA, 1689 bp, Artificial Sequence
  Description of Artificial Sequence: Synthetic coding sequence
atggccggcgtgggagatgctgctgcccctggagagggcggcggcggcggcgtggatggcccccagagagatggccgcggggaggccgagcagcccggcggcagcggcggccagggccccccaccagccccccagctgacagagaccctgggcttctatgaaagtgacagaagaagagaaagaagaagaggaagaacagagctgagcctgctgcgcttcctgtctgctgagctgacccggggctacttcctggagcacaatgaggccaagtacacagagcggcgggagcgggtgtacacctgcctgcgcatcccccgggagctggagaagctgatggtgtttggcatcttcctgtgcctggatgccttcctgtatgtgttcaccctgctgcccctgcgggtcttcctggccctcttccggctgctgaccctgccctgctacggcctgcgggaccggcggctgctgcagcctgcccaggtgtgtgacatcctgaagggcgtcatcctggtgatctgctacttcatgatgcactacgtggactacagcatgatgtaccacctgatccggggccagagcgtcatcaagctgtacatcatctacaacatgctggaggtggccgacaggctcttcagcagctttggccaggacatcctggatgccctgtactggacagccacagagcccaaggagaggaagagggcccacatcggggtcatcccccacttcttcatggctgtgctgtatgtgttcctgcacgccatcctgatcatggtgcaggccaccaccctgaatgtggccttcaacagccacaacaagagcctgctgaccatcatgatgagcaacaactttgtggagatcaagggctctgtgttcaagaagtttgagaagaacaacctcttccagatgagcaacagcgacatcaaggagcgcttcaccaactacgtgctgctgctgattgtgtgcctgaggaacatggagcagttctcctggaacccagaccacctgtgggtgctcttcccagatgtgtgcatggtgattgccagcgagattgctgtggacatcgtgaagcacgccttcatcaccaagttcaatgacatcacagcagatgtgtacagcgagtaccgggccagcctggcctttgacctggtgagcagccggcagaagaatgcctacacagactacagcgacagcgtggcccggaggatgggcttcatccccctgcccctggccgtgctgctgatccgggtggtgaccagcagcatcaaggtgcagggcatcctgtcctatgcctgtgtgatcctcttctacttcggcctcatcagcctgaaggtgctgaacagcatcgtgctgctgggcaagagctgccagtatgtgaaggaggccaagatggaggagaagctgagcaaccccccagccacctgcacccctgggaagcccagcagcaagagccagaacaagtgcaagcccagccagggcctgagcacagaggagaacctgagcgccagcatcaccaagcagcccatccaccagaaggagaacatcatccccctgctggtgaccagcaacagcgaccagttcctgaccaccccagatggagatgagaaggacatcacccaggacaacagcgagctgaagcacaggagcagcaagtctgtgctgctgtgccagagcggcctgcctgaatgttag

SEQ ID NO: 173942 - DNA, 2283 bp, Artificial Sequence
  Description of Artificial Sequence: Synthetic coding sequence
atgagccccaagaaggtgcagatcaaggtggaggagaaggaggatgaaacagaggagagcagcagcgaggaggaggaggaggtggaggacaagctgccccggcgggagagcctgcggcccaagaggaagaggaccagagatgtgatcaatgaagatgatcctgagcctgagccagaagatgaggagaccaggaaggcccgggagaaggagaggagaagaaggctgaagagaggagctgaggaggaggagattgatgaggaggagctggagcggctgaaggccgagctggatgagaagaggcagatcatcgccaccgtgaagtgcaagccctggaagatggagaagaagattgaggtgctgaaggaggccaagaagtttgtgtctgaaaatgaaggagccctgggcaagggcaagggcaagcgctggtttgccttcaagatgatgatggccaagaagtgggccaagttcctgcgggactttgagaacttcaaggccgcctgtgtgccctgggagaacaagatcaaggccatcgagagccagtttggcagctctgtggccagctacttcctgttcctgcgctggatgtatggagtgaacatggtgctcttcatcctgaccttcagcctcatcatgctgcctgagtacctgtggggcctgccctacggcagcctgcccaggaagacagtgcccagggctgaggaggccagcgctgccaactttggagtgctgtatgacttcaacggcctggcccagtacagcgtgctcttctacggctactatgacaacaagaggaccatcggctggatgaacttccggctgcccctgagctacttcctggtgggcatcatgtgcatcggctacagcttcctggtggtgctgaaggccatgaccaagaacattggagatgatggcggcggagatgacaacaccttcaacttctcctggaaggtgttcacctcctgggactacctgattggcaaccctgagacagctgacaacaagttcaacagcatcaccatgaacttcaaggaggccatcacagaggagaaggccgcccaggtggaggagaatgtgcacctgatccgcttcctgcgcttcctggccaacttctttgtgttcctgaccctgggcggcagcggctacctgatcttctgggccgtgaagaggagccaggagtttgcccagcaggaccctgacaccctgggctggtgggagaagaatgagatgaacatggtgatgagcctgctgggcatgttctgccccaccctgtttgacctgtttgctgagctggaggactaccaccccctgattgccctgaagtggctgctgggccgcatctttgccctgctgctgggcaacctgtatgtgttcatcctggccctgatggatgagatcaacaacaagattgaggaggagaagctggtgaaggccaacatcaccctgtgggaggccaacatgatcaaggcctacaatgccagcttcagcgagaacagcactggaccacccttctttgtgcacccagcagatgtgccccggggcccctgctgggagaccatggtgggccaggagtttgtgcggctgactgtgtctgatgtgctgaccacctacgtgaccatcctgattggagacttcctgcgggcctgctttgtgcgcttctgcaactactgctggtgctgggacctggagtatggctaccccagctacacagaatttgacatctctggaaatgtgctggccctgatcttcaaccagggcatgatctggatgggcagcttctttgcccccagcctgcccggcatcaacatcctgcggctgcacacctccatgtacttccagtgctgggccgtgatgtgctgcaatgtgcctgaggcccgggtcttcaaggccagccgcagcaacaacttctacctgggcatgctgctgctgatcctcttcctgagcaccatgcctgtgctgtacatgattgtgtccctgcccccatcctttgactgtggccccttcagcggcaagaacaggatgtttgaggtgattggagagaccctggagcatgacttccccagctggatggccaagatcctgcggcagctgagcaaccctggcctggtgattgctgtgatcctggtgatggtgctggccatctactacctgaatgccacagccaagggccagaaggccgccaacctggacctgaagaagaagatgaagatgcaggccctggagaacaagatgaggaacaagaagatggccgccgcccgggctgctgctgctgctggccggcagtag

SEQ ID NO: 173943 - DNA, 2283 bp, Artificial Sequence; identical to SEQ ID NO: 173942
  Description of Artificial Sequence: Synthetic coding sequence

SEQ ID NO: 173944 - DNA, 2223 bp, Artificial Sequence
  Description of Artificial Sequence: Synthetic coding sequence
gtggagtggagcggggagtgcctgcggagctgccggcgggaggtgcagatcaaggtggaggagaaggaggatgaaacagaggagagcagcagcgaggaggaggaggaggtggaggacaagctgccccggcgggagagcctgcggcccaagaggaagaggaccagagatgtgatcaatgaagatgatcctgagcctgagccagaagatgaggagaccaggaaggcccgggagaaggagaggagaagaaggctgaagagaggagctgaggccaagaagtttgtgtctgaaaatgaaggagccctgggcaagggcaagggcaagcgctggtttgccttcaagatgatgatggccaagaagtgggccaagttcctgcgggactttgagaacttcaaggccgcctgtgtgccctgggagaacaagatcaaggccatcgagagccagtttggcagctctgtggccagctacttcctgttcctgcgctggatgtatggagtgaacatggtgctcttcatcctgaccttcagcctcatcatgctgcctgagtacctgtggggcctgccctacggcagcctgcccaggaagacagtgcccagggctgaggaggccagcgctgccaactttggagtgctgtatgacttcaacggcctggcccagtacagcgtgctcttctacggctactatgacaacaagaggaccatcggctggatgaacttccggctgcccctgagctacttcctggtgggcatcatgtgcatcggctacagcttcctggtggtgctgaaggccatgaccaagaacattggagatgatggcggcggagatgacaacaccttcaacttctcctggaaggtgttcacctcctgggactacctgattggcaaccctgagacagctgacaacaagttcaacagcatcaccatgaacttcaaggaggccatcacagaggagaaggccgcccaggtggaggagaatgtgcacctgatccgcttcctgcgcttcctggccaacttctttgtgttcctgaccctgggcggcagcggctacctgatcttctgggccgtgaagaggagccaggagtttgcccagcaggaccctgacaccctgggctggtgggagaagaatgagatgaacatggtgatgagcctgctgggcatgttctgccccaccctgtttgacctgtttgctgagctggaggactaccaccccctcatcgccctgaagtggctgctgggccgcatctttgccctgctgctgggcaacctgtatgtgttcatcctggccctgatggatgagatcaacaacaagattgaggaggagaagctggtgaaggccaacatcaccctgtgggaggccaacatgatcaaggcctacaatgccagcttcagcgagaacagcacaggcccccccttctttgtgcacccagcagatgtgccccggggcccctgctgggagaccatggtgggccaggagtttgtgcggctgactgtgtctgatgtgctgaccacctacgtgaccatcctgattggagacttcctgcgggcctgctttgtgcgcttctgcaactactgctggtgctgggacctggagtatggctaccccagctacacagaatttgacatctctggaaatgtgctggccctgatcttcaaccagggcatgatctggatgggcagcttctttgcccccagcctgcccggcatcaacatcctgcggctgcacacctccatgtacttccagtgctgggccgtgatgtgctgcaatgtgcctgaggcccgggtcttcaaggccagccgcagcaacaacttctacctgggcatgctgctgctgatcctcttcctgagcaccatgcctgtgctgtacatgattgtgtccctgccccccagctttgactgtggccccttcagcggcaagaacaggatgtttgaagtcatcggggagaccctggagcatgacttccccagctggatggccaagatcctgcggcagctgagcaaccctggcctggtgattgctgtgatcctggtgatggtgctggccatctactacctgaatgccacagccaagggccagaaggccgccaacctggacctgaagaagaagatgaagatgctgcagctgctggtggccagcaacaagtacccagagagccctgagaaggtgcactttgccctgctcttcaagagcaatgccatctgtgagaggcctgagaacaagcactgctag

SEQ ID NO: 173945 - DNA, 2283 bp, Artificial Sequence; identical to SEQ ID NO: 173942
  Description of Artificial Sequence: Synthetic coding sequence

SEQ ID NO: 173946 - DNA, 2184 bp, Artificial Sequence
  Description of Artificial Sequence: Synthetic coding sequence
gtggagtggagcggggagtgcctgcggagctgccggcgggaggtgcagatcaaggtggaggagaaggaggatgaaacagaggagagcagcagcgaggaggaggaggaggtggaggacaagctgccccggcgggagagcctgcggcccaagaggaagaggaccagagatgtgatcaatgaagatgatcctgagcctgagccagaagatgaggagaccaggaaggcccgggagaaggagaggagaagaaggctgaagagaggagctgaggccaagaagtttgtgtctgaaaatgaaggagccctgggcaagggcaagggcaagcgctggtttgccttcaagatgatgatggccaagaagtgggccaagttcctgcgggactttgagaacttcaaggccgcctgtgtgccctgggagaacaagatcaaggccatcgagagccagtttggcagctctgtggccagctacttcctgttcctgcgctggatgtatggagtgaacatggtgctcttcatcctgaccttcagcctcatcatgctgcctgagtacctgtggggcctgccctacggcagcctgcccaggaagacagtgcccagggctgaggaggccagcgctgccaactttggagtgctgtatgacttcaacggcctggcccagtacagcgtgctcttctacggctactatgacaacaagaggaccatcggctggatgaacttccggctgcccctgagctacttcctggtgggcatcatgtgcatcggctacagcttcctggtggtgctgaaggccatgaccaagaacattggagatgatggcggcggagatgacaacaccttcaacttctcctggaaggtgttcacctcctgggactacctgattggcaaccctgagacagctgacaacaagttcaacagcatcaccatgaacttcaaggaggccatcacagaggagaaggccgcccaggtggaggagaatgtgcacctgatccgcttcctgcgcttcctggccaacttctttgtgttcctgaccctgggcggcagcggctacctgatcttctgggccgtgaagaggagccaggagtttgcccagcaggaccctgacaccctgggctggtgggagaagaatgagatgaacatggtgatgagcctgctgggcatgttctgccccaccctgtttgacctgtttgctgagctggaggactaccaccccctcatcgccctgaagtggctgctgggccgcatctttgccctgctgctgggcaacctgtatgtgttcatcctggccctgatggatgagatcaacaacaagattgaggaggagaagctggtgaaggccaacatcaccctgtgggaggccaacatgatcaaggcctacaatgccagcttcagcgagaacagcacaggcccccccttctttgtgcacccagcagatgtgccccggggcccctgctgggagaccatggtgggccaggagtttgtgcggctgactgtgtctgatgtgctgaccacctacgtgaccatcctgattggagacttcctgcgggcctgctttgtgcgcttctgcaactactgctggtgctgggacctggagtatggctaccccagctacacagaatttgacatctctggaaatgtgctggccctgatcttcaaccagggcatgatctggatgggcagcttctttgcccccagcctgcccggcatcaacatcctgcggctgcacacctccatgtacttccagtgctgggccgtgatgtgctgcaatgtgcctgaggcccgggtcttcaaggccagccgcagcaacaacttctacctgggcatgctgctgctgatcctcttcctgagcaccatgcctgtgctgtacatgattgtgtccctgccccccagctttgactgtggccccttcagcggcaagaacaggatgtttgaagtcatcggggagaccctggagcatgacttccccagctggatggccaagatcctgcggcagctgagcaaccctggcctggtgattgctgtgatcctggtgatggtgctggccatctactacctgaatgccacagccaagggccagaaggccgccaacctggacctgaagaagaagatgaagatgcaggccctggagaacaagatgaggaacaagaagatggctgctgcccgggctgctgctgctgctggccggcagtag

SEQ ID NO: 173947 - DNA, 1665 bp, Artificial Sequence
  Description of Artificial Sequence: Synthetic coding sequence
gtggagtggagcggggagtgcctgcggagctgccggcgggaggtgcagatcaaggtggaggagaaggaggatgaaacagaggagagcagcagcgaggaggaggaggaggtggaggacaagctgccccggcgggagagcctgcggcccaagaggaagaggaccagagatgtgatcaatgaagatgatcctgagcctgagccagaagatgaggagaccaggaaggcccgggagaaggagaggagaagaaggctgaagagaggagctgaggccaagaagtttgtgtctgaaaatgaaggagccctgggcaagggcaagggcaagcgctggtttgccttcaagatgatgatggccaagaagtgggccaagttcctgcgggactttgagaacttcaaggccgcctgtgtgccctgggagaacaagatcaaggccatcgagagccagtttggcagctctgtggccagctacttcctgttcctgcgctggatgtatggagtgaacatggtgctcttcatcctgaccttcagcctcatcatgctgcctgagtacctgtggggcctgccctacggcagcctgcccaggaagacagtgcccagggctgaggaggccagcgctgccaactttggagtgctgtatgacttcaacggcctggcccagtacagcgtgctcttctacggctactatgacaacaagaggaccatcggctggatgaacttccggctgcccctgagctacttcctggtgggcatcatgtgcatcggctacagcttcctggtggtgctgaaggccatgaccaagaacattggagatgatggcggcggagatgacaacaccttcaacttctcctggaaggtgttcacctcctgggactacctgattggcaaccctgagacagctgacaacaagttcaacagcatcaccatgaacttcaaggaggccatcacagaggagaaggccgcccaggtggaggagaatgtgcacctgatccgcttcctgcgcttcctggccaacttctttgtgttcctgaccctgggcggcagcggctacctgatcttctgggccgtgaagaggagccaggagtttgcccagcaggaccctgacaccctgggctggtgggagaagaatgagatgaacatggtgatgagcctgctgggcatgttctgccccaccctgtttgacctgtttgctgagctggaggactaccaccccctcatcgccctgaagtggctgctgggccgcatctttgccctgctgctgggcaacctgtatgtgttcatcctggccctgatggatgagatcaacaacaagattgaggaggagaagctggtgaaggccaacatcaccctgtgggaggccaacatgatcaaggcctacaatgccagcttcagcgagaacagcacaggcccccccttctttgtgcacccagcagatgtgccccggggcccctgctgggagaccatggtgggccaggagtttgtgcggctgactgtgtctgatgtgctgaccacctacgtgaccatcctgattggagacttcctgcgggcctgctttgtgcgcttctgcaactactgctggtgctgggacctggagtatggctaccccagctacacagaatttgacatctctggaaatgtgctggccctgatcttcaaccagggcatgatctag

SEQ ID NO: 173948 - DNA, 2265 bp, Artificial Sequence
  Description of Artificial Sequence: Synthetic coding sequence
cagatcaaggtggaggagaaggaggatgaaacagaggagagcagcagcgaggaggaggaggaggtggaggacaagctgccccggcgggagagcctgcggcccaagaggaagaggaccagagatgtgatcaatgaagatgatcctgagcctgagccagaagatgaggagaccaggaaggcccgggagaaggagaggagaagaaggctgaagagaggagctgaggaggaggagattgatgaggaggagctggagcggctgaaggccgagctggatgagaagaggcagatcatcgccaccgtgaagtgcaagccctggaagatggagaagaagattgaggtgctgaaggaggccaagaagtttgtgtctgaaaatgaaggagccctgggcaagggcaagggcaagcgctggtttgccttcaagatgatgatggccaagaagtgggccaagttcctgcgggactttgagaacttcaaggccgcctgtgtgccctgggagaacaagatcaaggccatcgagagccagtttggcagctctgtggccagctacttcctgttcctgcgctggatgtatggagtgaacatggtgctcttcatcctgaccttcagcctcatcatgctgcctgagtacctgtggggcctgccctacggcagcctgcccaggaagacagtgcccagggctgaggaggccagcgctgccaactttggagtgctgtatgacttcaacggcctggcccagtacagcgtgctcttctacggctactatgacaacaagaggaccatcggctggatgaacttccggctgcccctgagctacttcctggtgggcatcatgtgcatcggctacagcttcctggtggtgctgaaggccatgaccaagaacattggagatgatggcggcggagatgacaacaccttcaacttctcctggaaggtgttcacctcctgggactacctgattggcaaccctgagacagctgacaacaagttcaacagcatcaccatgaacttcaaggaggccatcacagaggagaaggccgcccaggtggaggagaatgtgcacctgatccgcttcctgcgcttcctggccaacttctttgtgttcctgaccctgggcggcagcggctacctgatcttctgggccgtgaagaggagccaggagtttgcccagcaggaccctgacaccctgggctggtgggagaagaatgagatgaacatggtgatgagcctgctgggcatgttctgccccaccctgtttgacctgtttgctgagctggaggactaccaccccctgattgccctgaagtggctgctgggccgcatctttgccctgctgctgggcaacctgtatgtgttcatcctggccctgatggatgagatcaacaacaagattgaggaggagaagctggtgaaggccaacatcaccctgtgggaggccaacatgatcaaggcctacaatgccagcttcagcgagaacagcactggaccacccttctttgtgcacccagcagatgtgccccggggcccctgctgggagaccatggtgggccaggagtttgtgcggctgactgtgtctgatgtgctgaccacctacgtgaccatcctgattggagacttcctgcgggcctgctttgtgcgcttctgcaactactgctggtgctgggacctggagtatggctaccccagctacacagaatttgacatctctggaaatgtgctggccctgatcttcaaccagggcatgatctggatgggcagcttctttgcccccagcctgcccggcatcaacatcctgcggctgcacacctccatgtacttccagtgctgggccgtgatgtgctgcaatgtgcctgaggcccgggtcttcaaggccagccgcagcaacaacttctacctgggcatgctgctgctgatcctcttcctgagcaccatgcctgtgctgtacatgattgtgtccctgcccccatcctttgactgtggccccttcagcggcaagaacaggatgtttgaggtgattggagagaccctggagcatgacttccccagctggatggccaagatcctgcggcagctgagcaaccctggcctggtgattgctgtgatcctggtgatggtgctggccatctactacctgaatgccacagccaagggccagaaggccgccaacctggacctgaagaagaagatgaagatgcaggccctggagaacaagatgaggaacaagaagatggccgccgcccgggcagatggagctgctggccgggcctag

SEQ ID NO: 173949 - DNA, 2721 bp, Artificial Sequence
  Description of Artificial Sequence: Synthetic coding sequence
atgagccaccaggtgaagggcctgaaggaggaggcccggggcggcgtgaagggccgggtgaagagcggcagcccccacactggagaccggctgggcagaagaagcagcagcaagagggccctgaaggccgagggcaccccaggaagaagaggagcccagaggagccagaaggagcgggccggcggcagccccagccctggcagccccaggaggaagcagacaggaagaagaagacaccgggaggagctgggggagcaggagcggggggaggccgagaggacctgtgagggccgcaggaagagagatgagcgggccagcttccaggagaggacagctgcccccaagcgggagaaggagatcccccggcgggaggagaagagcaagaggcagaagaagcccaggagcagcagcctggccagcagcgccagcggcggggagagcctgtctgaggaggagctggcccagatcctggagcaggtggaggagaagaagaagctgattgccaccatgaggagcaagccctggcccatggccaagaagctgacagagctgcgggaggcccaggagtttgtggagaagtatgagggcgccctgggcaagggcaagggcaagcagctgtatgcctacaagatgctgatggccaagaagtgggtgaagttcaagagggactttgacaacttcaagacccagtgcatcccctgggagatgaagatcaaggacatcgagagccacttcggcagctctgtggccagctacttcatcttcctgcgctggatgtatggagtgaacctggtgctgtttggcctcatcttcggcctggtgatcatccctgaggtgctgatgggcatgccctacggcagcatccccaggaagacagtgcccagggctgaggaggagaaggccatggacttctctgtgctgtgggactttgagggctacatcaagtacagcgccctcttctacggctactacaacaaccagaggaccatcggctggctgcgctaccgcctgcccatggcctacttcatggtgggcgtgtctgtgtttggctacagcctcatcatcgtcatccgctccatggccagcaacacccagggcagcactggagagggggagagtgacaacttcaccttctccttcaagatgttcacctcctgggactacctgattggcaacagcgagacagctgacaacaagtatgccagcatcaccaccagcttcaaggagagcatcgtggatgagcaggagagcaacaaggaggagaacatccacctgacccgcttcctgcgggtgctggccaacttcctgatcatctgctgcctgtgtggcagcggctacctgatctactttgtggtgaagaggagccagcagttcagcaagatgcagaatgtgtcctggtatgaaagaaatgaggtggagatcgtgatgagcctgctgggcatgttctgcccccccctgtttgagaccatcgccgccctggagaactaccaccccaggacaggcctgaagtggcagctgggccgcatctttgccctcttcctgggcaacctgtacaccttcctgctggccctgatggatgatgtgcacctgaagctggccaatgaggagaccatcaagaacatcacccactggaccctcttcaactactacaacagcagcggctggaatgaatctgtgccccggccccccctgcacccagcagatgtgccccggggcagctgctgggagacagctgtgggcatcgagttcatgaggctgactgtgtctgacatgctggtgacctacatcaccatcctgctgggggacttcctgcgggcctgctttgtgcgcttcatgaactactgctggtgctgggacctggaggccggcttccccagctatgcagagtttgacatctctggaaatgtgctgggcctcatcttcaaccagggcatgatctggatgggcagcttctacgcccctggcctggtgggcatcaacgtgctgcggctgctgacctccatgtacttccagtgctgggccgtgatgagcagcaatgtgccccatgagagggtcttcaaggccagccgcagcaacaacttctacatgggcctgctgctgctggtgctcttcctgagcctgctgcctgtggcctacaccatcatgagcctgccccccagctttgactgtggccccttcagcggcaagaacaggatgtatgatgtgctgcaggagaccattgaaaatgacttccccaccttcctgggcaagatctttgccttcctggccaaccctggcctcatcatcccagccatcctgctgatgttcctggccatctactacctgaacagcgtgtccaagagcctgagccgggccaatgcccagctgaggaagaagatccaggtgctgcgggaggtggagaagagccacaagtctgtgaagggcaaggccacagcccgggacagcgaggacacccccaagagcagcagcaagaatgccacccagctgcagctgaccaaggaggagaccaccccacccagcgccagccagagccaggccatggacaagaaggcccagggccctggcaccagcaacagcgccagcaggaccaccctgcctgccagcggccacctgcccatcagccggcccccaggcattggaccagattctggccacgcccccagccagacccacccctggaggtctgccagcggcaagagcgcccagaggcctccccactag

SEQ ID NO: 173950 - DNA, 1365 bp, Artificial Sequence
  Description of Artificial Sequence: Synthetic coding sequence
atggcccagcccctggccttcatcctggatgtgcctgagacccctggggaccagggccagggccccagcccctatgatgagagcgaggtgcatgacagcttccagcagctgatccaggagcagagccagtgcacagcccaggagggcctggagctgcagcagcgggagcgggaggtgacaggcagcagccagcagaccctgtggaggcctgagggcacccagagcacagccaccctgcgcatcctggcctccatgcccagcaggaccatcggccgcagcagaggagccatcatcagccagtactacaacagaacagtgcagctgcgctgccgcagcagccggcccctgctgggcaactttgtgcgcagcgcctggcccagcctgcggctgtatgacctggagctggaccccacagccctggaggaggaggagaagcagagcctgctggtgaaggagctgcagagcctggccgtggcccagagggaccacatgctgcggggcatgcccctgagcctggccgagaagaggagcctgcgggagaagagcaggaccccccggggcaagtggaggggccagcccggcagcggaggagtgtgcagctgctgcggccgcctgcgctatgcctgtgtgctggccctgcacagcctgggcctggccctgctgagcgccctgcaggccctgatgccctggaggtatgccctgaagagaattggaggccagtttggcagctctgtgctgagctacttcctgttcctgaagaccctgctggccttcaatgccctgctgctgctgctgctggtggccttcatcatgggcccccaggtggccttccccccagccctgcccggccctgcccctgtgtgcaccggcctggagctgctgactggagctggctgcttcacccacacagtgatgtactacggccactacagcaatgccaccctgaaccagccctgtggcagccccctggatggcagccagtgcaccccccgggtgggcggcctgccctacaacatgcccctggcctacctgagcacagtgggcgtgtccttcttcatcacctgcatcaccctggtgtacagcatggcccacagctttggagagagctacagagtgggcagcaccagcggcatccacgccatcaccgtcttctgctcctgggactacaaggtgacccagaagagggccagccggctgcagcaggacaacatccgcacccggctgaagggggaggacaagatcttcctgatcaacaagctgcacagcatctatgaaaggaaggagcgggaggagaggagccgggtgggcaccacagaggaggccgccgcccccccagccctgctgacagatgagcaggatgcctag

SEQ ID NO: 173951 - DNA, 2418 bp, Artificial Sequence
  Description of Artificial Sequence: Synthetic coding sequence
atggcccagcccctggccttcatcctggatgtgcctgagacccctggggaccagggccagggccccagcccctatgatgagagcgaggtgcatgacagcttccagcagctgatccaggagcagagccagtgcacagcccaggagggcctggagctgcagcagcgggagcgggaggtgacaggcagcagccagcagaccctgtggaggcctgagggcacccagagcacagccaccctgcgcatcctggcctccatgcccagcaggaccatcggccgcagcagaggagccatcatcagccagtactacaacagaacagtgcagctgcgctgccgcagcagccggcccctgctgggcaactttgtgcgcagcgcctggcccagcctgcggctgtatgacctggagctggaccccacagccctggaggaggaggagaagcagagcctgctggtgaaggagctgcagagcctggccgtggcccagagggaccacatgctgcggggcatgcccctgagcctggccgagaagaggagcctgcgggagaagagcaggaccccccggggcaagtggaggggccagcccggcagcggaggagtgtgcagctgctgcggccgcctgcgctatgcctgtgtgctggccctgcacagcctgggcctggccctgctgagcgccctgcaggccctgatgccctggaggtatgccctgaagagaattggaggccagtttggcagctctgtgctgagctacttcctgttcctgaagaccctgctggccttcaatgccctgctgctgctgctgctggtggccttcatcatgggcccccaggtggccttccccccagccctgcccggccctgcccctgtgtgcaccggcctggagctgctgactggagctggctgcttcacccacacagtgatgtactacggccactacagcaatgccaccctgaaccagccctgtggcagccccctggatggcagccagtgcaccccccgggtgggcggcctgccctacaacatgcccctggcctacctgagcacagtgggcgtgtccttcttcatcacctgcatcaccctggtgtacagcatggcccacagctttggagagagctacagagtgggcagcaccagcggcatccacgccatcaccgtcttctgctcctgggactacaaggtgacccagaagagggccagccggctgcagcaggacaacatccgcacccggctgaaggagctgctggccgagtggcagctgcggcacagccccaggtctgtgtgtggccgcctgcggcaggccgctgtgctgggcctggtgtggctgctgtgcctgggcacagccctgggctgtgctgtggccgtgcacgtgttcagcgagttcatgatccagagccctgaggccgccggccaggaggccgtgctgctggtgctgcccctggtggtgggcctgctgaacctgggcgccccctacctgtgccgggtgctggccgccctggagccccatgacagccctgtgctggaggtgtatgtggccatctgcaggaacctgatcctgaagctggccatcctgggcaccctgtgctaccactggctgggcagaagagtgggcgtgctgcagggccagtgctgggaggactttgtgggccaggagctgtaccgcttcctggtgatggactttgtgctgatgctgctggacaccctgtttggagagctggtgtggaggatcatcagcgagaagaagctgaagagaagaaggaagccagagtttgatattgccagaaatgtgctggagctgatctacggccagaccctgacctggctgggcgtgctcttcagccccctgctgcctgctgtgcagatcatcaagctgctgctggtgttctacgtgaagaagaccagcctgctggccaactgccaggccccccggcggccctggctggccagccacatgagcaccgtcttcctgaccctgctgtgcttccctgccttcctgggcgctgctgtgttcctgtgctatgctgtgtggcaggtgaagcccagcagcacctgtggccccttccgcaccctggacaccatgtatgaagctggccgggtgtgggtgcgccacctggaggccgccggcccccgggtgtcctggctgccctgggtgcaccgctacctgatggagaacaccttctttgtgttcctggtgtctgccctgctgctggccgtcatctacctgaacatccaggtggtgcggggccagaggaaggtgatctgcctgctgaaggagcagatcagcaatgaaggagaggacaagatcttcctgatcaacaagctgcacagcatctatgaaaggaaggagcgggaggagaggagccgggtgggcaccacagaggaggccgccgcccccccagccctgctgacagatgagcaggatgcctag

SEQ ID NO: 173952 - DNA, 1155 bp, Artificial Sequence
  Description of Artificial Sequence: Synthetic coding sequence
atggcccacagctttggagagagctacagagtgggcagcaccagcggcatccacgccatcaccgtcttctgctcctgggactacaaggtgacccagaagagggccagccggctgcagcaggacaacatccgcacccggctgaaggagctgctggccgagtggcagctgcggcacagccccaggtctgtgtgtggccgcctgcggcaggccgctgtgctgggcctggtgtggctgctgtgcctgggcacagccctgggctgtgctgtggccgtgcacgtgttttctgagttcatgatccagagccctgaggccgccggccaggaggccgtgctgctggtgctgcccctggtggtgggcctgctgaacctgggcgccccctacctgtgccgggtgctggccgccctggagccccatgacagccctgtgctggaggtgtatgtggccatctgccgcatcatcagcgagaagaagctgaagagaagaaggaagccagagtttgacatcgccagaaatgtgctggagctgatctacggccagaccctgacctggctgggcgtgctcttcagccccctgctgcctgctgtgcagatcatcaagctgctgctggtgttctacgtgaagaagaccagcctgctggccaactgccaggccccccggcggccctggctggccagccacatgagcacagtgttcctgaccctgctgtgcttccctgccttcctgggcgctgctgtgttcctgtgctatgctgtgtggcaggtgaagcccagcagcacctgtggccccttccgcaccctggacaccatgtatgaggccggccgggtgtgggtgcgccacctggaggccgccggcccccgggtgtcctggctgccctgggtgcaccgctacctgatggagaacaccttctttgtgttcctggtgtctgccctgctgctggccgtcatctacctgaacatccaggtggtgcggggccagaggaaggtgatctgcctgctgaaggagcagatcagcaatgaaggagaggacaagatcttcctgatcaacaagctgcacagcatctatgaaaggaaggagcgggaggagaggagccgggtgggcaccacagaggaggccgccgcccccccagccctgctgacagatgagcaggatgcctag

SEQ ID NO: 173953 - DNA, 417 bp, Artificial Sequence
  Description of Artificial Sequence: Synthetic coding sequence
cagtgctgggaggactttgtgggccaggagctgtaccgcttcctggtgatggactttgtgctgatgctgctggacaccctgtttggagagctggagaaccgcttccagagtgatgtgttcagcagccgcatctgggcctggtggaggaagccagagtttgatattgccagaaatgtgctggagctgatctacggccagaccctgacctggctgggcgtgctcttcagccccctgctgcctgctgtgcagatcatcaagctgctgctggtgttctacgtgaagaagaccagcctgctggccaactgccaggccccccggcggccctggctggccagccacatgagcaccgtcttcctgaccctgctgtgcttccctgccttcctgggcgctgctgtgttcctgtgctatgctgtgtag

SEQ ID NO: 173954 - DNA, 2418 bp, Artificial Sequence; identical to SEQ ID NO: 173951
  Description of Artificial Sequence: Synthetic coding sequence

SEQ ID NO: 173955 - DNA, 1098 bp, Artificial Sequence
  Description of Artificial Sequence: Synthetic coding sequence
atgaacatcatggacttcaacgtgaagaagctggccgcagatgctggcaccttcctgagcagagctgtgcagttcacagaggagaagctgggccaggccgagaagacagagctggatgcccacctggagaacctgctgagcaaggccgagtgcaccaagatctggacagagaagatcatgaagcagacagaggtgctgctgcagcccaaccccaatgccagaattgaggagtttgtgtatgagaagctggacaggaaggcccccagccgcatcaacaaccctgagctgctgggccagtacatgattgatgctggaacagaatttggacctggaacagcctatggaaatgccctgatcaagtgtggggagacccagaagagaattggaacagctgaccgggagctgatccagaccagcgccctgaacttcctgacccccctgaggaacttcattgaaggagactacaagaccatcgccaaggagaggaagctgctgcagaacaagaggctggacctggatgctgccaagacccggctgaagaaggccaaggctgctgagaccaggaacagcagcgagcaggagctgcgcatcacccagagcgagtttgaccggcaggccgagatcacccggctgctgctggagggcatcagcagcacccacgcccaccacctgcgctgcctgaatgactttgtggaggcccagatgacctactatgcccagtgctaccagtacatgctggacctgcagaagcagctgggcagcttccccagcaactacctgagcaacaacaaccagacctctgtgacccctgtgcccagcgtgctgcccaatgccatcggcagcagcgccatggccagcaccagcggcctggtgatcaccagccccagcaacctgagtgacctgaaggaatgttctggcagcaggaaggcccgggtgctgtatgactatgatgctgccaacagcacagagctgagcctgctggctgatgaagtcatcaccgtcttctctgtggtgggcatggacagcgactggctgatgggagagcggggcaaccagaagggcaaggtgcccatcacctacctggagctgctgaactag

SEQ ID NO: 173956 - DNA, 636 bp, Artificial Sequence
  Description of Artificial Sequence: Synthetic coding sequence
atggccggcgtgggcgccggccccctgcgggccatgggccggcaggccctgctgctgctggccctgtgtgccactggagcccagggcctgtacttccacatcggggagacagagaagcgctgcttcatcgaggagatcccagatgagaccatggtgattggcaactaccgcacccagggcatgcacgtggaggtgaaggaccctgatggcaaggtggtgctgagccggcagtatggcagcgagggccgcttcaccttcaccagccacacccctggggaccaccagatctgcctgcacagcaacagcaccaggatggccctgtttgctgggggcaagctgcgggtgcacctggacatccaggtgggggagcacgccaacaactacccagaaattgctgccaaggacaagctgacagagctgcagctgcgggcccggcagctgctggaccaggtggagcagatccagaaggagcaggactaccagcgctaccgggaggagcgcttccggctgaccagcgagagcaccaaccagagggtgctgtggtggagcatcgcccagaccgtcatcctgatcctgaccggcatctggcagatgaggcacctgaagagcttctttgaggccaagaagctggtgtag

SEQ ID NO: 173957 - DNA, 684 bp, Artificial Sequence
  Description of Artificial Sequence: Synthetic coding sequence
atggccggcgtgggcgccggccccctgcgggccatgggccggcaggccctgctgctgctggccctgtgtgccactggagcccagggcctgtacttccacatcggggagacagagaagcgctgcttcatcgaggagatcccagatgagaccatggtgattggcaactaccgcacccagatgtgggacaagcagaaggaggtgttcctgcccagcaccccaggcctgggcatgcacgtggaggtgaaggaccctgatggcaaggtggtgctgagccggcagtatggcagcgagggccgcttcaccttcaccagccacacccctggggaccaccagatctgcctgcacagcaacagcaccaggatggccctgtttgctgggggcaagctgcgggtgcacctggacatccaggtgggggagcacgccaacaactacccagaaattgctgccaaggacaagctgacagagctgcagctgcgggcccggcagctgctggaccaggtggagcagatccagaaggagcaggactaccagcgctaccgggaggagcgcttccggctgaccagcgagagcaccaaccagagggtgctgtggtggagcatcgcccagaccgtcatcctgatcctgaccggcatctggcagatgaggcacctgaagagcttctttgaggccaagaagctggtgtag

SEQ ID NO: 173958 - DNA, 660 bp, Artificial Sequence
  Description of Artificial Sequence: Synthetic coding sequence
atgagcggcctgagcggccccccagcccggcggggccccttccccctggccctgctgctgctcttcctgctgggcccccggctggtgctggccatctccttccacctgcccatcaacagcaggaagtgcctgcgggaggagatccacaaggacctgctggtgactggagcctatgagatcagtgaccagagcggcggggccggcggcctgcggagccacctgaagatcacagattctgctggccacatcctgtacagcaaggaggatgccaccaagggcaagtttgccttcaccacagaggactatgacatgtttgaggtgtgctttgagagcaagggcaccggccgcatcccagaccagctggtgatcctggacatgaagcacggcgtggaggccaagaactatgaggagatcgccaaggtggagaagctgaagcccctggaggtggagctgcggcggctggaggacctgtctgagagcatcgtgaatgactttgcctacatgaagaagcgggaggaggagatgagggacaccaatgaaagcaccaacaccagggtgctgtacttcagcatcttctccatgttctgcctgattggcctggccacctggcaggtgttctacctgcggcgcttcttcaaggccaagaagctgattgaatag

SEQ ID NO: 173959 - DNA, 471 bp, Artificial Sequence
  Description of Artificial Sequence: Synthetic coding sequence
atggccggctggccaggagctggccccctgtgtgtgctgggcggggccgccctgggcgtgtgcctggccggcgtggccggccagctggtggagcccagcacagccccacccaagcccaagcccccacccctgaccaaggagaccgtggtgttctgggacatgaggctgtggcacgtggtgggcatcttcagcctgtttgtgctgagcatcatcatcaccctgtgctgcgtgttcaactgccgggtgcccaggaccaggaaggagattgaggcccgctacctgcagaggaaggccgccaagatgtacacagacaagctggagaccgtgccccccctgaatgagctgacagaggtgcctggagaggacaagaagaagaagaagaagaagaagaaggacagcgtggacacagtggccatcaaggtggaggaggatgagaagaatgaggccaagaagaagaagggggagaagtag

SEQ ID NO: 173960 - DNA, 1602 bp, Artificial Sequence
  Description of Artificial Sequence: Synthetic coding sequence
atgaatgaatctccagaccccacagacctggccggggtcatcatcgagctgggccccaatgacagcccccagaccagcgagttcaagggggccacagaggaggccccagccaaggagagcgtgctggcccggctgagcaagtttgaggtggaggatgctgaaaatgtggccagctatgacagcaagatcaagaagatcgtgcacagcatcgtgtcctcctttgccttcggcctgtttggagtcttcctggtgctgctggatgtgaccctcatcctggccgacctgatcttcacagacagcaagctgtacatccccctggagtaccgcagcatcagcctggccatcgccctcttcttcctgatggatgtgctgctgcgggtgtttgtggagcggcggcagcagtacttcagtgacctcttcaacatcctggacacagccatcatcgtcatcctgctgctggtggatgtggtgtacatcttctttgacatcaagctgctgaggaacatcccccgctggacccacctgctgcggctgctgcggctcatcatcctgctgcgcatcttccacctgttccaccagaagaggcagctggagaagctgatcagaagaagagtgtctgagaacaagaggcgctacaccagagatggctttgacctggacctgacctacgtgacagagcgcatcatcgccatgtccttccccagcagcggccggcagagcttctacagaaaccccatcaaggaggtggtgcgcttcctggacaagaagcacaggaaccactacagagtgtacaacctgtgcagcgagcgggcctatgaccccaagcacttccacaacagagtggtgcgcatcatgattgatgaccacaacgtgcccaccctgcaccagatggtggtgttcaccaaggaggtgaatgagtggatggcccaggacctggagaacatcgtggccatccactgcaagggcggcacagacagaacaggcaccatggtgtgtgccttcctgattgccagcgagatctgcagcacagccaaggagagcctgtactactttggagagaggagaacagacaagacccacagcgagaagttccagggcgtgaagacccccagccagaagagatatgtggcctactttgcccaggtgaagcacctgtacaactggaacctgcccccccggcgcatcctcttcatcaagcacttcatcatctacagcatccccaggtatgtgcgggacctgaagatccagatcgagatggagaagaaggtggtgttcagcaccatcagcctgggcaagtgcagcgtgctggacaacatcaccacagacaagatcctgattgatgtgtttgatggcctgcccctgtatgatgatgtgaaggtgcagttcttctacagcaacctgcccacctactatgacaactgcagcttctacttctggctgcacaccagcttcatcgagaacaaccggctgtacctgcccaagaatgagctggacaacctgcacaagcagaaggcccggcgcatctaccccagcgactttgctgtggagatcctgtttggagagaagatgaccagcagtgatgtggtggccggcagtgactag

SEQ ID NO: 173961 - DNA, 1542 bp, Artificial Sequence
  Description of Artificial Sequence: Synthetic coding sequence
atgaatgaatctccagaccccacagacctggccggggtcatcatcgagctgggccccaatgacagcccccagaccagcgagttcaagggggccacagaggaggccccagccaaggagagcagcaagatcaagaagatcgtgcacagcatcgtgtcctcctttgccttcggcctgtttggagtcttcctggtgctgctggatgtgaccctcatcctggccgacctgatcttcacagacagcaagctgtacatccccctggagtaccgcagcatcagcctggccatcgccctcttcttcctgatggatgtgctgctgcgggtgtttgtggagcggcggcagcagtacttcagtgacctcttcaacatcctggacacagccatcatcgtcatcctgctgctggtggatgtggtgtacatcttctttgacatcaagctgctgaggaacatcccccgctggacccacctgctgcggctgctgcggctcatcatcctgctgcgcatcttccacctgttccaccagaagaggcagctggagaagctgatcagaagaagagtgtctgagaacaagaggcgctacaccagagatggctttgacctggacctgacctacgtgacagagcgcatcatcgccatgtccttccccagcagcggccggcagagcttctacagaaaccccatcaaggaggtggtgcgcttcctggacaagaagcacaggaaccactacagagtgtacaacctgtgcagcgagcgggcctatgaccccaagcacttccacaacagagtggtgcgcatcatgattgatgaccacaacgtgcccaccctgcaccagatggtggtgttcaccaaggaggtgaatgagtggatggcccaggacctggagaacatcgtggccatccactgcaagggcggcacagacagaacaggcaccatggtgtgtgccttcctgattgccagcgagatctgcagcacagccaaggagagcctgtactactttggagagaggagaacagacaagacccacagcgagaagttccagggcgtgaagacccccagccagaagagatatgtggcctactttgcccaggtgaagcacctgtacaactggaacctgcccccccggcgcatcctcttcatcaagcacttcatcatctacagcatccccaggtatgtgcgggacctgaagatccagatcgagatggagaagaaggtggtgttcagcaccatcagcctgggcaagtgcagcgtgctggacaacatcaccacagacaagatcctgattgatgtgtttgatggcctgcccctgtatgatgatgtgaaggtgcagttcttctacagcaacctgcccacctactatgacaactgcagcttctacttctggctgcacaccagcttcatcgagaacaaccggctgtacctgcccaagaatgagctggacaacctgcacaagcagaaggcccggcgcatctaccccagcgactttgctgtggagatcctgtttggagagaagatgaccagcagtgatgtggtggccggcagtgactag

SEQ ID NO: 173962 - DNA, 1656 bp, Artificial Sequence
  Description of Artificial Sequence: Synthetic coding sequence
atgaatgaatctccagaccccacagacctggccggggtcatcatcgagctgggccccaatgacagcccccagaccagcgagttcaagggggccacagaggaggccccagccaaggagagcccccacaccagcgagttcaagggagctgcccgggtgagccccatcagcgagagcgtgctggcccggctgagcaagtttgaggtggaggatgctgaaaatgtggccagctatgacagcaagatcaagaagatcgtgcacagcatcgtgtcctcctttgccttcggcctgtttggagtcttcctggtgctgctggatgtgaccctcatcctggccgacctgatcttcacagacagcaagctgtacatccccctggagtaccgcagcatcagcctggccatcgccctcttcttcctgatggatgtgctgctgcgggtgtttgtggagcggcggcagcagtacttcagtgacctcttcaacatcctggacacagccatcatcgtcatcctgctgctggtggatgtggtgtacatcttctttgacatcaagctgctgaggaacatcccccgctggacccacctgctgcggctgctgcggctcatcatcctgctgcgcatcttccacctgttccaccagaagaggcagctggagaagctgatcagaagaagagtgtctgagaacaagaggcgctacaccagagatggctttgacctggacctgacctacgtgacagagcgcatcatcgccatgtccttccccagcagcggccggcagagcttctacagaaaccccatcaaggaggtggtgcgcttcctggacaagaagcacaggaaccactacagagtgtacaacctgtgcagcgagcgggcctatgaccccaagcacttccacaacagagtggtgcgcatcatgattgatgaccacaacgtgcccaccctgcaccagatggtggtgttcaccaaggaggtgaatgagtggatggcccaggacctggagaacatcgtggccatccactgcaagggcggcacagacagaacaggcaccatggtgtgtgccttcctgattgccagcgagatctgcagcacagccaaggagagcctgtactactttggagagaggagaacagacaagacccacagcgagaagttccagggcgtgaagacccccagccagaagagatatgtggcctactttgcccaggtgaagcacctgtacaactggaacctgcccccccggcgcatcctcttcatcaagcacttcatcatctacagcatccccaggtatgtgcgggacctgaagatccagatcgagatggagaagaaggtggtgttcagcaccatcagcctgggcaagtgcagcgtgctggacaacatcaccacagacaagatcctgattgatgtgtttgatggcctgcccctgtatgatgatgtgaaggtgcagttcttctacagcaacctgcccacctactatgacaactgcagcttctacttctggctgcacaccagcttcatcgagaacaaccggctgtacctgcccaagaatgagctggacaacctgcacaagcagaaggcccggcgcatctaccccagcgactttgctgtggagatcctgtttggagagaagatgaccagcagtgatgtggtggccggcagtgactag

SEQ ID NO: 173963 - DNA, 1692 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccctgcccaggccagccctgcccaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctggcaccagcctgcccaagttcacctggagggagggccagaagcagctgcccctgattggctgtgtgctgctgctgattgccctggtggtgtccctcatcatcctcttccagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgagagcgcccacaggaccacagaggtggcccaccgggactttgccaacagcttcagcatcctgcgctacaacagcaccatccaggagagcctgcacagaagtgaatgtcccagccagcgctacatcagcctgcagtgcagccactgcggcctgcgggccatgacaggccgcatcgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaggaggatgattatgacatcgccctgatgaggctgagcaagcccctgaccctgagcgcccacatccacccagcctgcctgcccatgcacggccagaccttcagcctgaatgagacctgctggatcactggatttgggaagacccgggagacagatgacaagaccagccccttcctgcgggaggtgcaggtgaacctgattgacttcaagaagtgcaatgactacctggtgtatgacagctacctgacccccaggatgatgtgtgccggggacctgcggggcggccgggacagctgccagggcgacagcggcggccccctggtgtgtgagcagaacaaccgctggtacctggccggcgtgacctcctggggcaccggctgcggccagaggaacaagccaggagtgtacaccaaggtgacagaggtgctgccctggatctacagcaagatggagagcagcgctggatag

SEQ ID NO: 173964 - DNA, 1194 bp, Artificial Sequence
  Description of Artificial Sequence: Synthetic coding sequence
atggaccctgacagcgaccagcccctgaacagcctggtgaaggtgatcctggacaagtactacttcctgtgtggccagcccctgcacttcatccccaggaagcagctgtgtgatggagagctggactgccccctgggagaagatgaggagcactgtgtgaagagcttccctgagggccctgctgtggccgtgcggctgagcaaggacaggagcaccctgcaggtgctggacagcgccaccggcaactggttcagcgcctgctttgacaacttcacagaggccctggccgagacagcctgccggcagatgggctacagcagcaagcccaccttccgggctgtggagatcggccctgaccaggacctggatgtggtggagatcacagagaacagccaggagctgaggatgaggaacagcagcggcccctgcctgagcggcagcctggtgtccctgcactgcctggcctgtgggaagagcctgaagaccccccgggtggtgggcgtggaggaggcctctgtggacagctggccctggcaggtgtccatccagtatgacaagcagcacgtgtgtggcggcagcatcctggacccccactgggtgctgacagctgcccactgcttcaggaagcacacagatgtgttcaactggaaggtgcgggccggcagtgacaagctgggcagcttccccagcctggccgtggccaagatcatcatcatcgagttcaaccccatgtaccccaaggacaatgacatcgccctgatgaagctgcagttccccctgaccttctctggaacagtgcggcccatctgcctgcccttctttgatgaggagctgaccccagccacccccctgtggatcatcggctggggcttcaccaagcagaatggaggcaagatgtctgacatcctgctgcaggcctctgtgcaggtgattgacagcacccgctgcaatgctgatgatgcctaccagggcgaggtgacagagaagatgatgtgtgccggcatccctgagggcggcgtggacacctgccagggcgacagcggcggccccctgatgtaccagagcgaccagtggcacgtggtgggcatcgtgtcctggggctacggctgcggcggccccagcaccccaggagtgtacaccaaggtgtctgcctacctgaactggatctacaacgtgtggaaggccgagctgtag

SEQ ID NO: 173965 - DNA, 1266 bp, Artificial Sequence
  Description of Artificial Sequence: Synthetic coding sequence
atgatgtacagaacagtgggcttcggcaccaggagcaggaacctgaagccctggatgattgctgtgctgattgtgctgagcctgactgtggtggccgtgaccatcggcctgctggtgcacttcctggtgtttgaccagaagaaggagtactaccacggcagcttcaagatcctggacccccagatcaacaacaactttggccagagcaacacctaccagctgaaggacctgcgggagaccacagagaacctggtgtcccaggtggatgagatcttcattgattctgcctggaagaagaactacatcaagaaccaggtggtgcggctgaccccagaagaagatggagtgaaggtggatgtgatcatggtgttccagttccccagcacagagcagagagctgtgcgggagaagaagatccagagcatcctgaaccagaagatccggaacctgcgggccctgcccatcaatgccagctctgtgcaggtgaatgccatgagcagcagcactggagagctgactgtgcaggccagctgtgggaagagggtggtgcccctgaatgtgaaccgcatcgccagcggcgtgattgcccccaaggccgcctggccctggcaggccagcctgcagtatgacaacatccaccagtgtggggccaccctcatcagcaacacctggctggtgacagctgcccactgcttccagaagtacaagaacccccaccagtggacagtgtcctttggcaccaagatcaacccccccctgatgaagagaaatgtgcggcgcttcatcatccacgagaagtacagatctgctgcccgggagtatgacattgctgtggtgcaggtgagcagccgggtgaccttcagtgatgacatccggcagatctgcctgcctgaggccagcgccagcttccagcccaacctgactgtgcacatcaccggctttggagccctgtactatggaggagagagccagaatgacctgcgggaggcccgggtgaagatcatcagtgatgatgtgtgcaagcagccccaggtgtatggaaatgacatcaagccaggcatgttctgtgccggctacatggagggcatctatgatgcctgccgcggggacagcggcggccccctggtgacccgggacctgaaggacacctggtacctgattggaattgtgtcctggggagacaactgtggccagaaggacaagccaggagtgtacacccaggtgacctactacagaaactggatcgccagcaagacaggcatctag

SEQ ID NO: 173966 - DNA, 1257 bp, Artificial Sequence
  Description of Artificial Sequence: Synthetic coding sequence
atgatgtacagaacagtgggcttcggcaccaggagcaggaacctgaagccctggatgattgctgtgctgattgtgctgagcctgactgtggtggccgtgaccatcggcctgctggtgcacttcctggtgtttgaccagaagaaggagtactaccacggcagcttcaagatcctggacccccagatcaacaacaactttggccagagcaacacctaccagctgaaggacctgcgggagaccacagagaacctggtggatgagatcttcatcgacagcgcctggaagaagaactacatcaagaaccaggtggtgcggctgaccccagaggaggatggagtgaaggtggatgtgatcatggtgttccagttccccagcacagagcagagagctgtgcgggagaagaagatccagagcatcctgaaccagaagatccggaacctgcgggccctgcccatcaatgccagctctgtgcaggtgaatgccatgagcagcagcactggagagctgactgtgcaggccagctgtgggaagagggtggtgcccctgaatgtgaacagaattgccagcggggtcatcgcccccaaggccgcctggccctggcaggccagcctgcagtatgacaacatccaccagtgtggggccaccctcatcagcaacacctggctggtgacagctgcccactgcttccagaagtacaagaacccccaccagtggacagtgtcctttggcaccaagatcaacccccccctgatgaagagaaatgtgcggcgcttcatcatccacgagaagtacagatctgctgcccgggagtatgacattgctgtggtgcaggtgagcagccgggtgaccttcagtgatgacatccggcagatctgcctgcctgaggccagcgccagcttccagcccaacctgactgtgcacatcactggatttggagccctgtactacggcggggagagccagaatgacctgcgggaggcccgggtgaagatcatcagtgatgatgtgtgcaagcagccccaggtgtatggaaatgacatcaagccaggcatgttctgtgccggctacatggagggcatctatgatgcctgccgcggggacagcggcggccccctggtgacccgggacctgaaggacacctggtacctgattggcatcgtgtcctggggagacaactgtggccagaaggacaagccaggagtgtacacccaggtgacctactacagaaactggatcgccagcaagacaggcatctag

SEQ ID NO: 173967 - DNA, 1254 bp, Artificial Sequence
  Description of Artificial Sequence: Synthetic coding sequence
atgtacagaacagtgggcttcggcaccaggagcaggaacctgaagccctggatgattgctgtgctgattgtgctgagcctgactgtggtggccgtgaccatcggcctgctggtgcacttcctggtgtttgaccagaagaaggagtactaccacggcagcttcaagatcctggacccccagatcaacaacaactttggccagagcaacacctaccagctgaaggacctgcgggagaccacagagaacctggtggatgagatcttcattgattctgcctggaagaagaactacatcaagaaccaggtggtgcggctgaccccagaagaagatggagtgaaggtggatgtgatcatggtgttccagttccccagcacagagcagagagctgtgcgggagaagaagatccagagcatcctgaaccagaagatccggaacctgcgggccctgcccatcaatgccagctctgtgcaggtgaatgccatgagcagcagcactggagagctgactgtgcaggccagctgtgggaagagggtggtgcccctgaatgtgaaccgcatcgccagcggcgtgattgcccccaaggccgcctggccctggcaggccagcctgcagtatgacaacatccaccagtgtggggccaccctcatcagcaacacctggctggtgacagctgcccactgcttccagaagtacaagaacccccaccagtggacagtgtcctttggcaccaagatcaacccccccctgatgaagagaaatgtgcggcgcttcatcatccacgagaagtacagatctgctgcccgggagtatgacattgctgtggtgcaggtgagcagccgggtgaccttcagtgatgacatccggcagatctgcctgcctgaggccagcgccagcttccagcccaacctgactgtgcacatcaccggctttggagccctgtactatggaggagagagccagaatgacctgcgggaggcccgggtgaagatcatcagtgatgatgtgtgcaagcagccccaggtgtatggaaatgacatcaagccaggcatgttctgtgccggctacatggagggcatctatgatgcctgccgcggggacagcggcggccccctggtgacccgggacctgaaggacacctggtacctgattggaattgtgtcctggggagacaactgtggccagaaggacaagccaggagtgtacacccaggtgacctactacagaaactggatcgccagcaagacaggcatctag

SEQ ID NO: 173968 - DNA, 1689 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccccctgcaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctggcaccagcctgcccaagttcacctggagggagggccagaagcagctgcccctcatcggctgtgtgctgctgctgattgccctggtggtgtccctcatcatcctcttccagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgaaagtgcccacaggaccacagaggtggcccaccgggactttgccaacagcttcagcatcctgcgctacaacagcaccatccaggagagcctgcacaggtctgagtgccccagccagcgctacatcagcctgcagtgcagccactgcggcctgcgggccatgactggaagaattgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaagaagatgattatgacatcgccctgatgaggctgagcaagcccctgaccctgagcgcccacatccacccagcctgcctgcccatgcacggccagaccttcagcctgaatgagacctgctggatcaccggctttgggaagacccgggagacagatgacaagaccagccccttcctgcgggaggtgcaggtgaacctgattgacttcaagaagtgcaatgactacctggtgtatgacagctacctgacccccaggatgatgtgtgccggggacctgcggggcggccgggacagctgccagggcgacagcggcggccccctggtgtgtgagcagaacaaccgctggtacctggccggcgtgacctcctggggcaccggctgcggccagaggaacaagccaggagtgtacaccaaggtgacagaggtgctgccctggatctacagcaagatggagagcgaggtgcgcttcaggaagagctag

SEQ ID NO: 173969 - DNA, 1761 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccctgcccaggccagccctgcccaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctggcaccagcctgcccaagttcacctggagggagggccagaagcagctgcccctgattggctgtgtgctgctgctgattgccctggtggtgtccctcatcatcctcttccagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgagagcgcccacaggaccacagaggtggcccaccgggactttgccaacagcttcagcatcctgcgctacaacagcaccatccaggagagcctgcacagaagtgaatgtcccagccagcgctacatcagcctgcagtgcagccactgcggcctgcgggccatgacaggccgcatcgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaggaggatgattatgacatcgccctgatgaggctgagcaagcccctgaccctgagcgcccacatccacccagcctgcctgcccatgcacggccagaccttcagcctgaatgagacctgctggatcactggatttgggaagacccgggagacagatgacaagaccagccccttcctgcgggaggtgcaggtgaacctgattgacttcaagaagtgcaatgactacctggtgtatgacagctacctgacccccaggatgatgtgtgccggggacctgcggggcggccgggacagctgccagggcgacagcggcggccccctggtgtgtgagcagaacaaccgctggtacctggccggcgtgacctcctggggcaccggctgcggccagaggaacaagccaggagtgtacaccaaggtgacagaggtgctgccctggatctacagcaagatggaggtgcgcagcctgcagcaggacacagcccccagccggctgggcaccagcagcggcggggaccccggcggggccccccggctgtag

SEQ ID NO: 173970 - DNA, 1704 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccctgcccaggccagccctgcccaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctggcaccagcctgcccaagttcacctggagggagggccagaagcagctgcccctgattggctgtgtgctgctgctgattgccctggtggtgtccctcatcatcctcttccagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgagagcgcccacaggaccacagaggtggcccaccgggactttgccaacagcttcagcatcctgcgctacaacagcaccatccaggagagcctgcacagaagtgaatgtcccagccagcgctacatcagcctgcagtgcagccactgcggcctgcgggccatgacaggccgcatcgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaggaggatgattatgacatcgccctgatgaggctgagcaagcccctgaccctgagcgcccacatccacccagcctgcctgcccatgcacggccagaccttcagcctgaatgagacctgctggatcactggatttgggaagacccgggagacagatgacaagaccagccccttcctgcgggaggtgcaggtgaacctgattgacttcaagaagtgcaatgactacctggtgtatgacagctacctgacccccaggatgatgtgtgccggggacctgcggggcggccgggacagctgccagggcgacagcggcggccccctggtgtgtgagcagaacaaccgctggtacctggccggcgtgacctcctggggcaccggctgcggccagaggaacaagccaggagtgtacaccaaggtgacagaggtgctgccctggatctacagcaagatggagagcgaggtgcgcttcaggaagagctag

SEQ ID NO: 173971 - DNA, 1476 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccctgcccaggccagccctgcccaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctggcaccagcctgcccaagttcacctggagggagggccagaagcagctgcccctgattggctgtgtgctgctgctgattgccctggtggtgtccctcatcatcctcttccagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgagagcgcccacaggaccacagaggtggcccaccgggactttgccaacagcttcagcatcctgcgctacaacagcaccatccaggagagcctgcacagaagtgaatgtcccagccagcgctacatcagcctgcagtgcagccactgcggcctgcgggccatgacaggccgcatcgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaggaggatgattatgacatcgccctgatgaggctgagcaagcccctgaccctgtctggagagggcatctgcacccccaggagccctgccccccagccccagcaccccctgcagcccagccacctgagcgcctctgtgaacagctacccaggccccaaggccagcgctggccagaagagcaagaccctgaaggacccctacatggagcacttctgcttcatcatccgggagacagaggcccagggcctgtag

SEQ ID NO: 173972 - DNA, 1599 bp, Artificial Sequence
  Description of Artificial Sequence: Synthetic coding sequence
atggagcgggacagccacggcaatgccagccctgcccggacccccagcgctggggccagccctgcccaggccagccctgctggcaccccacctggccgggccagccctgcccaggccagccctgcccaggccagccctgctggcaccccacctggccgggccagccctgcccaggccagccctgctggcaccccacctggccgggccagccctggccgggccagccctgcccaggccagccctgcccaggccagccctgcccgggccagccctgccctggccagcctgagccgcagcagcagcggccgcagcagcagcgcccggagcgcctctgtgaccaccagccccaccagggtgtacctggtgcgggccacccctgtgggcgctgtgcccatccgcagcagccctgcccggagcgccccagccacccgggccacccgggagagccctgtgcagttctggcagggccacacaggcatccgctacaaggagcagcgggagagctgccccaagcatgctgtgcgctgtgatggagtggtggactgcaagctgaagagtgatgagctgggctgtgtgcgctttgactgggacaagagcctgctgaagatctacagcggcagcagccaccagtggctgcccatctgcagcagcaactggaatgacagctacagcgagaagacctgccagcagctgggctttgaaagtgcccacaggaccacagaggtggcccaccgggactttgccaacagcttcagcatcctgcgctacaacagcaccatccaggagagcctgcacaggtctgagtgccccagccagcgctacatcagcctgcagtgcagccactgcggcctgcgggccatgactggaagaattgtgggcggggccctggccagtgacagcaagtggccctggcaggtgtccctgcacttcggcaccacccacatctgtggcggcaccctgattgatgcccagtgggtgctgacagctgcccactgcttctttgtgacccgggagaaggtgctggagggctggaaggtgtatgccggcaccagcaacctgcaccagctgcctgaggccgccagcattgctgagatcatcatcaacagcaactacacagatgaagaagatgattatgacatcgccctgatgaggctgagcaagcccctgaccctgagcgcccacatccacccagcctgcctgcccatgcacggccagaccttcagcctgaatgagacctgctggatcaccggctttgggaagacccgggagacagatgacaagaccagccccttcctgcgggaggtgcaggtgaacctgattgacttcaagaagtgcaatgactacctggtgtatgacagctacctgacccccaggatgatgtgtgccggggacctgcggggcggccgggacagctgccagggcgacagcggcggccccctggtgtgtgagcagaacaaccgctggtacctggccggcgtgacctcctggggcaccggctgcggccagaggaacaagccaggagtgtacaccaaggtgacagaggtgctgccctggatctacagcaagatggagagcgaggtgcgcttcaggaagagctag

SEQ ID NO: 173973 - DNA, 1365 bp, Artificial Sequence
  Description of Artificial Sequence: Synthetic coding sequence
atgggagaaaatgaccccccagctgtggaggcccccttctccttccgcagcctgtttggcctggatgacctgaagatcagccctgtggccccagatgctgatgctgtggccgcccagatcctgagcctgctgcccctgaagttcttccccatcatcgtcatcggcatcatcgccctgatcctggccctggccatcggcctgggcatccactttgactgcagcggcaagtaccgctgccgcagcagcttcaagtgcatcgagctgattgcccgctgtgatggagtgtctgactgcaaggatggagaagatgagtaccgctgtgtgcgggtgggcggccagaatgctgtgctgcaggtgttcaccgctgcctcctggaagaccatgtgcagtgatgactggaagggccactacgccaacgtggcctgtgcccagctgggcttccccagctatgtgtccagtgacaacctgcgggtgagcagcctggagggccagttccgggaggagtttgtgtccattgaccacctgctgcctgatgacaaggtgacagccctgcaccacagcgtgtatgtgcgggagggctgtgccagcggccacgtggtgaccctgcagtgcacagcctgtggccaccggcggggctacagcagcagaattgtgggcggcaacatgagcctgctgagccagtggccctggcaggccagcctgcagttccagggctaccacctgtgtggcggcagcgtcatcacccccctgtggatcatcacagctgcccactgtgtgtatgacctgtacctgcccaagtcctggaccatccaggtgggcctggtgtccctgctggacaacccagcccccagccacctggtggagaagatcgtgtaccacagcaagtacaagcccaagaggctgggcaatgacatcgccctgatgaagctggccggccccctgaccttcaatgagatgatccagcctgtgtgcctgcccaacagcgaggagaacttcccagatggcaaggtgtgctggaccagcggctggggcgccacagaagatggagctggagatgccagccctgtgctgaaccacgccgctgtgcccctcatcagcaacaagatctgcaaccacagagatgtgtatggaggcatcatcagccccagcatgctgtgtgccggctacctgactggaggagtggacagctgccagggcgacagcggcggccccctggtgtgccaggagcggcggctgtggaagctggtgggcgccaccagctttggaattggctgtgccgaggtgaacaagccaggagtgtacaccagggtgaccagcttcctggactggattcatgagcagatggagcgggacctgaagacctag

SEQ ID NO: 173974 - DNA, 1617 bp, Artificial Sequence
  Description of Artificial Sequence: Synthetic coding sequence
atgcaggccgtgggccccaagcccctgcccaccctgctgtgtggcggccgcacaggccacaggacagcccgggtgctgtccttcctgatccgcagctgcccctgtgagcccgggaagggctgtgtgtatggcaagcctgtgaccctgtggcccaccatcagctctgtggtgcccagcaccttcctgggcctgggcaactatgaggtggaggtggaggccgagccagatgtgcggggccctgagatcgtgaccatgggagaaaatgaccccccagctgtggaggcccccttctccttccgcagcctgtttggcctggatgacctgaagatcagccctgtggccccagatgctgatgctgtggccgcccagatcctgagcctgctgcccctgaagttcttccccatcatcgtcatcggcatcatcgccctgatcctggccctggccatcggcctgggcatccactttgactgcagcggcaagtaccgctgccgcagcagcttcaagtgcatcgagctgattgcccgctgtgatggagtgtctgactgcaaggatggagaagatgagtaccgctgtgtgcgggtgggcggccagaatgctgtgctgcaggtgttcaccgctgcctcctggaagaccatgtgcagtgatgactggaagggccactacgccaacgtggcctgtgcccagctgggcttccccagctatgtgtccagtgacaacctgcgggtgagcagcctggagggccagttccgggaggagtttgtgtccattgaccacctgctgcctgatgacaaggtgacagccctgcaccacagcgtgtatgtgcgggagggctgtgccagcggccacgtggtgaccctgcagtgcacagcctgtggccaccggcggggctacagcagcagaattgtgggcggcaacatgagcctgctgagccagtggccctggcaggccagcctgcagttccagggctaccacctgtgtggcggcagcgtcatcacccccctgtggatcatcacagctgcccactgtgtgtatgacctgtacctgcccaagtcctggaccatccaggtgggcctggtgtccctgctggacaacccagcccccagccacctggtggagaagatcgtgtaccacagcaagtacaagcccaagaggctgggcaatgacatcgccctgatgaagctggccggccccctgaccttcaatgagatgatccagcctgtgtgcctgcccaacagcgaggagaacttcccagatggcaaggtgtgctggaccagcggctggggcgccacagaagatggagctggagatgccagccctgtgctgaaccacgccgctgtgcccctcatcagcaacaagatctgcaaccacagagatgtgtatggaggcatcatcagccccagcatgctgtgtgccggctacctgactggaggagtggacagctgccagggcgacagcggcggccccctggtgtgccaggagcggcggctgtggaagctggtgggcgccaccagctttggaattggctgtgccgaggtgaacaagccaggagtgtacaccagggtgaccagcttcctggactggattcatgagcagatggagcgggacctgaagacctag

SEQ ID NO: 173975 - DNA, 1035 bp, Artificial Sequence
  Description of Artificial Sequence: Synthetic coding sequence
atgggagaaaatgaccccccagctgtggaggcccccttctccttccgcagcctgtttggcctggatgacctgaagatcagccctgtggccccagatgctgatgctgtggccgcccagatcctgagcctgctgcccctgaagttcttccccatcatcgtcatcggcatcatcgccctgatcctggccctggccatcggcctgggcatccactttgactgcagcggcaagtaccgctgccgcagcagcttcaagtgcatcgagctgattgcccgctgtgatggagtgtctgactgcaaggatggagaagatgagtaccgctgtgtgcgggtgggcggccagaatgctgtgctgcaggtgttcaccgctgcctcctggaagaccatgtgcagtgatgactggaagggccactacgccaacgtggcctgtgcccagctgggcttccccagctatgtgtccagtgacaacctgcgggtgagcagcctggagggccagttccgggaggagtttgtgtccattgaccacctgctgcctgatgacaaggtgacagccctgcaccacagcgtgtatgtgcgggagggctgtgccagcggccacgtggtgaccctgcagtgcacagcctgtggccaccggcggggctacagcagcagaattgtgggcggcaacatgagcctgctgagccagtggccctggcaggccagcctgcagttccagggctaccacctgtgtggcggcagcgtcatcacccccctgtggatcatcacagctgcccactgtgtgtatgacctgtacctgcccaagtcctggaccatccaggtgggcctggtgtccctgctggacaacccagcccccagccacctggtggagaagatcgtgtaccacagcaagtacaagcccaagaggctgggcaatgacatcgccctgatgaagctggccggccccctgaccttcaacggcaccagcggcagcctgtgtggcagcgctgccctgcccctcttccaggaggacctgcagctgctgattgaggccttcctgtag

SEQ ID NO: 173976 - DNA, 1362 bp, Artificial Sequence
  Description of Artificial Sequence: Synthetic coding sequence
atgggagaaaatgaccccccagctgtggaggcccccttctccttccgcagcctgtttggcctggatgacctgaagatcagccctgtggccccagatgctgatgctgtggccgcccagatcctgagcctgctgcccctgaagttcttccccatcatcgtcatcggcatcatcgccctgatcctggccctggccatcggcctgggcatccactttgactgcagcggcaagtaccgctgccgcagcagcttcaagtgcatcgagctgattgcccgctgtgatggagtgtctgactgcaaggatggagaagatgagtaccgctgtgtgcgggtgggcggccagaatgctgtgctgcaggtgttcaccgctgcctcctggaagaccatgtgcagtgatgactggaagggccactacgccaacgtggcctgtgcccagctgggcttccccagctatgtgtccagtgacaacctgcgggtgagcagcctggagggccagttccgggaggagtttgtgtccattgaccacctgctgcctgatgacaaggtgacagccctgcaccacagcgtgtatgtgcgggagggctgtgccagcggccacgtggtgaccctgcagtgcacagcctgtggccaccggcggggctacagcagcagaattgtgggcggcaacatgagcctgctgagccagtggccctggcaggccagcctgcagttccagggctaccacctgtgtggcggcagcgtcatcacccccctgtggatcatcacagctgcccactgtgtgtatgacctgtacctgcccaagtcctggaccatccaggtgggcctggtgtccctgctggacaacccagcccccagccacctggtggagaagatcgtgtaccacagcaagtacaagcccaagaggctgggcaatgacatcgccctgatgaagctggccggccccctgaccttcaatgagatgatccagcctgtgtgcctgcccaacagcgaggagaacttcccagatggcaaggtgtgctggaccagcggctggggcgccacagaagatggaggagatgccagccctgtgctgaaccacgccgctgtgcccctcatcagcaacaagatctgcaaccacagagatgtgtatggaggcatcatcagccccagcatgctgtgtgccggctacctgaccggcggcgtggacagctgccagggcgacagcggcggccccctggtgtgccaggagcggcggctgtggaagctggtgggcgccaccagctttggcatcggctgtgccgaggtgaacaagccaggagtgtacaccagggtgaccagcttcctggactggatccacgagcagatggagcgggacctgaagacctag

SEQ ID NO: 173977 - DNA, 1314 bp, Artificial Sequence
  Description of Artificial Sequence: Synthetic coding sequence
atgctgcaggaccctgacagcgaccagcccctgaacagcctggatgtgaagcccctgaggaagccccgcatccccatggagaccttcaggaaggtgggcatccccatcatcatcgccctgctgagcctggccagcatcatcatcgtggtggtgctgatcaaggtgatcctggacaagtactacttcctgtgtggccagcccctgcacttcatccccaggaagcagctgtgtgatggagagctggactgccccctgggagaagatgaggagcactgtgtgaagagcttccctgagggccctgctgtggccgtgcggctgagcaaggacaggagcaccctgcaggtgctggacagcgccaccggcaactggttcagcgcctgctttgacaacttcacagaggccctggccgagacagcctgccggcagatgggctacagcagcaagcccaccttccgggctgtggagatcggccctgaccaggacctggatgtggtggagatcacagagaacagccaggagctgaggatgaggaacagcagcggcccctgcctgagcggcagcctggtgtccctgcactgcctggcctgtgggaagagcctgaagaccccccgggtggtgggcgtggaggaggcctctgtggacagctggccctggcaggtgtccatccagtatgacaagcagcacgtgtgtggcggcagcatcctggacccccactgggtgctgacagctgcccactgcttcaggaagcacacagatgtgttcaactggaaggtgcgggccggcagtgacaagctgggcagcttccccagcctggccgtggccaagatcatcatcatcgagttcaaccccatgtaccccaaggacaatgacatcgccctgatgaagctgcagttccccctgaccttctctggaacagtgcggcccatctgcctgcccttctttgatgaggagctgaccccagccacccccctgtggatcatcggctggggcttcaccaagcagaatggaggcaagatgtctgacatcctgctgcaggcctctgtgcaggtgattgacagcacccgctgcaatgctgatgatgcctaccagggcgaggtgacagagaagatgatgtgtgccggcatccctgagggcggcgtggacacctgccagggcgacagcggcggccccctgatgtaccagagcgaccagtggcacgtggtgggcatcgtgtcctggggctacggctgcggcggccccagcaccccaggagtgtacaccaaggtgtctgcctacctgaactggatctacaacgtgtggaaggccgagctgtag

SEQ ID NO: 173978 - DNA, 1299 bp, Artificial Sequence
  Description of Artificial Sequence: Synthetic coding sequence
atgctgcaggaccctgacagcgaccagcccctgaacagcctggatgtgaagcccctgaggaagccccgcatccccatggagaccttcaggaaggtgggcatccccatcatcatcgccctgctgagcctggccagcatcatcatcgtggtggtgctgatcaaggtgatcctggacaagtactacttcctgtgtggccagcccctgcacttcatccccaggaagcagctgtgtgatggagagctggactgccccctgggagaagatgaggagcactgtgtgaagagcttccctgagggccctgctgtggccgtgcggctgagcaaggacaggagcaccctgcaggtgctggacagcgccaccggcaactggttcagcgcctgctttgacaacttcacagaggccctggccgagacagcctgccggcagatgggctacagcagagctgtggagattggaccagaccaggacctggatgtggtggagatcacagagaacagccaggagctgaggatgaggaacagcagcggcccctgcctgagcggcagcctggtgtccctgcactgcctggcctgtgggaagagcctgaagaccccccgggtggtgggcgtggaggaggcctctgtggacagctggccctggcaggtgtccatccagtatgacaagcagcacgtgtgtggcggcagcatcctggacccccactgggtgctgacagctgcccactgcttcaggaagcacacagatgtgttcaactggaaggtgcgggccggcagtgacaagctgggcagcttccccagcctggccgtggccaagatcatcatcatcgagttcaaccccatgtaccccaaggacaatgacatcgccctgatgaagctgcagttccccctgaccttcagcggcaccgtgcggcccatctgcctgcccttctttgatgaggagctgaccccagccacccccctgtggatcatcggctggggcttcaccaagcagaatggaggcaagatgtctgacatcctgctgcaggcctctgtgcaggtgattgacagcacccgctgcaatgctgatgatgcctaccagggcgaggtgacagagaagatgatgtgtgccggcatccctgagggcggcgtggacacctgccagggcgacagcggcggccccctgatgtaccagagcgaccagtggcacgtggtgggcatcgtgtcctggggctacggctgcggcggccccagcaccccaggagtgtacaccaaggtgtctgcctacctgaactggatctacaacgtgtggaaggccgagctgtag

SEQ ID NO: 173979 - DNA, 1308 bp, Artificial Sequence
  Description of Artificial Sequence: Synthetic coding sequence
atggaccctgacagcgaccagcccctgaacagcctggatgtgaagcccctgaggaagccccgcatccccatggagaccttcaggaaggtgggcatccccatcatcatcgccctgctgagcctggccagcatcatcatcgtggtggtgctgatcaaggtgatcctggacaagtactacttcctgtgtggccagcccctgcacttcatccccaggaagcagctgtgtgatggagagctggactgccccctgggagaagatgaggagcactgtgtgaagagcttccctgagggccctgctgtggccgtgcggctgagcaaggacaggagcaccctgcaggtgctggacagcgccaccggcaactggttcagcgcctgctttgacaacttcacagaggccctggccgagacagcctgccggcagatgggctacagcagcaagcccaccttccgggctgtggagatcggccctgaccaggacctggatgtggtggagatcacagagaacagccaggagctgaggatgaggaacagcagcggcccctgcctgagcggcagcctggtgtccctgcactgcctggcctgtgggaagagcctgaagaccccccgggtggtgggcgtggaggaggcctctgtggacagctggccctggcaggtgtccatccagtatgacaagcagcacgtgtgtggcggcagcatcctggacccccactgggtgctgacagctgcccactgcttcaggaagcacacagatgtgttcaactggaaggtgcgggccggcagtgacaagctgggcagcttccccagcctggccgtggccaagatcatcatcatcgagttcaaccccatgtaccccaaggacaatgacatcgccctgatgaagctgcagttccccctgaccttctctggaacagtgcggcccatctgcctgcccttctttgatgaggagctgaccccagccacccccctgtggatcatcggctggggcttcaccaagcagaatggaggcaagatgtctgacatcctgctgcaggcctctgtgcaggtgattgacagcacccgctgcaatgctgatgatgcctaccagggcgaggtgacagagaagatgatgtgtgccggcatccctgagggcggcgtggacacctgccagggcgacagcggcggccccctgatgtaccagagcgaccagtggcacgtggtgggcatcgtgtcctggggctacggctgcggcggccccagcaccccaggagtgtacaccaaggtgtctgcctacctgaactggatctacaacgtgtggaaggccgagctgtag

SEQ ID NO: 173980 - DNA, 1374 bp, Artificial Sequence
  Description of Artificial Sequence: Synthetic coding sequence
atgagcctgatgctggatgaccagccccccatggaggcccagtatgcagaggagggccctggccctggcatcttccgggcagagcccggggaccagcagcaccccatcagccaggccgtgtgctggaggtccatgaggcggggctgtgctgtgctgggcgccctgggcctgctggccggggccggcgtgggctcctggctgctggtgctgtacctgtgcccagctgccagccagcccatcagcggcaccctgcaggatgaggagatcaccctgagctgcagcgaggccagcgctgaggaggccctgctgcctgccctgcccaagacagtgtccttccgcatcaacagcgaggacttcctgctggaggcccaggtgcgggaccagccccgctggctgctggtgtgccacgagggctggagccctgccctgggcctgcagatctgctggagcctgggccacctgcggctgacccaccacaagggcgtgaacctgacagacatcaagctgaacagcagccaggagtttgcccagctgagcccccggctgggcggcttcctggaggaggcctggcagcccaggaacaactgcaccagcggccaggtggtgtccctgcgctgcagtgaatgtggggcccggcccctggccagccgcatcgtgggcggccagagcgtggcccctggccgctggccctggcaggcctctgtggccctgggcttccgccacacctgtggcggctctgtgctggccccccgctgggtggtgacagctgcccactgcatgcacagcttccggctggcccggctgagctcctggagggtgcatgctggcctggtgagccacagcgctgtgcggccccaccagggcgccctggtggagcgcatcatcccccaccccctgtacagcgcccagaaccacgactatgatgtggccctgctgcggctgcagacagccctgaacttcagtgacacagtgggcgctgtgtgcctgcctgccaaggagcagcacttccccaagggcagccgctgctgggtgtctggctggggccacacccaccccagccacacctacagcagtgacatgctgcaggacacagtggtgcccctcttcagcacccagctgtgcaacagcagctgtgtgtacagcggggccctgacccccaggatgctgtgtgccggctacctggatggccgggcagatgcctgccagggcgacagcggcggccccctggtgtgcccagatggagacacctggaggctggtgggcgtggtgtcctggggccggggctgtgccgagcccaaccaccctggggtgtatgccaaggtggccgagttcctggactggattcatgacacagcccaggacagcctgctgtag

SEQ ID NO: 173981 - DNA, 2436 bp, Artificial Sequence
  Description of Artificial Sequence: Synthetic coding sequence
atgctgctgctcttccacagcaagaggatgcctgtggccgaggccccccaggtggccggcggccagggagatggaggagatggagaggaggccgagcctgagggcatgttcaaggcctgtgaggacagcaagaggaaggcccggggctacctgcggctggtgcccctgtttgtgctgctggccctgctggtgctggccagcgctggggtgctgctgtggtacttcctgggctacaaggccgaggtgatggtgtcccaggtgtacagcggcagcctgcgggtgctgaacagacacttcagccaggacctgacccggcgggagagcagcgccttccgctcagaaacagccaaggcccagaagatgctgaaggagctgatcaccagcacccggctgggcacctactacaacagcagctctgtgtacagctttggagagggccccctgacctgcttcttctggttcatcctgcagatccctgagcaccggcggctgatgctgagccctgaggtggtgcaggccctgctggtggaggagctgctgagcacagtgaacagcagcgctgctgtgccctacagagcagaatatgaggtggaccctgagggcctggtgatcctggaggcctctgtgaaggacattgctgccctgaacagcaccctgggctgctaccgctacagctatgtgggccagggccaggtgctgcggctgaagggccctgaccacctggccagcagctgcctgtggcacctgcagggccccaaggacctgatgctgaagctgcggctggagtggaccctggctgaatgtcgggaccggctggccatgtatgatgtggccggccccctggagaagaggctcatcacctctgtgtatggctgcagccggcaggagcctgtggtggaggtgctggccagcggggccatcatggctgtggtgtggaagaagggcctgcacagctactatgacccctttgtgctgtctgtgcagcctgtggtgttccaggcctgtgaggtgaacctgaccctggacaaccggctggacagccagggcgtgctgagcaccccctacttccccagctactacagcccccagacccactgctcctggcacctgactgtgcccagcctggactatggcctggccctgtggtttgatgcctatgccctgcggcggcagaagtatgacctgccctgcacccagggccagtggaccatccagaacagaaggctgtgtggcctgcgcatcctgcagccctatgcagagcgcatccctgtggtggccacagctggcatcaccatcaacttcaccagccagatcagcctgactggacctggggtgcgggtgcactacggcctgtacaaccagagcgacccctgccctggagagttcctgtgcagcgtgaatggcctgtgtgtgcctgcctgtgatggagtgaaggactgccccaacggcctggatgaaagaaactgtgtgtgccgggccaccttccagtgcaaggaggacagcacctgcatcagcctgcccaaggtgtgtgatggccagcctgactgcctgaatggaagtgatgaggagcagtgccaggagggcgtgccctgtggcaccttcaccttccagtgtgaagatagaagctgtgtgaagaagcccaacccccagtgtgatggccgcccagactgcagagatggcagtgatgaggagcactgtgactgtggcctgcagggccccagcagcagaattgtgggcggcgctgtgagcagcgagggggagtggccctggcaggccagcctgcaggtgcggggccgccacatctgtggcggggccctgattgctgaccgctgggtgatcacagctgcccactgcttccaggaggacagcatggccagcacagtgctgtggacagtgttcctgggcaaggtgtggcagaacagccgctggccaggagaggtgtccttcaaggtgtcccggctgctgctgcacccctaccacgaggaggacagccatgactatgatgtggccctgctgcagctggaccaccctgtggtgcgctctgctgctgtgcggcctgtgtgcctgcctgcccggagccacttctttgagcccggcctgcactgctggatcaccggctggggcgccctgcgggagggcggccccatcagcaatgccctgcagaaggtggatgtgcagctgatcccccaggacctgtgcagcgaggtgtaccgctaccaggtgacccccaggatgctgtgtgccggctacaggaagggcaagaaggatgcctgccagggcgacagcggcggccccctggtgtgcaaggccctgagcggccgctggttcctggccggcctggtgtcctggggcctgggctgcggccggcccaactactttggagtgtacacccgcatcaccggggtcatctcctggatccagcaggtggtgacctag

SEQ ID NO: 173982 - DNA, 2475 bp, Artificial Sequence
  Description of Artificial Sequence: Synthetic coding sequence
atgcctgtggccgaggccccccaggtggccggcggccagggagatggaggagatggagaggaggccgagcctgagggcatgttcaaggcctgtgaggacagcaagaggaaggcccggggctacctgcggctggtgcccctgtttgtgctgctggccctgctggtgctggccagcgctggggtgctgctgtggtacttcctgggctacaaggccgaggtgatggtgtcccaggtgtacagcggcagcctgcgggtgctgaacagacacttcagccaggacctgacccggcgggagagcagcgccttccgctcagaaacagccaaggcccagaagatgctgaaggagctgatcaccagcacccggctgggcacctactacaacagcagctctgtgtacagctttggagagggccccctgacctgcttcttctggttcatcctgcagatccctgagcaccggcggctgatgctgagccctgaggtggtgcaggccctgctggtggaggagctgctgagcacagtgaacagcagcgctgctgtgccctacagagcagaatatgaggtggaccctgagggcctggtgatcctggaggcctctgtgaaggacattgctgccctgaacagcaccctgggctgctaccgctacagctatgtgggccagggccaggtgctgcggctgaagggccctgaccacctggccagcagctgcctgtggcacctgcagggccccaaggacctgatgctgaagctgcggctggagtggaccctggccgagtgccgggaccggctggccatgtatgatgtggccggccccctggagaagaggctcatcacctctgtgtatggctgcagccggcaggagcctgtggtggaggtgctggccagcggggccatcatggctgtggtgtggaagaagggcctgcacagctactatgacccctttgtgctgtctgtgcagcctgtggtgttccaggcctgtgaggtgaacctgaccctggacaaccggctggacagccagggcgtgctgagcaccccctacttccccagctactacagcccccagacccactgctcctggcacctgactgtgcccagcctggactatggcctggccctgtggtttgatgcctatgccctgcggcggcagaagtatgacctgccctgcacccagggccagtggaccatccagaacagaaggctgtgtggcctgcgcatcctgcagccctatgcagagcgcatccctgtggtggccacagctggcatcaccatcaacttcaccagccagatcagcctgaccggccctggggtgcgggtgcactacggcctgtacaaccagagcgacccctgccctggagagttcctgtgcagcgtgaatggcctgtgtgtgcctgcctgtgatggagtgaaggactgccccaacggcctggatgagaggaactgtgtgtgccgggccaccttccagtgcaaggaggacagcacctgcatcagcctgcccaaggtgtgtgatggccagcctgactgcctgaatggaagtgatgaggagcagtgccaggagggcgtgccctgtggcaccttcaccttccagtgtgaggacaggagctgtgtgaagaagcccaacccccagtgtgatggccgcccagactgcagagatggcagtgatgaggagcactgtgactgtggcctgcagggccccagcagccgcatcgtgggcggcgctgtgtcctctgagggggagtggccctggcaggccagcctgcaggtgcggggccgccacatctgtggcggggccctgattgctgaccgctgggtgatcacagctgcccactgcttccaggaggacagcatggccagcacagtgctgtggacagtgttcctgggcaaggtgtggcagaacagccgctggccaggagaggtgtccttcaaggtgtcccggctgctgctgcacccctaccacgaggaggacagccatgactatgatgtggccctgctgcagctggaccaccctgtggtgcgctctgctgctgtgcggcctgtgtgcctgcctgcccggagccacttctttgagcccggcctgcactgctggatcaccggctggggcgccctgcgggagggcgccctgcgggcagatgctgtggccctcttctacggctggaggaaccagggcagcgagacctgctgctgccccatcagcaatgccctgcagaaggtggatgtgcagctgatcccccaggacctgtgcagcgaggtgtaccgctaccaggtgacccccaggatgctgtgtgccggctacaggaagggcaagaaggatgcctgccagggcgacagcggcggccccctggtgtgcaaggccctgagcggccgctggttcctggccggcctggtgtcctggggcctgggctgcggccggcccaactactttggagtgtacacccgcatcactggagtcatctcctggatccagcaggtggtgacctag

SEQ ID NO: 173983 - DNA, 2409 bp, Artificial Sequence
  Description of Artificial Sequence: Synthetic coding sequence
atgcctgtggccgaggccccccaggtggccggcggccagggagatggaggagatggagaggaggccgagcctgagggcatgttcaaggcctgtgaggacagcaagaggaaggcccggggctacctgcggctggtgcccctgtttgtgctgctggccctgctggtgctggccagcgctggggtgctgctgtggtacttcctgggctacaaggccgaggtgatggtgtcccaggtgtacagcggcagcctgcgggtgctgaacagacacttcagccaggacctgacccggcgggagagcagcgccttccgctcagaaacagccaaggcccagaagatgctgaaggagctgatcaccagcacccggctgggcacctactacaacagcagctctgtgtacagctttggagagggccccctgacctgcttcttctggttcatcctgcagatccctgagcaccggcggctgatgctgagccctgaggtggtgcaggccctgctggtggaggagctgctgagcacagtgaacagcagcgctgctgtgccctacagagcagaatatgaggtggaccctgagggcctggtgatcctggaggcctctgtgaaggacattgctgccctgaacagcaccctgggctgctaccgctacagctatgtgggccagggccaggtgctgcggctgaagggccctgaccacctggccagcagctgcctgtggcacctgcagggccccaaggacctgatgctgaagctgcggctggagtggaccctggccgagtgccgggaccggctggccatgtatgatgtggccggccccctggagaagaggctcatcacctctgtgtatggctgcagccggcaggagcctgtggtggaggtgctggccagcggggccatcatggctgtggtgtggaagaagggcctgcacagctactatgacccctttgtgctgtctgtgcagcctgtggtgttccaggcctgtgaggtgaacctgaccctggacaaccggctggacagccagggcgtgctgagcaccccctacttccccagctactacagcccccagacccactgctcctggcacctgactgtgcccagcctggactatggcctggccctgtggtttgatgcctatgccctgcggcggcagaagtatgacctgccctgcacccagggccagtggaccatccagaacagaaggctgtgtggcctgcgcatcctgcagccctatgcagagcgcatccctgtggtggccacagctggcatcaccatcaacttcaccagccagatcagcctgaccggccctggggtgcgggtgcactacggcctgtacaaccagagcgacccctgccctggagagttcctgtgcagcgtgaatggcctgtgtgtgcctgcctgtgatggagtgaaggactgccccaacggcctggatgagaggaactgtgtgtgccgggccaccttccagtgcaaggaggacagcacctgcatcagcctgcccaaggtgtgtgatggccagcctgactgcctgaatggaagtgatgaggagcagtgccaggagggcgtgccctgtggcaccttcaccttccagtgtgaggacaggagctgtgtgaagaagcccaacccccagtgtgatggccgcccagactgcagagatggcagtgatgaggagcactgtgactgtggcctgcagggccccagcagccgcatcgtgggcggcgctgtgtcctctgagggggagtggccctggcaggccagcctgcaggtgcggggccgccacatctgtggcggggccctgattgctgaccgctgggtgatcacagctgcccactgcttccaggaggacagcatggccagcacagtgctgtggacagtgttcctgggcaaggtgtggcagaacagccgctggccaggagaggtgtccttcaaggtgtcccggctgctgctgcacccctaccacgaggaggacagccatgactatgatgtggccctgctgcagctggaccaccctgtggtgcgctctgctgctgtgcggcctgtgtgcctgcctgcccggagccacttctttgagcccggcctgcactgctggatcaccggctggggcgccctgcgggagggcggccccatcagcaatgccctgcagaaggtggatgtgcagctgatcccccaggacctgtgcagcgaggtgtaccgctaccaggtgacccccaggatgctgtgtgccggctacaggaagggcaagaaggatgcctgccagggcgacagcggcggccccctggtgtgcaaggccctgagcggccgctggttcctggccggcctggtgtcctggggcctgggctgcggccggcccaactactttggagtgtacacccgcatcactggagtcatctcctggatccagcaggtggtgacctag

SEQ ID NO: 173984 - DNA, 2475 bp, Artificial Sequence; identical to SEQ ID NO: 173982
  Description of Artificial Sequence: Synthetic coding sequence

SEQ ID NO: 173985 - DNA, 426 bp, Artificial Sequence
  Description of Artificial Sequence: Synthetic coding sequence
atgcctgtggccgaggccccccaggtggccggcggccagggagatggaggagatggagaggaggccgagcctgagggcatgttcaaggcctgtgaggacagcaagaggaaggcccggggctacctgcggctggtgcccctgtttgtgctgctggccctgctggtgctggccagcgctggggtgctgctgtggtacttcctgggctacaaggccgaggtgatggtgtcccaggtgtacagcggcagcctgcgggtgctgaacagacacttcagccaggacctgacccggcgggagagcagcgccttccgctcagaaacagccaaggcccagaagatgctgaaggagctgatcaccagcacccggctgggcacctactacaacagcagctctgtgtacagctttggagagggccccctgacctgctag

SEQ ID NO: 173986 - DNA, 1386 bp, Artificial Sequence
  Description of Artificial Sequence: Synthetic coding sequence
atgctgctgctcttccacagcaagaggatgcctgtggccgaggccccccaggtggccggcggccagggagatggaggagatggagaggaggccgagcctgagggcatgttcaaggcctgtgaggacagcaagaggaaggcccggggctacctgcggctggtgcccctgtttgtgctgctggccctgctggtgctggccagcgctggggtgctgctgtggtacttcctgggctacaaggccgaggtgatggtgtcccaggtgtacagcggcagcctgcgggtgctgaacagacacttcagccaggacctgacccggcgggagagcagcgccttccgctcagaaacagccaaggcccagaagatgctgaaggagctgatcaccagcacccggctgggcacctactacaacagcagctctgtgtacagctttggagagggccccctgacctgcttcttctggttcatcctgcagatccctgagcaccggcggctgatgctgagccctgaggtggtgcaggccctgctggtggaggagctgctgagcacagtgaacagcagcgctgctgtgccctacagagcagaatatgaggtggaccctgagggcctggtgatcctggaggcctctgtgaaggacattgctgccctgaacagcaccctgggctgctaccgctacagctatgtgggccagggccaggtgctgcggctgaagggccctgaccacctggccagcagctgcctgtggcacctgcagggccccaaggacctgatgctgaagctgcggctggagtggaccctggctgaatgtcgggaccggctggccatgtatgatgtggccggccccctggagaagaggctcatcacctctgtgtatggctgcagccggcaggagcctgtggtggaggtgctggccagcggggccatcatggctgtggtgtggaagaagggcctgcacagctactatgacccctttgtgctgtctgtgcagcctgtggtgttccaggcctgtgaggtgaacctgaccctggacaaccggctggacagccagggcgtgctgagcaccccctacttccccagctactacagcccccagacccactgctcctggcacctgactgtgcccagcctggactatggcctggccctgtggtttgatgcctatgccctgcggcggcagaagtatgacctgccctgcacccagggccagtggaccatccagaacagacgctaccacttcctgagcagcctgtggctgcccttcctgcccccaccacccagcctgcccagcagcatcgtgacccccagcctggaggcccaggtgcccaacctgcggggagctgcccggggggccagccggggctggggctggtgccaggcctgctgcccctag

SEQ ID NO: 173987 - DNA, 1527 bp, Artificial Sequence
  Description of Artificial Sequence: Synthetic coding sequence
atggccagcgctgtgtggggcagcgccccctggtggggccccccacctccagccccagcccggcccctgacagacatcgacttctgcagcggggcccagctgcaggagctgacccagctgatccaggagctgggcgtgcaggagagctggagcgatggccccaagccaggagctgacctgctgcgggccaaggactttgtgttcagcctgctgggcctggtgcaccggcgggacccccgcttccccccccaggccgagctgctgctgctgcggggcggcatccgggagggcagcctggacctgggccacgcccccctgggcccctatgcccggggcccccactatgatgctggcttcaccctgctggtgcccatgttcagcctggatggaacagagctgcagctggacctggagagctgctacgcccaggtgtgcctgcctgagatggtgtgtggcacccccatccgggagatgtggcaggactgcctgggcccccctgtgcctggggcccgggacagcatccacaggacagaaagtgaggagagcagcaaggactggcagagctctgtggaccagccccacagctatgtgacagagcacgaggcccctgtgtccctggagaagagccccagtgatgtgtctgccagcgagagcccccagcatgatgtggtggacctgggcagcacagcccccctgaagaccatgagcagtgatgtgaccaaggctgctgtggagagccctgtgcccaagcccagcgaggcccgggaggcctggcccaccctgtgcagcgcccaggtggccgcctggttctttgccaccctggccgctgtggccgagagcctcatccctgtgcctggggccccccggctggtgcatgctgcccggcatgctggcttcaccaccgtgctgctggccaccccagagcccccccggcggctgctgctgtttgacctgatccctgtggtgtctgtggccggctggccagagggcgcccggagccacagctgggccggccccctggccagcgagagcgccagcttctacctggtgcctgggggcggcacagagcggccctgtgccagcgcctggcagctgtgctttgcccggcaggagctggccctgaaggcccgcatcccagcccccctgctgcaggcccatgctgctgcccaggccctgctgcggcccctggtggccggcaccagggctgctgccccctacctgctgcggaccctgctgtactgggcctgtgagcggctgcctgccctgtacctggcccggccagaaaatgctggggcctgctgcctgggcctgctggatgagctgggccgggtgctggaggccggcaccctgccccactacttcctgaatggccggcagctgaggactggagatgacagcgctgccctgctgggggagctggcccggctgcggggggaccctgcccgggccctgcgggctgctgtggaggaggccaaggtggccaggaagggcggcggcctggccggcgtgggcggcggggcccactag

SEQ ID NO: 173988 - DNA, 1527 bp, Artificial Sequence; identical to SEQ ID NO: 173987
  Description of Artificial Sequence: Synthetic coding sequence

SEQ ID NO: 173989 - DNA, 825 bp, Artificial Sequence
  Description of Artificial Sequence: Synthetic coding sequence
atgggcaagagcctgagccacctgcccctgcacagcagcaaagaagatgcctatgatggagtgaccagcgagaacatgagaaatggcctggtgaacagcgaggtgcacaatgaagatggaagaaatggagatgtgtcccagttcccctacgtggagttcaccggccgggacagcgtgacctgccccacctgccagggcaccggccgcatcccccggggccaggagaaccagctggtggccctgatcccctacagcgaccagaggctgcggcccaggaggaccaagctgtatgtgatggcctctgtgtttgtgtgcctgctgctgagcggcctggccgtgttcttcctgttccccaggagcattgatgtgaagtacatcggcgtgaagagcgcctacgtgtcctatgatgtgcagaagaggaccatctacctgaacatcaccaacaccctgaacatcaccaacaacaactactacagcgtggaggtggagaacatcacagcccaggtgcagttcagcaagacagtcatcggcaaggcccggctgaacaacatcaccatcatcggccccctggacatgaagcagattgactacacagtgcccaccgtgattgctgaggagatgagctacatgtatgacttctgcaccctcatcagcatcaaggtgcacaacatcgtgctgatgatgcaggtgacagtgaccaccacctacttcggccacagcgagcagatcagccaggagcgctaccagtatgtggactgtggcaggaacaccacctaccagctgggccagagcgagtacctgaatgtgctgcagccccagcagtag

SEQ ID NO: 173990 - DNA, 825 bp, Artificial Sequence; identical to SEQ ID NO: 173989
  Description of Artificial Sequence: Synthetic coding sequence

SEQ ID NO: 173991 - DNA, 78 bp, Artificial Sequence
  Description of Artificial Sequence: Synthetic coding sequence
atgggcaagagcctgagccacctgcccctgcacagcagcaaagaagatgcctatgatggagtgaccagcgagaactag

SEQ ID NO: 173992 - DNA, 333 bp, Artificial Sequence
  Description of Artificial Sequence: Synthetic coding sequence
atgggcaagagcctgagccacctgcccctgcacagcagcaaagaagatgcctatgatggagtgaccagcgagaacatgagaaatggcctggtgaacagcgaggtgcacaatgaagatggaagaaatggagatgtgtcccagttcccctacgtggagttcaccggccgggacagcgtgacctgccccacctgccagggcaccggccgcatcccccggggccaggagaaccagctggtggccctgatcccctacagcgaccagaggctgcggcccaggaggaccaagctgtatgtgatggcctctgtgtttgtgtgcctgctgctgtctggatag

SEQ ID NO: 173993 - DNA, 369 bp, Artificial Sequence
  Description of Artificial Sequence: Synthetic coding sequence
atgcacggcacctttgtgatcctgctgcccctgagcctcatcctgatggtgtttggaggcatgacaggcttcctgtccttcctgctgcaggcctacctgctgctgctgctgaccggcatcctcttcctgtttggagccatggtgaccctggccggcatctctgtgtacatcgcctacagcgctgctgccttccgggaggccctgtgcctgctggaggagaaggccctgctggaccaggtggacatcagctttggctggagcctggccctgggctggatctccttcatcgccgagctgctgactggagctgccttcctggccgccgcccgggagctgagcctgcggcggcggcaggaccaggccatctag

SEQ ID NO: 173994 - DNA, 570 bp, Artificial Sequence
  Description of Artificial Sequence: Synthetic coding sequence
atgggcctgggcgcccggggggcctgggccgccctgctgctgggcaccctgcaggtgctggccctgctgggcgccgcccatgaatctgctgccatggccgagaccctgcagcacgtgcccagcgaccacaccaatgagaccagcaacagcacagtgaagccacccacctctgtggccagtgacagcagcaacaccaccgtgaccaccatgaagcccacagctgccagcaacaccaccaccccaggcatggtgtccaccaacatgaccagcaccaccctgaagagcacccccaagaccacctctgtgtcccagaacaccagccagatcagcaccagcaccatgacagtgacccacaacagctctgtgaccagcgctgccagctctgtgaccatcaccaccaccatgcacagcgaggccaagaagggcagcaagtttgacaccggcagctttgtgggcggcatcgtgctgaccctgggcgtgctgagcatcctgtacatcggctgcaagatgtactacagccggcggggcatccgctaccgcaccattgatgaacatgatgccatcatctag

SEQ ID NO: 173995 - DNA, 627 bp, Artificial Sequence
  Description of Artificial Sequence: Synthetic coding sequence
atgggcctgggcgcccggggggcctgggccgccctgctgctgggcaccctgcaggtgctggccctgctgggcgccgcccatgaatctgctgccatggccgccagcgccaacattgaaaattctggcctgccccacaacagcagcgccaacagcacagagaccctgcagcacgtgcccagcgaccacaccaatgagaccagcaacagcacagtgaagccacccacctctgtggccagtgacagcagcaacaccaccgtgaccaccatgaagcccacagctgccagcaacaccaccaccccaggcatggtgtccaccaacatgaccagcaccaccctgaagagcacccccaagaccacctctgtgtcccagaacaccagccagatcagcaccagcaccatgacagtgacccacaacagctctgtgaccagcgctgccagctctgtgaccatcaccaccaccatgcacagcgaggccaagaagggcagcaagtttgacaccggcagctttgtgggcggcatcgtgctgaccctgggcgtgctgagcatcctgtacatcggctgcaagatgtactacagcagaagaggcatccgctaccgcaccattgatgaacatgatgccatcatctag

SEQ ID NO: 173996 - DNA, 588 bp, Artificial Sequence
  Description of Artificial Sequence: Synthetic coding sequence
atggagaaccacaagagcaacaacaaggagaacatcaccatcgtggacatcagcaggaagatcaaccagctgcctgaggccgagaggaacctgctggagaatggatctgtgtatgtgggcctgaatgctgccctgtgtggcctgattgccaacagcctcttccgccgcatcctgaatgtgaccaaggccagaattgctgctggcctgcccatggccggcatccccttcctgaccacagacctgacctaccgctgctttgtgtccttccccctgaacacaggagacctggactgtgagacctgcaccatcaccaggagcggcctgaccggcctggtgattggaggcctgtaccctgtgttcctggccatccctgtgaatggaggcctggccgcccgctaccagagcgccctgctgccccacaagggcaacatcctgagctactggatccgcaccagcaagcctgtgttcaggaagatgctgttccccatcctgctgcagaccatgttcagcgcctacctgggcagcgagcagtacaagctgctgatcaaggccctgcagctgtctgagcccgggaaggagatccactag

SEQ ID NO: 173997 - DNA, 378 bp, Artificial Sequence
  Description of Artificial Sequence: Synthetic coding sequence
atggccggcatccccttcctgaccacagacctgacctaccgctgctttgtgtccttccccctgaacacaggagacctggactgtgagacctgcaccatcaccaggagcggcctgaccggcctggtgattggaggcctgtaccctgtgttcctggccatccctgtgaatggaggcctggccgcccgctaccagagcgccctgctgccccacaagggcaacatcctgagctactggatccgcaccagcaagcctgtgttcaggaagatgctgttccccatcctgctgcagaccatgttcagcgcctacctgggcagcgagcagtacaagctgctgatcaaggccctgcagctgtctgagcccgggaaggagatccactag

SEQ ID NO: 173998 - DNA, 489 bp, Artificial Sequence
  Description of Artificial Sequence: Synthetic coding sequence
atgctgcagaccagcaactacagcctggtgctgagcctgcagttcctgctgctgtcctatgacctgtttgtgaacagcttcagcgagctgctgcagaagacccctgtgatccagctggtgctcttcatcatccaggacattgctgtgctcttcaacatcatcatcatcttcctgatgttcttcaacacctttgtgttccaggccggcctggtgaacctgctcttccacaagttcaagggcaccatcatcctgacagctgtgtactttgccctgagcatcagcctgcacgtgtgggtgatgaacctgcgctggaagaacagcaacagcttcatctggacagatggcctgcagatgctgtttgtgttccagaggctggccgctgtgctgtactgctacttctacaagaggacagctgtgcggctgggggacccccacttctaccaggacagcctgtggctgaggaaggagttcatgcaggtgagaagatag

SEQ ID NO: 173999 - DNA, 318 bp, Artificial Sequence
  Description of Artificial Sequence: Synthetic coding sequence
atgctgcagaccagcaactacagcctggtgctgagcctgcagttcctgctgctgtcctatgacctgtttgtgaacagcttcagcgagctgctgcagaagacccctgtgatccagctggtgctcttcatcatccaggacattgctgtgctcttcaacatcatcatcatcttcctgatgttcttcaacacctttgtgttccaggccggcctggtgaacctgctcttccacaagttcaagggcaccatcatcctgacagctgtgtactttgccctgagcatcagcctgcacgtgtgggtgatggtgcgggtggccgtgtag

SEQ ID NO: 174000 - DNA, 1140 bp, Artificial Sequence
  Description of Artificial Sequence: Synthetic coding sequence
atgccccacagcagcctgcaccccagcatcccctgcccccggggccacggggcccagaaggccgccctggtgctgctgagcgcctgcctggtgaccctgtggggcctgggggagcccccagagcacaccctgcgctacctggtgctgcacctggccagcctgcagctgggcctgctgctgaatggagtgtgcagcctggccgaggagctgcggcacatccacagccgctaccggggcagctactggaggacagtgcgggcctgcctgggctgccccctgcggcggggggccctgctgctgctgagcatctacttctactacagcctgcccaatgctgtgggcccccccttcacctggatgctggccctgctgggcctgagccaggccctgaacatcctgctgggcctgaagggcctggccccagctgagatctctgctgtgtgtgagaagggcaacttcaacgtggcccacggcctggcctggagctactacatcggctacctgcggctcatcctgcctgagctgcaggcccgcatccgcacctacaaccagcactacaacaacctgctgcggggagctgtgtcccagaggctgtacatcctgctgcccctggactgtggggtgcctgacaacctgtccatggctgaccccaacatccgcttcctggacaagctgccccagcagacaggagaccatgctggcatcaaggacagagtgtacagcaacagcatctatgagctgctggagaatggccagagagctggcacctgtgtgctggagtatgccacccccctgcagaccctgtttgccatgagccagtacagccaggccggcttcagccgggaggaccggctggagcaggccaagctgttctgcaggaccctggaggacatcctggctgatgcccctgagagccagaacaactgccgcctcatcgcctaccaggagccagcagatgacagcagcttcagcctgagccaggaggtgctgcggcacctgcggcaggaggagaaggaggaggtgacagtgggcagcctgaagaccagcgctgtgcccagcaccagcaccatgagccaggagcctgagctgctgatcagcggcatggagaagcccctgcccctgaggacagacttctcctag

SEQ ID NO: 174001 - DNA, 762 bp, Artificial Sequence
  Description of Artificial Sequence: Synthetic coding sequence
atgccccacagcagcctgcaccccagcatcccctgcccccggggccacggggcccagaaggccgccctggtgctgctgagcgcctgcctggtgaccctgtggggcctgggggagcccccagagcacaccctgcgctacctggtgctgcacctggccagcctgcagctgggcctgctgctgaatggagtgtgcagcctggccgaggagctgcggcacatccacagccgctaccggggcagctactggaggacagtgcgggcctgcctgggctgccccctgcggcggggggccctgctgctgctgagcatctacttctactacagcctgcccaatgctgtgggcccccccttcacctggatgctggccctgctgggcctgagccaggccctgaacatcctgctgggcctgaagggcctggccccagctgagatctctgctgtgtgtgagaagggcaacttcaacgtggcccacggcctggcctggagctactacatcggctacctgcggctcatcctgcctgagctgcaggcccgcatccgcacctacaaccagcactacaacaacctgctgcggggagctgtgtcccagaggctgtacatcctgctgcccctggactgtggggtgcctgacaacctgtccatggctgaccccaacatccgcttcctggacaagctgccccagcagacaggagaccatgctggcatcaaggacagagtgtacagcaacagcatctatgagctgctggagaatggccagaggtag

SEQ ID NO: 174002 - DNA, 423 bp, Artificial Sequence
  Description of Artificial Sequence: Synthetic coding sequence
atgcccagcgccttctctgtgtcctccttccctgtgtccatcccagctgtgctgacccagacagactggacagagccctggctgatgggcctggccaccttccacgccctgtgtgtgctgctgacctgcctgagcagccgcagctaccgcctgcagatcggccacttcctgtgcctggtgatcctggtgtactgtgccgagtacatcaatgaggccgccgccatgaactggaggctcttcagcaagtaccagtactttgacagccggggcatgttcatcagcatcgtgttcagcgcccccctgctggtgaatgccatgatcatcgtggtgatgtgggtgtggaagaccctgaatgtgatgacagacctgaagaatgcccaggagaggaggaaggagaagaagagaagaagaaaagaagattag

SEQ ID NO: 174003 - DNA, 384 bp, Artificial Sequence
  Description of Artificial Sequence: Synthetic coding sequence
atgctgagcggctacctgcagacagactggacagagccctggctgatgggcctggccaccttccacgccctgtgtgtgctgctgacctgcctgagcagccgcagctaccgcctgcagatcggccacttcctgtgcctggtgatcctggtgtactgtgccgagtacatcaatgaagctgctgccatgaactggaggctcttcagcaagtaccagtactttgacagccggggcatgttcatcagcatcgtgttttctgcccccctgctggtgaatgccatgatcatcgtggtgatgtgggtgtggaagaccctgaatgtgatgacagacctgaagaatgcccaggagaggaggaaggagaagaagagaagaaggaaggaggactag

SEQ ID NO: 174004 - DNA, 1560 bp, Artificial Sequence
  Description of Artificial Sequence: Synthetic coding sequence
ggccctgcccagagggccagcagccccatccccagcgctggaagaagagagggcgcccaggccgccacccagagggtggagcggcgggaccgggaccccggcggctgtgccgcctggacccccagcaccctgcccctgagccccaggtctgctgccagcagcagcacctgtgccggcggctgcggcaagaggacagccagcagcaggaggaccagccggcccagcaggatgacagccaccaccggccccaaggtgatccagaccagcgctgccaacttcagcctgaacaacagcaagaagctgaagcccatccagatcctgagcaaccccctgagcacctacaaccagcagctgtggctgacctgtgtggtggagctggaccagagcaaggagaccagcatcaagaccagcttccccatgacagtgaaggtggatggagtggcccaggacggcaccaccatgtacatccacaacaaggtgcacaacagaaccaggaccctgacctgtgccgggaaatgtgccgagatcatcgtggcccacctgggctacctgaactacacccagtacaccgtcatcgtgggctttgagcacctgaagctgcccatcaagggcatgaacttcacctggaagacctacaacccagccttcagccggctggagatctggttccgcttcttctttgtggtgctgaccttcatcgtgacctgcctgtttgcccacagcctgaggaagttctccatgagggactggggcatcgagcagaagtggatgtctgtgctgctgcccctgctgctgctgtacaatgaccccttcttccccctgtccttcctggtgaacagctggctgcccggcatgctggatgacctcttccagagcatgttcctgtgtgccctgctgctcttctggctgtgtgtgtaccacggcatccgggtgcagggcgagaggaagtgcctgaccttctacctgcccaagttcttcatcgtgggcctgctgtggctggcctctgtgaccctgggcatctggcagacagtgaatgagctgcatgaccccatgtaccagtacagagtggacaccggcaacttccagggcatgaaggtgttcttcatggtggtggccgctgtgtacatcctgtacctgctcttcctgattgtgcgggcctgcagcgagctgcggcacatgccctacgtggacctgcggctgaagttcctgacagccctgacctttgtggtgctggtgatcagcatcgccatcctgtacctgcgctttggagcccaggtgctgcaggacaactttgtggccgagctgagcacccactaccagaagccagctgagttcctgtccttctacggcctgctgaacttctacctgtacaccctggcctttgtgtacagccccagcaagaatgccctgtatgagagccagctgaaggacaacccagccttctccatgctgaatgacagtgatgatgatgtgatctacggcagtgactatgaggagatgcccctgcagaatggccaggccatccgggccaagtacaaggaggagagtgacagcgactag

SEQ ID NO: 174005 - DNA, 1839 bp, Artificial Sequence
  Description of Artificial Sequence: Synthetic coding sequence
atgggcgccgcccccagccccacccaggccagcagccggggcggcggccctggccccccagcccccaccagggctgtgagcagcagcagccgggcccggggcggggccctgagcgccctgggccccagccctgcccggcccctgaccaccagccctgccccagcccccccacccaggagcaggcctgcccggcagcagcctgacccccagtgctgggagaagaggggcggggccggcggggacaccaagggcggcgctgctggccctggccctggccgcctgcggggcatggatgctgagtacccagcctttgagccccccctgtgcagcgagctgaagcacctgtgccggcggctgcgggaggcctaccgggagctgaaggaggacctgacccccttcaaggatgaccgctactaccgcctggcccccatgaggctgtacaccctgagcaagaggcactttgtgctggtgtttgtggtgttcttcatctgcttcggcctgaccatctttgtgggcatccggggccccaaggtgatccagaccagcgctgccaacttcagcctgaacaacagcaagaagctgaagcccatccagatcctgagcaaccccctgagcacctacaaccagcagctgtggctgacctgtgtggtggagctggaccagagcaaggagaccagcatcaagaccagcttccccatgacagtgaaggtggatggagtggcccaggacggcaccaccatgtacatccacaacaaggtgcacaacagaaccaggaccctgacctgtgccgggaaatgtgccgagatcatcgtggcccacctgggctacctgaactacacccagtacacagtgattgtgggctttgagcacctgaagctgcccatcaagggcatgaacttcacctggaagacctacaacccagccttcagccggctggagatctggttccgcttcttctttgtggtgctgaccttcatcgtgacctgcctgtttgcccacagcctgaggaagttctccatgagggactggggcatcgagcagaagtggatgtctgtgctgctgcccctgctgctgctgtacaatgaccccttcttccccctgtccttcctggtgaacagctggctgcccggcatgctggatgacctcttccagagcatgttcctgtgtgccctgctgctcttctggctgtgtgtgtaccacggcatccgggtgcagggcgagaggaagtgcctgaccttctacctgcccaagttcttcatcgtgggcctgctgtggctggcctctgtgaccctgggcatctggcagacagtgaatgagctgcatgaccccatgtaccagtacagagtggacaccggcaacttccagggcatgaaggtgttcttcatggtggtggccgctgtgtacatcctgtacctgctcttcctgattgtgcgggcctgcagcgagctgcggcacatgccctacgtggacctgcggctgaagttcctgacagccctgacctttgtggtgctggtgatcagcatcgccatcctgtacctgcgctttggagcccaggtgctgcaggacaactttgtggccgagctgagcacccactaccagaacagcgctgagttcctgtccttctacggcctgctgaacttctacctgtacaccctggcctttgtgtacagccccagcaagaatgccctgtatgagagccagctgaaggacaacccagccttctccatgctgaatgacagtgatgatgatgtgatctacggcagtgactatgaggagatgcccctgcagaatggccaggccatccgggccaagtacaaggaggagagtgacagcgactag

SEQ ID NO: 174006 - DNA, 1317 bp, Artificial Sequence
  Description of Artificial Sequence: Synthetic coding sequence
atgccctgcacctgcacctggaggaactggaggcagtggatccggcccctggtggccgtcatctacctggtgtccatcgtggtggccgtgcccctgtgtgtgtgggagctgcagaagctggaggtgggcatccacaccaaggcctggttcatcgccggcatcttcctgctgctgaccatccccatcagcctgtgggtgatcctgcagcacctggtgcactacacccagcctgagctgcagaagcccatcatccgcatcctgtggatggtgcccatctacagcctggacagctggatcgccctgaagtacccaggcatcgccatctacgtggacacctgcagagaatgttatgaggcctacgtgatctacaacttcatgggcttcctgaccaactacctgaccaaccgctaccccaacctggtgctgatcctggaggccaaggaccagcagaagcacttcccccccctgtgctgctgccccccctgggccatgggagaggtgctgctcttccgctgcaagctgggcgtgctgcagtacacagtggtgcggcccttcaccaccatcgtggccctgatctgtgagctgctgggcatctatgatgagggcaacttctccttcagcaatgcctggacctacctggtgatcatcaacaacatgagccagctgtttgccatgtactgcctgctgctcttctacaaggtgctgaaggaggagctgagccccatccagcctgtgggcaagttcctgtgtgtgaagctggtggtgtttgtgtccttctggcaggccgtggtgattgccctgctggtgaaggtgggcgtcatcagcgagaagcacacctgggagtggcagacagtggaggccgtggccaccggcctgcaggacttcatcatctgcatcgagatgttcctggccgccatcgcccaccactacaccttctcctacaagccctacgtgcaggaggccgaggagggcagctgctttgacagcttcctggccatgtgggatgtgtctgacatcagagatgacatcagcgagcaggtgagacatgtgggccgcacagtgcggggccaccccaggaagaagctgtttcctgaggaccaggaccagaatgagcacaccagcctgctgagcagcagcagccaggatgccatcagcatcgccagctccatgccacccagccccatgggccactaccagggcttcggccacacagtgaccccccagaccacccccaccacagccaagatcagtgatgagatcctgagtgacaccatcggggagaagaaggagcccagcgacaagtctgtggacagctag

SEQ ID NO: 174007 - DNA, 4152 bp, Artificial Sequence
  Description of Artificial Sequence: Synthetic coding sequence
atgtatgccacagacagccggggccacagccctgccttcctgcagccccagaatggaaacagccgccaccccagcggctacgtgcctgggaaggtggtgcccctgcggcccccacctccacccaagagccaggccagcgccaagttcaccagcatcagaagagaagatcgggccacctttgccttcagccctgaggagcagcaggcccagcgggagagccagaagcagaagaggcacaagaacaccttcatctgctttgccatcaccagcttctccttcttcatcgccctggccatcatcctgggcatcagcagcaaatatgccccagatgagaactgcccagaccagaacccccggctgaggaactgggaccccggccaggacagcgccaagcaggtggtgatcaaggagggggacatgctgcggctgaccagtgatgccaccgtgcacagcatcgtcatccaggacggcggcctgctggtgtttggagacaacaaggatggcagcaggaacatcaccctgcggacccactacatcctgatccaggatggaggagccctgcacatcggggctgagaagtgccgctacaagagcaaggccaccatcaccctgtatggcaagagtgatgaaggagagagcatgcccaccttcggcaagaagttcatcggcgtggaggccggcggcaccctggagctgcatggagccaggaaggcctcctggaccctgctggcccggaccctgaacagcagcggcctgcccttcggcagctacacctttgagaaggacttcagccggggcctgaatgtgcgggtcatcgaccaggacacagccaagatcctggagagcgagagatttgacacccatgagtacagaaatgaaagccggcggctgcaggagttcctgcgcttccaggaccccggcagaattgtggccatcgctgtgggggacagcgctgccaagagcctgctgcagggcaccatccagatgatccaggagcggctgggcagcgagctgatccagggcctgggctaccggcaggcctgggccctggtgggcgtgattgatggcggcagcaccagctgcaatgaatctgtgaggaactatgagaaccacagcagcggcggcaaggccctggcccagcgggagttctacacagtggatggccagaagttctctgtgacagcctacagcgagtggattgagggcgtgtccctgagcggcttccgggtggaggtggtggatggagtgaagctgaacctgctggatgatgtgtcctcctggaagccaggggaccagatcgtggtggccagcacagactacagcatgtaccaggccgaggagttcaccctgctgccctgcagtgaatgtagccacttccaggtgaaggtgaaggagaccccccagttcctgcacatgggagagatcattgatggagtggacatgagagctgaggtgggcatcctgaccaggaacatcgtcatccagggcgaggtggaggacagctgctacgccgagaaccagtgccagttctttgattatgacaccttcggcggccacatcatgatcatgaagaacttcacctctgtgcacctgtcctatgtggagctgaagcacatgggccagcagcagatgggccgctaccctgtgcacttccacctgtgtggagatgtggactacaagggcggctacagacatgccacctttgtggatggcctgagcatccaccacagcttcagccgctgcatcaccgtgcacggcaccaacggcctgctgatcaaggacaccatcggctttgacaccctgggccactgcttcttcctggaggatggcatcgagcagaggaacaccctcttccacaacctgggcctgctgaccaagccaggcaccctgctgcccacagacaggaacaacagcatgtgcaccaccatgagggacaaggtgtttggaaactacatccctgtgcctgccacagactgcatggctgtgtccaccttctggatcgcccaccccaacaacaacctgatcaacaatgctgctgctggcagccaggatgctggcatctggtacctgttccacaaggagcccaccggggagagcagcggcctgcagctgctggccaagccagagctgacccccctgggcatcttctacaacaacagagtgcacagcaacttcaaggccggcctcttcatcgacaagggcgtgaagaccaccaacagcagcgctgctgacccccgggagtacctgtgcctggacaacagcgcccgcttccggccccaccaggatgccaaccctgagaagccccgggtggccgccctgattgacaggctcatcgccttcaagaacaatgacaatggagcctgggtgcggggcggggacatcatcgtgcagaacagcgcctttgctgacaatggcatcggcctgacctttgccagtgatggcagcttccccagtgatgagggcagcagccaggaggtgtctgagagcctgtttgtgggggagagcaggaactacggcttccagggcggccagaacaagtatgtgggcaccggcggcatcgaccagaagcccaggaccctgcccaggaacagaaccttccccatccggggcttccagatctatgatggccccatccacctgaccaggagcaccttcaagaagtatgtgcccaccccagaccgctacagcagcgccatcggcttcctgatgaagaacagctggcagatcacccccaggaacaacatcagcctggtgaagtttggcccccacgtgtccctgaatgtgttcttcggcaagccaggcccctggtttgaggactgtgagatggatggagacaagaacagcatcttccatgacattgatggctctgtgacaggctacaaggatgcctacgtgggccgcatggacaactacctgatccgccaccccagctgtgtgaatgtgtccaagtggaatgctgtgatctgcagcggcacctacgcccaggtgtatgtgcagacctggagcacccagaacctgtccatgaccatcaccagagatgagtaccccagcaaccccatggtgctgcggggcatcaaccagaaggccgccttcccccagtaccagcctgtggtgatgctggagaagggctacaccatccactggaatggacctgcccccaggaccaccttcctgtacctggtgaacttcaacaagaatgactggatccgggtgggcctgtgctaccccagcaacaccagcttccaggtgaccttcggctacctgcagaggcagaatggcagcctgagcaagattgaggagtatgagcctgtgcacagcctggaggagctgcagaggaagcagagcgagaggaagttctactttgacagcagcacaggcctgctcttcctgtacctgaaggccaagagccacagacatggccacagctactgcagcagccagggctgtgagcgggtgaagatccaggccgccacagacagcaaggacatcagcaactgcatggccaaggcctacccccagtactacaggaagcccagcgtggtgaagaggatgcctgccatgctgaccggcctgtgccagggctgcggcacccggcaggtggtgttcaccagtgacccccacaagagctacctgcctgtgcagttccagagcccagacaaggccgagacccagagaggagaccccagcgtcatctctgtgaatggaacagacttcaccttccgctctgctggggtgctgctgctggtggtggacccctgcagcgtgcccttccggctgacagagaagacagtgttccccctggctgatgtgtccagaattgaggagtacctgaagacaggcatcccccccaggagcatcgtgctgctgagcaccagaggagagatcaagcagctgaacatcagccacctgctggtgcccctgggcctggccaagccagcccacctgtatgacaagggcagcaccatcttcctgggcttcagcggcaacttcaagcccagctggaccaagctgttcaccagccctgctggccagggcctgggcgtgctggagcagttcatccccctgcagctggatgaatatggctgcccccgggccaccaccgtgagaagaagagacctggagctgctgaagcaggccagcaaggcccactag

SEQ ID NO: 174008 - DNA, 3963 bp, Artificial Sequence
  Description of Artificial Sequence: Synthetic coding sequence
atgtatgccacagacagccggggccacagccctgccttcctgcagccccagaatggaaacagccgccaccccagcggctacgtgcctgggaaggtggtgcccctgcggcccccacctccacccaagagccaggccagcgccaagttcaccagcatcagaagagaagatcgggccacctttgccttcagccctgaggagcagcaggcccagcgggagagccagaagcagaagaggcacaagaacaccttcatctgctttgccatcaccagcttctccttcttcatcgccctggccatcatcctgggcatcagcagcaaatatgccccagatgagaactgcccagaccagaacccccggctgaggaactgggaccccggccaggacagcgccaagcaggtggtgatcaaggagggggacatgctgcggctgaccagtgatgccaccgtgcacagcatcgtcatccaggacggcggcctgctggtgtttggagacaacaaggatggcagcaggaacatcaccctgcggacccactacatcctgatccaggatggaggagccctgcacatcggggctgagaagtgccgctacaagagcaaggccaccatcaccctgtatggcaagagtgatgaaggagagagcatgcccaccttcggcaagaagttcatcggcgtggaggccggcggcaccctggagctgcatggagccaggaaggcctcctggaccctgctggcccggaccctgaacagcagcggcctgcccttcggcagctacacctttgagaaggacttcagccggggcctgaatgtgcgggtcatcgaccaggacacagccaagatcctggagagcgagagatttgacacccatgagtacagaaatgaaagccggcggctgcaggagttcctgcgcttccaggaccccggcagaattgtggccatcgctgtgggggacagcgctgccaagagcctgctgcagggcaccatccagatgatccaggagcggctgggcagcgagctgatccagggcctgggctaccggcaggcctgggccctggtgggcgtgattgatggcggcagcaccagctgcaatgaatctgtgaggaactatgagaaccacagcagcggcggcaaggccctggcccagcgggagttctacacagtggatggccagaagttctctgtgacagcctacagcgagtggattgaggagaccccccagttcctgcacatgggagagatcattgatggagtggacatgagagctgaggtgggcatcctgaccagaaatattgtcatccagggcgaggtggaggacagctgctacgccgagaaccagtgccagttctttgattatgacacctttggaggccacatcatgatcatgaagaacttcacctctgtgcacctgtcctatgtggagctgaagcacatgggccagcagcagatgggccgctaccctgtgcacttccacctgtgtggagatgtggactacaagggcggctacagacatgccacctttgtggatggcctgagcatccaccacagcttcagccgctgcatcaccgtgcacggcaccaacggcctgctgatcaaggacaccatcggctttgacaccctgggccactgcttcttcctggaggatggcatcgagcagaggaacaccctcttccacaacctgggcctgctgaccaagccaggcaccctgctgcccacagacaggaacaacagcatgtgcaccaccatgagggacaaggtgtttggaaactacatccctgtgcctgccacagactgcatggctgtgtccaccttctggatcgcccaccccaacaacaacctgatcaacaatgctgctgctggcagccaggatgctggcatctggtacctgttccacaaggagcccactggagagagcagcggcctgcagctgctggccaagccagagctgacccccctgggcatcttctacaacaacagagtgcacagcaacttcaaggccggcctcttcatcgacaagggcgtgaagaccaccaacagcagcgctgctgacccccgggagtacctgtgcctggacaacagcgcccgcttccggccccaccaggatgccaaccctgagaagccccgggtggccgccctgattgaccggctgattgccttcaagaacaatgacaacggggcctgggtgcggggcggggacatcatcgtgcagaacagcgcctttgctgacaatggaattggcctgacctttgccagtgatggcagcttccccagtgatgagggcagcagccaggaggtgtctgagagcctgtttgtgggggagagcagaaattatggcttccagggcggccagaacaagtatgtgggcactggaggcatcgaccagaagcccaggaccctgcccaggaacagaaccttccccatccggggcttccagatctatgatggccccatccacctgaccaggagcaccttcaagaagtatgtgcccaccccagaccgctacagcagcgccatcggcttcctgatgaagaacagctggcagatcaccccaagaaacaacatcagcctggtgaagtttggcccccacgtgtccctgaatgtgttcttcggcaagccaggcccctggtttgaggactgtgagatggatggagacaagaacagcatcttccatgacattgatggctctgtgacaggctacaaggatgcctacgtgggccgcatggacaactacctgatccgccaccccagctgtgtgaatgtgtccaagtggaatgctgtgatctgcagcggcacctacgcccaggtgtatgtgcagacctggagcacccagaacctgtccatgaccatcaccagagatgagtaccccagcaaccccatggtgctgcggggcatcaaccagaaggccgccttcccccagtaccagcctgtggtgatgctggagaagggctacaccatccactggaatggacctgcccccaggaccaccttcctgtacctggtgaacttcaacaagaatgactggatccgggtgggcctgtgctaccccagcaacaccagcttccaggtgaccttcggctacctgcagaggcagaatggcagcctgagcaagattgaggagtatgagcctgtgcacagcctggaggagctgcagaggaagcagagcgagaggaagttctactttgacagcagcacaggcctgctcttcctgtacctgaaggccaagagccaccgccacggccacagctactgcagcagccagggctgtgagcgggtgaagatccaggccgccacagacagcaaggacatcagcaactgcatggccaaggcctacccccagtactacaggaagcccagcgtggtgaagaggatgcctgccatgctgaccggcctgtgccagggctgcggcacccggcaggtggtgttcaccagtgacccccacaagagctacctgcctgtgcagttccagagcccagacaaggccgagacccagagaggagaccccagcgtcatctctgtgaatggaacagacttcaccttccgctctgctggggtgctgctgctggtggtggacccctgcagcgtgcccttccggctgacagagaagacagtgttccccctggctgatgtgagccgcatcgaggagtacctgaagacaggcatccccccaagaagcatcgtgctgctgagcaccagaggagagatcaagcagctgaacatcagccacctgctggtgcccctgggcctggccaagccagcccacctgtatgacaagggcagcaccatcttcctgggcttcagcggcaacttcaagcccagctggaccaagctgttcaccagccctgctggccagggcctgggcgtgctggagcagttcatccccctgcagctggatgaatatggctgcccccgggccaccaccgtgagaagaagagacctggagctgctgaagcaggccagcaaggcccactag

SEQ ID NO: 174009 - DNA, 1131 bp, Artificial Sequence
  Description of Artificial Sequence: Synthetic coding sequence
atgaccatcaccagagatgagtaccccagcaaccccatggtgctgcggggcatcaaccagaaggccgccttcccccagtaccagcctgtggtgatgctggagaagggctacaccatccactggaatggacctgcccccaggaccaccttcctgtacctggtgaacttcaacaagaatgactggatccgggtgggcctgtgctaccccagcaacaccagcttccaggtgaccttcggctacctgcagaggcagaatggcagcctgagcaagattgaggagtatgagcctgtgcacagcctggaggagctgcagaggaagcagagcgagaggaagttctactttgacagcagcacaggcctgctcttcctgtacctgaaggccaagagccaccgccacggccacagctactgcagcagccagggctgtgagcgggtgaagatccaggccgccacagacagcaaggacatcagcaactgcatggccaaggcctacccccagtactacaggaagcccagcgtggtgaagaggatgcctgccatgctgaccggcctgtgccagggctgcggcacccggcaggtggtgttcaccagtgacccccacaagagctacctgcctgtgcagttccagagcccagacaaggccgagacccagagaggagaccccagcgtcatctctgtgaatggaacagacttcaccttccgctctgctggggtgctgctgctggtggtggacccctgcagcgtgcccttccggctgacagagaagacagtgttccccctggctgatgtgagccgcatcgaggagtacctgaagacaggcatccccccaagaagcatcgtgctgctgagcaccagaggagagatcaagcagctgaacatcagccacctgctggtgcccctgggcctggccaagccagcccacctgtatgacaagggcagcaccatcttcctgggcttcagcggcaacttcaagcccagctggaccaagctgttcaccagccctgctggccagggcctgggcgtgctggagcagttcatccccctgcagctggatgaatatggctgcccccgggccaccaccgtgagaagaagagacctggagctgctgaagcaggccagcaaggcccactag

SEQ ID NO: 174010 - DNA, 57 bp, Artificial Sequence
  Description of Artificial Sequence: Synthetic coding sequence
atgtatgccacagacagccggggccacagccctgccttcctgcagccccagaactag

SEQ ID NO: 174011 - DNA, 570 bp, Artificial Sequence
  Description of Artificial Sequence: Synthetic coding sequence
atggaggagggcggcaacctgggcggcctcatcaagatggtgcacctgctggtgctgagcggggcctggggcatgcagatgtgggtgacctttgtgtctggcttcctgctcttccgcagcctgcccaggcacaccttcggcctggtgcagagcaagctgttccccttctacttccacatctccatgggctgtgccttcatcaacctgtgcatcctggccagccagcacgcctgggcccagctgaccttctgggaggccagccagctgtacctgctcttcctgagcctgaccctggccaccgtgaatgcccgctggctggagcccaggaccacagctgccatgtgggccctgcagacagtggagaaggagcggggcctgggcggggaggtgcccggcagccaccagggccctgacccctaccggcagctgcgggagaaggaccccaagtacagcgccctgcggcagaacttcttccgctaccacggcctgagcagcctgtgcaacctgggctgtgtgctgagcaatggcctgtgcctggccggcctggccctggagatccgcagcctgtag

SEQ ID NO: 174012 - DNA, 570 bp, Artificial Sequence; identical to SEQ ID NO: 174011
  Description of Artificial Sequence: Synthetic coding sequence

SEQ ID NO: 174013 - DNA, 570 bp, Artificial Sequence; identical to SEQ ID NO: 174011
  Description of Artificial Sequence: Synthetic coding sequence

SEQ ID NO: 174014 - DNA, 447 bp, Artificial Sequence
  Description of Artificial Sequence: Synthetic coding sequence
atgctgccccggggcctgaagatggccccccggggcaagaggctgagcagcacccccctggagatcctcttcttcctgaatggctggtacaatgccacctacttcctgctggagctgttcatcttcctgtacaagggcgtgctgctgccctaccccacagccaacctggtgctggatgtggtgatgctgctgctgtacctgggcattgaagtcatccgcctcttcttcggcaccaagggcaacctgtgccagaggaagatgcccctgagcatctctgtggccctgaccttccccagcgccatgatggccagctactacctgctgctgcagacctacgtgctgcggctggaggccatcatgaatggcatcctgctcttcttctgtggcagcgagctgctgctggaggtgctgaccctggccgccttcagctccatggaccgcatctag

SEQ ID NO: 174015 - DNA, 438 bp, Artificial Sequence
  Description of Artificial Sequence: Synthetic coding sequence
atgctgccccggggcctgaagatggccccccggggcaagaggctgagcagcacccccctggagatcctcttcttcctgaatggctggtacaatgccacctacttcctgctggagctgttcatcttcctgtacaagggcgtgctgctgccctaccccacagccaacctggtgctggatgtggtgatgctgctgctgtacctgggcattgaagtcatccgcctcttcttcggcaccaagggcaacctgtgccagaggaagatgcccctgagcatctctgtggccctgaccttccccagcgccatgatggccagctactacctgctgctgcagacctacgtgctgcggctggaggccatcatgaatggcatcctgctcttcttctgtggcagcgagctgctgctggaggtgctgaccctggccgccttcagccgcatctag

SEQ ID NO: 174016 - DNA, 942 bp, Artificial Sequence
  Description of Artificial Sequence: Synthetic coding sequence
atgaggacagattctggggcccggctggaggagggccacctgcggcccccccgggccctgccccctgtgcccagcattgatgacatccccctgagccggcccaagaagaagaagacccagcctgctgagctgcagtatgccaatgagctgggcgtggaggatgaggacatcatcacagatgagcagaccaccgtggagcagcagagcgtcttcaccgcccccaccggcatcagccagcctgtgggcaaggtgtttgtggagaagagccgccgcttccaggccgctgacagaagtgagctgatcaagaccacagaaaatattgatgtgtccatggatgtgaagcccagctggaccaccagagatgtggccctgactgtgcaccgggccttcaggatgattggcctcttcagccacggcttcctggccggctgtgctgtgtggaacatcgtggtgatctacgtgctggccggggaccagctgagcaacctgagcaacctgctgcagcagtacaagaccctggcctaccccttccagagcctgctgtacctgctgctggccctgagcaccatcagcgcctttgacagaattgactttgccaagatctctgtggccatccggaacttcctggccctggaccccacagccctggccagcttcctgtacttcaccgccctgatcctgagcctgagccagcagatgaccagtgaccgcatccacctgtacacccccagctctgtgaatggcagcctgtgggaggccggcatcgaggagcagatcctgcagccctggatcgtggtgaacctggtggtggccctgctggtgggcctgtcctggctgttcctgagctacagacctggcatggacctgtctgaggagctgatgttcagcagcgaggtggaggagtacccagacaaggagaaggagatcaaggccagcagctag

SEQ ID NO: 174017 - DNA, 1203 bp, Artificial Sequence
  Description of Artificial Sequence: Synthetic coding sequence
atgggcaagaaccctgtgcggcccccccgggccctgccccctgtgcccagccaggatgacatccccctgagccggcccaagaagaagaagcccaggaccaagaacaccccagccagcgccagcctggagggcctggcccagacagctggaagaagacccagcgagggcaatgagcccagcaccaaggagctgaaggagcaccctgaggcccctgtgcagaggcggcagaagaagacccggctgcccctggagctggagaccagcagcacccagaagaagagcagcagcagcagcctgctgagaaatgaaaatggaattgatgctgagcctgctgaggaggccgtcatccagaagcccaggaggaagaccaagaagacccagcctgctgagctgcagtatgccaatgagctgggcgtggaggatgaggacatcatcacagatgagcagaccaccgtggagcagcagagcgtcttcaccgcccccaccggcatcagccagcctgtgggcaaggtgtttgtggagaagagccgccgcttccaggccgctgacagaagtgagctgatcaagaccacagagaacattgatgtgtccatggatgtgaagcccagctggaccaccagagatgtggccctgactgtgcaccgggccttcaggatgattggcctcttcagccacggcttcctggccggctgtgctgtgtggaacatcgtggtgatctacgtgctggccggggaccagctgagcaacctgagcaacctgctgcagcagtacaagaccctggcctaccccttccagagcctgctgtacctgctgctggccctgagcaccatcagcgcctttgacagaattgactttgccaagatctctgtggccatccggaacttcctggccctggaccccacagccctggccagcttcctgtacttcaccgccctgatcctgagcctgagccagcagatgaccagtgaccgcatccacctgtacacccccagctctgtgaatggcagcctgtgggaggccggcatcgaggagcagatcctgcagccctggatcgtggtgaacctggtggtggccctgctggtgggcctgtcctggctgttcctgagctaccggcccggcatggacctgtctgaggagctgatgttcagcagcgaggtggaggagtacccagacaaggagaaggagatcaaggccagcagctag

SEQ ID NO: 174018 - DNA, 1227 bp, Artificial Sequence
  Description of Artificial Sequence: Synthetic coding sequence
atgaggacagattctggggcccggctggaggagggccacctgcggcccccccgggccctgccccctgtgcccagccaggatgacatccccctgagccggcccaagaagaagaagcccaggaccaagaacaccccagccagcgccagcctggagggcctggcccagacagctggaagaagacccagcgagggcaatgagcccagcaccaaggagctgaaggagcaccctgaggcccctgtgcagaggcggcagaagaagacccggctgcccctggagctggagaccagcagcacccagaagaagagcagcagcagcagcctgctgagaaatgaaaatggaattgatgctgagcctgctgaggaggccgtcatccagaagcccaggaggaagaccaagaagacccagcctgctgagctgcagtatgccaatgagctgggcgtggaggatgaggacatcatcacagatgagcagaccaccgtggagcagcagagcgtcttcaccgcccccaccggcatcagccagcctgtgggcaaggtgtttgtggagaagagccgccgcttccaggccgctgacagaagtgagctgatcaagaccacagagaacattgatgtgtccatggatgtgaagcccagctggaccaccagagatgtggccctgactgtgcaccgggccttcaggatgattggcctcttcagccacggcttcctggccggctgtgctgtgtggaacatcgtggtgatctacgtgctggccggggaccagctgagcaacctgagcaacctgctgcagcagtacaagaccctggcctaccccttccagagcctgctgtacctgctgctggccctgagcaccatcagcgcctttgacagaattgactttgccaagatctctgtggccatccggaacttcctggccctggaccccacagccctggccagcttcctgtacttcaccgccctgatcctgagcctgagccagcagatgaccagtgaccgcatccacctgtacacccccagctctgtgaatggcagcctgtgggaggccggcatcgaggagcagatcctgcagccctggatcgtggtgaacctggtggtggccctgctggtgggcctgtcctggctgttcctgagctaccggcccggcatggacctgtctgaggagctgatgttcagcagcgaggtggaggagtacccagacaaggagaaggagatcaaggccagcagctag

SEQ ID NO: 174019 - DNA, 1293 bp, Artificial Sequence
  Description of Artificial Sequence: Synthetic coding sequence
atgacccactgtgcctgtgcccgggaccggcgggagggctggggcgcccgctgcctgggcagaagaccacccaggcctgccaagaggaggatgggcaagaaccctgtgcggcccccccgggccctgccccctgtgcccagcattgatgacatccccctgagccggcccaagaagaagaagcccaggaccaagaacaccccagccagcgccagcctggagggcctggcccagacagctggaagaagacccagcgagggcaatgagcccagcaccaaggagctgaaggagcaccctgaggcccctgtgcagaggcggcagaagaagacccggctgcccctggagctggagaccagcagcacccagaagaagagcagcagcagcagcctgctgagaaatgaaaatggaattgatgctgagcctgctgaggaggccgtcatccagaagcccaggaggaagaccaagaagacccagcctgctgagctgcagtatgccaatgagctgggcgtggaggatgaggacatcatcacagatgagcagaccaccgtggagcagcagagcgtcttcaccgcccccaccggcatcagccagcctgtgggcaaggtgtttgtggagaagagccgccgcttccaggccgctgacagaagtgagctgatcaagaccacagagaacattgatgtgtccatggatgtgaagcccagctggaccaccagagatgtggccctgactgtgcaccgggccttcaggatgattggcctcttcagccacggcttcctggccggctgtgctgtgtggaacatcgtggtgatctacgtgctggccggggaccagctgagcaacctgagcaacctgctgcagcagtacaagaccctggcctaccccttccagagcctgctgtacctgctgctggccctgagcaccatcagcgcctttgacagaattgactttgccaagatctctgtggccatccggaacttcctggccctggaccccacagccctggccagcttcctgtacttcaccgccctgatcctgagcctgagccagcagatgaccagtgaccgcatccacctgtacacccccagctctgtgaatggcagcctgtgggaggccggcatcgaggagcagatcctgcagccctggatcgtggtgaacctggtggtggccctgctggtgggcctgtcctggctgttcctgagctaccggcccggcatggacctgtctgaggagctgatgttcagcagcgaggtggaggagtacccagacaaggagaaggagatcaaggccagcagctag

SEQ ID NO: 174020 - DNA, 1227 bp, Artificial Sequence
  Description of Artificial Sequence: Synthetic coding sequence
atgaggacagattctggggcccggctggaggagggccacctgcggcccccccgggccctgccccctgtgcccagcattgatgacatccccctgagccggcccaagaagaagaagcccaggaccaagaacaccccagccagcgccagcctggagggcctggcccagacagctggaagaagacccagcgagggcaatgagcccagcaccaaggagctgaaggagcaccctgaggcccctgtgcagaggcggcagaagaagacccggctgcccctggagctggagaccagcagcacccagaagaagagcagcagcagcagcctgctgagaaatgaaaatggaattgatgctgagcctgctgaggaggccgtcatccagaagcccaggaggaagaccaagaagacccagcctgctgagctgcagtatgccaatgagctgggcgtggaggatgaggacatcatcacagatgagcagaccaccgtggagcagcagagcgtcttcaccgcccccaccggcatcagccagcctgtgggcaaggtgtttgtggagaagagccgccgcttccaggccgctgacagaagtgagctgatcaagaccacagagaacattgatgtgtccatggatgtgaagcccagctggaccaccagagatgtggccctgactgtgcaccgggccttcaggatgattggcctcttcagccacggcttcctggccggctgtgctgtgtggaacatcgtggtgatctacgtgctggccggggaccagctgagcaacctgagcaacctgctgcagcagtacaagaccctggcctaccccttccagagcctgctgtacctgctgctggccctgagcaccatcagcgcctttgacagaattgactttgccaagatctctgtggccatccggaacttcctggccctggaccccacagccctggccagcttcctgtacttcaccgccctgatcctgagcctgagccagcagatgaccagtgaccgcatccacctgtacacccccagctctgtgaatggcagcctgtgggaggccggcatcgaggagcagatcctgcagccctggatcgtggtgaacctggtggtggccctgctggtgggcctgtcctggctgttcctgagctaccggcccggcatggacctgtctgaggagctgatgttcagcagcgaggtggaggagtacccagacaaggagaaggagatcaaggccagcagctag

SEQ ID NO: 174021 - DNA, 1101 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggcctgctggccaccagggtggaggtgcccctgctgggcatcgtggtggccgccggcctggccctgggcaccctggtgggcttcagcaccctggtggcctgcctggtgtgcaggaaggagaagaagaccaagggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcttcatccggctgcctgtgctgggctacatctacagagtgtcctctgtgtccagtgatgagatctggctgtag

SEQ ID NO: 174022 - DNA, 657 bp, Artificial Sequence
  Description of Artificial Sequence: Synthetic coding sequence
atggccctgcccccaggccctgctgccctgcggcacaccctgctgctgctgcctgccctgctgagctctgtgaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcttcatccggctgcctgtgctgggctacatctacagagtgtcctctgtgtccagtgatgagatctggctgtag

SEQ ID NO: 174023 - DNA, 1056 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggcctgctggccaccagggtggaggtgcccctgctgggcatcgtggtggccgccggcctggccctgggcaccctggtgggcttcagcaccctggtggcctgcctggtgtgcaggaaggagaagaagaccaagggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcagaagaaaccaggacaaggatgcctag

SEQ ID NO: 174024 - DNA, 969 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcttcatccggctgcctgtgctgggctacatctacagagtgtcctctgtgtccagtgatgagatctggctgtag

SEQ ID NO: 174025 - DNA, 969 bp, Artificial Sequence; identical to SEQ ID NO: 174024
  Description of Artificial Sequence: Synthetic coding sequence

SEQ ID NO: 174026 - DNA, 921 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggccccagccgccaccccagcctcatcagcagtgacagcaacaacctgaagctgaacaacgtgcggctgccccgggagaacatgagcctgcccagcaacctgcagctgaatgacctgaccccagacagccgggtgaagccagctgaccggcagatggcccagaacaacagcaggcctgagctgctggaccctgagcccggcggcctgctgaccagccagggcagaagaaaccaggacaaggatgcctag

SEQ ID NO: 174027 - DNA, 1146 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggcctgctggccaccagggtggaggtgcccctgctgggcatcgtggtggccgccggcctggccctgggcaccctggtgggcttcagcaccctggtggcctgcctggtgtgcaggaaggagaagaagaccaagggccccagccgccaccccagcctcatcagcagtgacagcaacaacctgaagctgaacaacgtgcggctgccccgggagaacatgagcctgcccagcaacctgcagctgaatgacctgaccccagacagccgggtgaagccagctgaccggcagatggcccagaacaacagcaggcctgagctgctggaccctgagcccggcggcctgctgaccagccaggcctgcctgctgcaccacggcaccccagccctgaccaacccctggctgccccaccagcaggagggcgccctgcccggcggctggagcccccaggcccacaacagcacagtgtggaagctgtag

SEQ ID NO: 174028 - DNA, 810 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagtggctgctggccaccagggtggaggtgcccctgctgggcatcgtggtggccgccggcctggccctgggcaccctggtgggcttcagcaccctggtggcctgcctggtgtgcaggaaggagaagaagaccaagggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcttcatccggctgcctgtgctgggctacatctacagagtgtcctctgtgtccagtgatgagatctggctgtag

SEQ ID NO: 174029 - DNA, 669 bp, Artificial Sequence
  Description of Artificial Sequence: Synthetic coding sequence
atgctgtggctgctcttcttcctggtgacagccatccacgccgagctgtgccagcctggagcagaaaatgccttcaaggtgcggctgagcatcagaacagccctgggggacaaggcctatgcctgggacaccaatgaggagtacctgttcaaggccatggtggccttctccatgaggaaggtgcccaaccgggaggccacagagatcagccacgtgctgctgtgcaatgtgacccagagggtgtccttctggtttgtggtgacagaccccagcaagaaccacaccctgcctgctgtggaggtgcagagcgccatccgcatgaacaagaaccgcatcaacaatgccttcttcctgaatgaccagaccctggagttcctgaagatccccagcaccctggccccacccatggaccccagcgtgcccatctggatcatcatctttggagtcatcttctgcatcatcatcgtggccatcgccctgctgatcctgagcggcatctggcagaggaggaggaagaacaaggagcccagcgaggtggatgatgctgaagataaatgtgagaacatgatcaccattgaaaatggcatccccagcgaccccctggacatgaagggcggccacatcaatgatgccttcatgacagaagatgagcggctgacccccctgtag

SEQ ID NO: 174030 - DNA, 252 bp, Artificial Sequence
  Description of Artificial Sequence: Synthetic coding sequence
atgctgaggaacctgctggccctgcggcagatcggccagaggaccatcagcacagccagcagaagacacttcaagaacaaggtgcctgagaagcagaagctgttccaggaggatgatgagatccccctgtacctgaagggcggcgtggctgatgccctgctgtaccgggccaccatgatcctgactgtgggcggcacagcctatgccatctatgagctggccgtggccagcttccccaagaagcaggagtag

SEQ ID NO: 174031 - DNA, 729 bp, Artificial Sequence
  Description of Artificial Sequence: Synthetic coding sequence
atgtactacggcctgagcaacttctaccagaaccacagaagatatgtgaagagcagagatgacagccagctgaatggagacagcagcgccctgctgaaccccagcaaagaatgtgagccctacagaagaaatgaagacaagcccatcgccccctgtggggccatcgccaacagcatgtttaatgacaccctggagctgttcctgattggaaatgacagctaccccatccccatcgccctgaagaagaagggcatcgcctggtggacagacaagaatgtgaagttcaggaaccccccaggaggagacaacctggaggagcgcttcaagggcaccaccaagcctgtgaactggctgaagcctgtgtacatgctggacagcgaccctgacaacaacggcttcatcaatgaagacttcatcgtgtggatgaggacagctgccctgcccaccttcaggaagctgtaccgcctgattgaaaggaagagtgacctgcaccccaccctgcctgctggccgctacagcctgaatgtgacctacaactaccctgtgcactactttgatggcaggaagaggatgatcctgagcaccatctcctggatgggcggcaagaaccccttcctgggcatcgcctacatcgctgtgggcagcatctccttcctgctgggcgtggtgctgctggtgatcaaccacaagtacagaaacagcagcaacacagctgacatcaccatctag

SEQ ID NO: 174032 - DNA, 978 bp, Artificial Sequence
  Description of Artificial Sequence: Synthetic coding sequence
atggccatgaactacaatgccaaggatgaggtggatggcggccccccctgtgcccctgggggcacagccaagacccggcggccagacaacacagccttcaagcagcagaggctgcctgcctggcagcccatcctgacagctggcaccgtgctgcccatcttcttcatcatcggcctcatcttcatccccatcggcatcggcatctttgtgaccagcaacaacatccgggagattgagggcaatgtgttcatgtactacggcctgagcaacttctaccagaaccaccggcgctacgtgaagagcagagatgacagccagctgaatggagacagcagcgccctgctgaaccccagcaaagaatgtgagccctacagaagaaatgaagacaagcccatcgccccctgtggggccatcgccaacagcatgtttaatgacaccctggagctgttcctgattggaaatgacagctaccccatccccatcgccctgaagaagaagggcatcgcctggtggacagacaagaatgtgaagttcagaaatcctcctggaggagacaacctggaggagcgcttcaagggcaccaccaagcctgtgaactggctgaagcctgtgtacatgctggacagcgaccctgacaacaacggcttcatcaatgaagacttcatcgtgtggatgaggacagctgccctgcccaccttcaggaagctgtaccgcctcatcgagaggaagagtgacctgcaccccaccctgcctgctggccgctacagcctgaatgtgacctacaactaccctgtgcactactttgatggcaggaagaggatgatcctgagcaccatctcctggatgggcggcaagaaccccttcctgggcatcgcctacatcgctgtgggcagcatctccttcctgctgggcgtggtgctgctggtgatcaaccacaagtacagaaacagcagcaacacagctgacatcaccatctag

SEQ ID NO: 174033 - DNA, 234 bp, Artificial Sequence
  Description of Artificial Sequence: Synthetic coding sequence
atgtactacggcctgagcaacttctaccagaaccacagaagatatgtgaagagcagagatgacagccagctgaatggagacagcagcgccctgctgaaccccagcaaagaatgtgagccctacagaagaaatgaagacaagcccatcgccccctgtggggccatcgccaacagcatgtttaatgacaccctggagctgttcctgattggaaatgacagctaccccatcccctag

SEQ ID NO: 174034 - DNA, 1038 bp, Artificial Sequence
  Description of Artificial Sequence: Synthetic coding sequence
atggccatgaactacacagccaagacccggcggccagacaacacagccttcaagcagcagaggctgcctgcctggcagcccatcctgacagctggcaccgtgctgcccatcttcttcatcatcggcctcatcttcatccccatcggcatcggcatctttgtgaccagcaacaacatccgggagattgaaattgactacacaggaacagagcccagcagcccctgcaacaagtgcctgagcccagatgtgaccccctgcttctgcaccatcaacttcaccctggagaagagctttgagggcaatgtgttcatgtactacggcctgagcaacttctaccagaaccaccggcgctacgtgaagagcagagatgacagccagctgaatggagacagcagcgccctgctgaaccccagcaaagaatgtgagccctacagaagaaatgaagacaagcccatcgccccctgtggggccatcgccaacagcatgtttaatgacaccctggagctgttcctgattggaaatgacagctaccccatccccatcgccctgaagaagaagggcatcgcctggtggacagacaagaatgtgaagttcagaaatcctcctggaggagacaacctggaggagcgcttcaagggcaccaccaagcctgtgaactggctgaagcctgtgtacatgctggacagcgaccctgacaacaacggcttcatcaatgaagacttcatcgtgtggatgaggacagctgccctgcccaccttcaggaagctgtaccgcctcatcgagaggaagagtgacctgcaccccaccctgcctgctggccgctacagcctgaatgtgacctacaactaccctgtgcactactttgatggcaggaagaggatgatcctgagcaccatctcctggatgggcggcaagaaccccttcctgggcatcgcctacatcgctgtgggcagcatctccttcctgctgggcgtggtgctgctggtgatcaaccacaagtacagaaacagcagcaacacagctgacatcaccatctag

SEQ ID NO: 174035 - DNA, 1056 bp, Artificial Sequence
  Description of Artificial Sequence: Synthetic coding sequence
atgacctggagcgccacagcccggggggcccaccagcctgacaacacagccttcacccagcagaggctgcctgcctggcagcccctgctgagcgccagcatcgccctgcccctcttcttctgtgccggcctggccttcatcggcctgggcctgggcctgtactacagcagcaatggcatcaaggagctggagtatgactacaccggggaccccggcactggaaactgcagcgtgtgtgccgccgccggccagggccgggccctgcccccaccctgcagctgtgcctggtacttcagcctgcctgagctgttccagggccctgtgtacctgtactatgagctgaccaacttctaccagaacaacagaagatatggagtgtccagagatgatgcccagctgagcggcctgcccagcgccctgcggcaccctgtgaatgaatgtgccccctaccagaggtctgctgctggcctgcccatcgccccctgtggggccatcgccaacagcctcttcaatgacagcttcagcctgtggcaccagaggcagcccggcggcccctacgtggaggtgcccctggacaggagcggcatcgcctggtggacagactaccacgtgaagttcagaaatccacccctggtgaatggcagcctggccctggccttccagggcacagcccccccacccaactggaggaggcctgtgtatgagctgagcccagaccccaacaacacaggcttcatcaaccaggactttgtggtgtggatgaggacagctgccctgcccaccttcaggaagctgtatgcccgcatccggcagggcaactacagcgctggcctgcccaggggggcctacagagtgaacatcacctacaactaccctgtgcgggccttcggcggccacaagctgctgatcttcagcagcatctcctggatgggcggcaagaaccccttcctgggcatcgcctacctggtggtgggcagcctgtgcatcctgactggatttgtgatgctggtggtgtacatccgctaccaggaccaggatgatgatgatgaggagtag

SEQ ID NO: 174036 - DNA, 1056 bp, Artificial Sequence; identical to SEQ ID NO: 174035
  Description of Artificial Sequence: Synthetic coding sequence

SEQ ID NO: 174037 - DNA, 342 bp, Artificial Sequence
  Description of Artificial Sequence: Synthetic coding sequence
atggaggagcgggcccagcactgcctgagccggctgctggacaacagcgccctgaagcagcaggagctgcccatccaccggctgtacttcaccgccaggagagtgctgtttgtgttctttgccaccggcatcttctgcctgtgcatgggcatcatcctgatcctgagcgcccggagcacccaggagattgagatcaactacacccgcatctgtgccaactgtgccaagctgagagaaaatgccagcaactttgacaaggaatgtacctgcagcatccccttctacctgagcggcaagatgatggtgggggagatccaggagacccggctgaccctgcactag

SEQ ID NO: 174038 - DNA, 207 bp, Artificial Sequence
  Description of Artificial Sequence: Synthetic coding sequence
tgactgtgcatgggcatcatcctgatcctgagcgcccggagcacccaggagattgagatcaactacacccgcatctgtgccaactgtgccaagctgcgggagaatgccagcaactttgacaaggagtgcacctgcagcatccccttctacctgagcggcaagatgatggtgggggagatccaggagacccggctgaccctgcactag

SEQ ID NO: 174039 - DNA, 1203 bp, Artificial Sequence
  Description of Artificial Sequence: Synthetic coding sequence
atggccgccaactacagcagcaccagcacccggcgggagcacgtgaaggtgaagaccagcagccagcccggcttcctggagcggctgtctgagaccagcggcggcatgtttgtgggcctgatggccttcctgctgtccttctacctgatcttcaccaatgaaggccgggccctgaagacagccaccagcctggccgagggcctgagcctggtggtgtccccagacagcatccacagcgtggccccagaaaatgaaggccgcctggtgcacatcatcggggccctgcggaccagcaagctgctgagtgaccccaactacggcgtgcacctgcctgctgtgaagctgcggcggcacgtggagatgtaccagtgggtggagacagaggagagccgggagtacacagaagatggccaggtgaagaaggagacccgctacagctacaacacagagtggaggtctgagatcatcaacagcaagaactttgaccgggagatcggccacaagaaccccagcgccatggctgtggagagcttcatggccacagccccctttgtgcagatcggccgcttcttcctgagcagcggcctgattgacaaggtggacaacttcaagagcctgagcctgagcaagctggaggacccccacgtggacatcatccggcggggggacttcttctaccacagcgagaaccccaagtacccagaggtgggggacctgcgggtgtccttctcctatgccggcctgtctggagatgatcctgacctgggccctgcccacgtggtgaccgtcatcgcccggcagagaggagaccagctggtgcccttcagcaccaagagcggggacaccctgctgctgctgcaccacggggacttctctgctgaggaggtgttccaccgggagctgcggagcaacagcatgaagacctggggcctgcgggccgccggctggatggccatgttcatgggcctgaacctgatgacccgcatcctgtacaccctggtggactggttccctgtgttccgggacctggtgaacatcggcctgaaggcctttgccttctgtgtggccaccagcctgaccctgctgactgtggccgccggctggctgttctaccggcccctgtgggccctgctgattgctggcctggccctggtgcccatcctggtggcccggaccagggtgcctgccaagaagctggagtag

SEQ ID NO: 174040 - DNA, 546 bp, Artificial Sequence
  Description of Artificial Sequence: Synthetic coding sequence
atggccagcgctggcagcggcatggaggaggtgcgggtgtctgtgctgacccccctgaagctggtgggcctggtgtgcatcttcctggccctgtgcctggacctgggcgctgtgctgagccctgcctgggtgacagctgaccaccagtactacctgagcctgtgggagagctgcaggaagccagccagcctggacatctggcactgtgagagcaccctgagcagtgactggcagatcgccaccctggccctgctgctgggcggggccgccatcatcctgattgccttcctggtgggcctcatcagcatctgtgtgggcagcagaagacgcttctacagacctgtggccgtgatgctgtttgctgctgtggtgctgcaggtgtgcagcctggtgctgtaccccatcaagttcatcgagaccgtgtccctgaagatctaccacgagttcaactggggctacggcctggcctggggcgccaccatcttctcctttggaggagccatcctgtactgcctgaaccccaagaactatgaggactactactag

SEQ ID NO: 174041 - DNA, 2745 bp, Artificial Sequence; identical to SEQ ID NO: 147366
  Description of Artificial Sequence: Synthetic coding sequence

SEQ ID NO: 174042 - DNA, 1674 bp, Artificial Sequence
  Description of Artificial Sequence: Synthetic coding sequence
atggccacagctgtgtcccggccctgtgccggccgcagccgggacatcctgtggagggtgctgggctggagaattgtggccagcatcgtgtggagcgtgctcttcctgcccatctgcaccaccgtcttcatcatcttcagcagaattgacctcttccaccccatccagtggctgagtgacagcttcagtgacctgtacagcagctatgtgatcttctacttcctgctgctgtctgtggtgatcatcatcatcagcatcttcaacgtggagttctatgctgtggtgcccagcatcccctgcagccggctggccctgattggcaagatcatccacccccagcagctgatgcacagcttcatccacgccgccatgggcatggtgatggcctggtgtgccgctgtgatcacccagggccagtacagcttcctggtggtgccctgcaccggcaccaacagctttggcagccctgctgcccagacctgcctgaatgagtaccacctgttcttcctgctgaccggggccttcatgggctacagctacagcctgctgtactttgtgaacaacatgaactacctgcccttccccatcatccagcagtacaagttcctgcgcttccgccgcagcctgctgctgctggtgaagcacagctgtgtggagagcctcttcctggtgaggaacttctgcatcctgtactacttcctgggctacatccccaaggcctggatcagcacagccatgaacctgcacattgatgagcaggtgcaccggcccctggacacagtgtctggcctgctgaacctgagcctgctgtaccacgtgtggctgtgtggggtcttcctgctgaccacctggtacgtgtcctggatcctcttcaagatctatgccacagaggcccacgtgtttcctgtgcagcccccatttgctgagggcagtgatgaatgtctgcccaaggtgctgaacagcaaccccccacccatcatcaagtacctggccctgcaggacctgatgctgctgagccagtacagccccagccggcggcaggaggtgttcagcctgagccagcccggcggccacccccacaactggacagccatcagccgggagtgcctgaacctgctgaatgagatgacagagttcagcaaccccagccccagcaccagcatctctgctgagggcaagaccatgaggcagcccagcgtcatctacagctggatccagaacaagcgggagcagatcaagaacttcctgagcaagagggtgctgatcatgtacttcttcagcaagcaccctgaggccagcatccaggccgtgttcagtgatgcccagatgcacatctgggccctggagggcctgagccacctggtggccgccagcttcacagaagatcgcttcggcgtggtgcagaccaccctgcctgccatcctgaacaccctgctgaccctgcaggaggccgtggacaagtacttcaagctgccccacgccagcagcaagccaccccgcatcagcggcagcctggtggacaccagctacaagaccctgcgctttgccttccgggccagcctgaagacagccatctaccgcatcaccaccaccttcggggagcacctgaatgctgtgcaggccagcgctgagcaccagaagaggctgcagcagttcctggagttcaaggagtag

SEQ ID NO: 174043 - DNA, 2025 bp, Artificial Sequence
  Description of Artificial Sequence: Synthetic coding sequence
atggccacagctgtgtcccggccctgtgccggccgcagccgggacatcctgtggagggtgctgggctggagaattgtggccagcatcgtgtggagcgtgctcttcctgcccatctgcaccaccgtcttcatcatcttcagcagaattgacctcttccaccccatccagtggctgagtgacagcttcagtgacctgtacagcagctatgtgatcttctacttcctgctgctgtctgtggtgatcatcatcatcagcatcttcaacgtggagttctatgctgtggtgcccagcatcccctgcagccggctggccctgattggcaagatcatccacccccagcagctgatgcacagcttcatccacgccgccatgggcatggtgatggcctggtgtgccgctgtgatcacccagggccagtacagcttcctggtggtgccctgcaccggcaccaacagctttggcagccctgctgcccagacctgcctgaatgagtaccacctgttcttcctgctgaccggggccttcatgggctacagctacagcctgctgtactttgtgaacaacatgaactacctgcccttccccatcatccagcagtacaagttcctgcgcttccgccgcagcctgctgctgctggtgaagcacagctgtgtggagagcctcttcctggtgaggaacttctgcatcctgtactacttcctgggctacatccccaaggcctggatcagcacagccatgaacctgcacattgatgagcaggtgcaccggcccctggacacagtgtctggcctgctgaacctgagcctgctgtaccacgtgtggctgtgtggggtcttcctgctgaccacctggtacgtgtcctggatcctcttcaagatctatgccacagaggcccacgtgtttcctgtgcagcccccatttgctgagggcagtgatgaatgtctgcccaaggtgctgaacagcaaccccccacccatcatcaagtacctggccctgcaggacctgatgctgctgagccagtacagccccagccggcggcaggaggtgttcagcctgagccagcccggcggccacccccacaactggacagccatcagccgggagtgcctgaacctgctgaatggcatgacccagaagctgatcctgtaccaggaggccgccgccaccaacggccgggtgagcagcagctaccctgtggagcccaagaagctgaacagccctgaggagacagccttccagacccccaagagcagccagatgccccggcccagcgtgccccccctggtgaagaccagcctcttcagcagcaagctgagcaccccagatgtggtgagccccttcggcaccccatttggcagctctgtgatgaacaggatggccggcatctttgatgtgaacacctgctacggcagcccccagagcccccagctgatcagaagaggcccccggctgtggaccagcgccagtgaccagcagatgacagagttcagcaaccccagccccagcaccagcatctctgctgagggcaagaccatgaggcagcccagcgtcatctacagctggatccagaacaagcgggagcagatcaagaacttcctgagcaagagggtgctgatcatgtacttcttcagcaagcaccctgaggccagcatccaggccgtgttcagtgatgcccagatgcacatctgggccctggagggcctgagccacctggtggccgccagcttcacagaggacagatttggagtggtgcagaccaccctgcctgccatcctgaacaccctgctgaccctgcaggaggccgtggacaagtacttcaagctgccccacgccagcagcaagcccccacgcatcagcggcagcctggtggacaccagctacaagaccctgcgctttgccttccgggccagcctgaagacagccatctaccgcatcaccaccacctttggagagcacctgaatgctgtgcaggccagcgctgagcaccagaagaggctgcagcagttcctggagttcaaggagtag

SEQ ID NO: 174044 - DNA, 1020 bp, Artificial Sequence
  Description of Artificial Sequence: Synthetic coding sequence
atgctgctgagccagtacagccccagccggcggcaggaggtgttcagcctgagccagcccggcggccacccccacaactggacagccatcagcagagaatgtctgaacctgctgaatggcatgacccagaagctgatcctgtaccaggaggccgccgccaccaacggccgggtgagcagcagctaccctgtggagcccaagaagctgaacagccctgaggagacagccttccagacccccaagagcagccagatgccccggcccagcgtgccccccctggtgaagaccagcctcttcagcagcaagctgagcaccccagatgtggtgagccccttcggcacccccttcggcagctctgtgatgaacaggatggccggcatctttgatgtgaacacctgctacggcagcccccagagcccccagctgatccggcggggcccccggctgtggaccagcgccagtgaccagcagatgacagagttcagcaaccccagccccagcaccagcatctctgctgagggcaagaccatgaggcagcccagcgtcatctacagctggatccagaacaagcgggagcagatcaagaacttcctgagcaagagggtgctgatcatgtacttcttcagcaagcaccctgaggccagcatccaggccgtgttcagtgatgcccagatgcacatctgggccctggagggcctgagccacctggtggccgccagcttcacagaagatcgcttcggcgtggtgcagaccaccctgcctgccatcctgaacaccctgctgaccctgcaggaggccgtggacaagtacttcaagctgccccacgccagcagcaagccaccccgcatcagcggcagcctggtggacaccagctacaagaccctgcgctttgccttccgggccagcctgaagacagccatctaccgcatcaccaccaccttcggggagcacctgaatgctgtgcaggccagcgctgagcaccagaagaggctgcagcagttcctggagttcaaggagtag

SEQ ID NO: 174045 - DNA, 1629 bp, Artificial Sequence
  Description of Artificial Sequence: Synthetic coding sequence
atggccacagctgtgtcccggccctgtgccggccgcagccgggacatcctgtggagggtgctgggctggagaattgtggccagcatcgtgtggagcgtgctcttcctgcccatctgcaccaccgtcttcatcatcttcagcagaattgacctcttccaccccatccagtggctgagtgacagcttcagtgacctgtacagcagctatgtgatcttctacttcctgctgctgtctgtggtgatcatcatcatcagcatcttcaacgtggagttctatgctgtggtgcccagcatcccctgcagccggctggccctgattggcaagatcatccacccccagcagctgatgcacagcttcatccacgccgccatgggcatggtgatggcctggtgtgccgctgtgatcacccagggccagtacagcttcctggtggtgccctgcaccggcaccaacagctttggcagccctgctgcccagacctgcctgaatgagtaccacctgttcttcctgctgaccggggccttcatgggctacagctacagcctgctgtactttgtgaacaacatgaactacctgcccttccccatcatccagcagtacaagttcctgcgcttccgccgcagcctgctgctgctggtgaagcacagctgtgtggagagcctcttcctggtgaggaacttctgcatcctgtactacttcctgggctacatccccaaggcctggatcagcacagccatgaacctgcacattgatgagcaggtgcaccggcccctggacacagtgtctggcctgctgaacctgagcctgctgtaccacgtgtggctgtgtggggtcttcctgctgaccacctggtacgtgtcctggatcctcttcaagatctatgccacagaggcccacgtgtttcctgtgcagcccccatttgctgagggcagtgatgaatgtctgcccaaggtgctgaacagcaaccccccacccatcatcaagtacctggccctgcaggacctgatgctgctgagccagtacagccccagccggcggcaggaggtgttcagcctgagccagcccggcggccacccccacaactggacagccatcagccgggagtgcctgaacctgctgaatggcatgacccagaagctgatcctgtaccaggaggccgccgccaccaacggccgggtgagcagcagctaccctgtggagcccaagaagctgaacagccctgaggagacagccttccagacccccaagagcagccagatgccccggcccagcgtgccccccctggtgaagaccagcctcttcagcagcaagctgagcaccccagatgtggtgagccccttcggcaccccatttggcagctctgtgatgaacaggatggccggcatctttgatgtgaacacctgctacggcagcccccagagcccccagctgatcagaagaggcccccggctgtggaccagcgccagtgaccagcagatgacagagttcagcaaccccagccccagcaccagcatctctgctgaggccccccggggcctgcacagcggctgcttcttccgctgccccaatgcctacctgggcatcagaagatctgtggccctgagcagcagcatcatctaccggggctag

SEQ ID NO: 174046 - DNA, 1332 bp, Artificial Sequence
  Description of Artificial Sequence: Synthetic coding sequence
atgaggctgaccaggaagaggctgtgcagcttcctgattgccctgtactgcctcttcagcctgtatgctgcctaccacgtgttctttggaagaagacggcaggccccagctggcagcccccggggcctgaggaaaggagctgccccagcccgggagcggcggggccgggagcagagcaccctggagagcgaggagtggaacccctgggagggagatgagaagaatgagcagcagcaccgcttcaagaccagcctgcagatcctggacaagagcaccaagggcaagacagacctgtctgtgcagatctggggcaaggccgccatcggcctgtacctgtgggagcacatctttgagggcctgctggaccccagtgatgtgacagcccagtggagggagggcaagagcatcgtgggccgcacccagtacagcttcatcaccggccctgctgtgattcctggctacttctctgtggatgtgaacaacgtggtgctgatcctgaatggccgggagaaggccaagatcttctacgccacccagtggctgctgtatgcccagaacctggtgcagatccagaagctgcagcacctggccgtggtgctgctgggcaatgagcactgtgacaatgagtggatcaaccccttcctgaagagaaatggaggctttgtggagctgctcttcatcatctatgacagcccctggatcaatgatgtggatgtgttccagtggcccctgggcgtggccacctacagaaacttccctgtggtggaggcctcctggagcatgctgcatgatgagcggccctacctgtgcaacttcctgggcaccatctatgagaacagcagccggcaggccctgatgaacatcctgaagaaggatggaaatgacaagctgtgctgggtgtctgcccgggagcactggcagccccaggagaccaatgaaagcctgaagaactaccaggatgccctgctgcagagcgacctgaccctgtgccctgtgggcgtgaacacagagtgctaccgcatctatgaggcctgcagctatggcagcatccctgtggtggaggatgtgatgacagctggcaactgtggcaacacctctgtgcaccacggggcccccctgcagctgctgaagtccatgggcgcccccttcatcttcatcaagaactggaaggagctgcctgctgtgctggagaaggagaagaccatcatcctgcaggagaagattgaaagaaggaagatgctgctgcagtggtaccagcacttcaagacagagctgaagatgaagttcaccaacatcctggagagcagcttcctgatgaacaacaagagctag

SEQ ID NO: 174047 - DNA, 774 bp, Artificial Sequence
  Description of Artificial Sequence: Synthetic coding sequence
atggctgctgatggagtggatgagaggagccccctgctgagcgccagccacagcggaaatgtgacccccacagccccaccctacctgcaggagagcagccccagggctgagctgcccccaccctacacagccatcgccagcccagatgccagcggcatccctgtgatcaactgccgggtgtgccagagcctcatcaacctggatggcaagctgcaccagcacgtggtgaagtgcaccgtgtgcaatgaggccacccccatcaagaacccccccaccgggaagaagtatgtgcgctgcccctgcaactgcctgctgatctgcaaggacaccagccgccgcatcggctgcccccggcccaactgccgccgcatcatcaacctgggccctgtgatgctgatcagcgaggagcagcctgcccagcctgccctgcccatccagcctgagggcaccagggtggtgtgtggccactgcggcaacaccttcctgtggatggagctgcgcttcaacaccctggccaagtgcccccactgcaagaagatcagctctgtgggcagcgccctgccccggcggcgctgctgtgcctacatcaccatcggcatgatctgcatcttcatcggcgtgggcctgactgtgggcaccccagactttgcccggcgcttccgggccacctacgtgtcctgggccatcgcctacctgctgggcctcatctgcctgatccgggcctgctactggggcgccatccgggtgtcctacccagagcacagctttgcctag

SEQ ID NO: 174048 - DNA, 2745 bp, Artificial Sequence
  Description of Artificial Sequence: Synthetic coding sequence
atgagcctgagccactggccctacttccggctggtgctgaacttccggccccaggtgatctgcctgccccagccccccaaggtgctgggctaccgcctggagcccccccacctgaccctggcctgcaccctggagggcatgtacaacatcatcgaggagatcctggagcgggacatcaatggcaccctgctgagccaggccacctgtgagctgtgtgatggaaatgaaaacagcttcatggtggtgaatgccctgggggacagatgtgtgcgctgtgagcccacctttgtgaacaccagccgcagctgtgcctgcagcgagcccaacatcctgaccggcggcctgtgcttcagcagcacaggcaacttccccctgcggcgcatctctgctgcccgctatggagaggtgggcatgagcctgaccagcgagtggtttgccaagtacctgcagagcagcgctgctgcctgctgggtgtatgccaacctgaccagctgccaggccctgggcaacatgtgtgtgatgaacatgaacagctatgactttgccacctttgatgcctgtggcctcttccagttcatctttgaaaatacagctggcctgagcacagtgcacagcatctccttctggaggcagaacctgccctggctgttctacggggaccagctgggcctggccccccaggtgctgagcagcaccagcctgcccaccaacttctccttcaagggggagaaccagaacaccaagctgaagtttgtggccgccagctatgacatccggggcaacttcctgaagtggcagaccctggagggcggcgtgctgcagctgtgcccagacacagagacccggctgaatgctgcctacagctttggcaccacctaccagcagaactgtgagatccccatcagcaagatcctgattgacttccccacccccatcttctatgatgtgtacctggagtacacagatgagaaccagcaccagtacatcctggccgtgcctgtgctgaacctgaacctgcagcacaacaagatctttgtgaaccaggacagcaacagcggcaagtggctgctgacccggcgcatcttcctggtggatgctgtgtctggaagagaaaatgacctgggcacccagcccagggtcatccgggtggccacccagatcagcctgtctgtgcacctggtgcccaacaccatcaatggaaacatctacccacccctcatcaccatcgcctacagcgacatcgacatcaaggatgccaacagccagagcgtgaaggtgtccttctctgtgacctatgagatggaccacggggaggcccacgtgcagacagacatcgccctgggcgtgctgggcggcctggccgtgctggccagcctgctgaagacagctggctggaagagaagaattggcagccccatgattgacctgcagacagtggtgaagttcctggtgtactatgctggggacctggccaacgtgttcttcatcatcaccgtgggcaccggcctgtactggctgatcttcttcaaggcccagaagtctgtgtctgtgctgctgcccatgcccatccaggaggagagatttgtgacctacgtgggctgtgcctttgccctgaaggccctgcagttcctgcacaagctgatcagccagatcaccattgatgtgttcttcatcgactgggagcggcccaagggcaaggtgctgaaggctgtggagggggagggcggcgtgcgcagcgccaccgtgcctgtgtccatctggaggacctactttgtggccaatgagtggaatgagatccagacagtgaggaagatcaacagcctcttccaggtgctgactgtgctcttcttcctggaggtggtgggcttcaagaacctggccctgatggacagcagcagcagcctgagcagaaatcctccttcctacatcgccccctacagctgcatcctgcgctatgctgtgtctgctgccctgtggctggccatcggcatcatccaggtggtgttctttgctgtgttctatgagcgcttcatcgaggacaagatccggcagtttgtggacctgtgcagcatgagcaacatctctgtgttcctgctgagccacaagtgcttcggctactacatccacggccgctctgtgcacggccatgctgacaccaacatggaggagatgaacatgaacctgaagcgggaggccgagaacctgtgcagccagaggggcctggtgcccaacacagatggccagacctttgagatcgccatcagcaaccagatgaggcagcactatgaccgcatccacgagaccctcatcaggaagaatggacctgcccggctgctgagcagcagcgccagcacctttgagcagagcatcaaggcctaccacatgatgaacaagttcctgggcagcttcatcgaccacgtgcacaaggagatggactacttcatcaaggacaagctgctgctggagcgcatcctgggcatggagttcatggagcccatggagaagagcatcttctacaatgatgagggctacagcttcagctctgtgctgtactatggaaatgaggccaccctgctgatctttgacctgctcttcttctgtgtggtggacctggcctgccagaacttcatcctggccagcttcctgacctacctgcagcaggagatcttccgctacatccggaacacagtgggccagaagaacctggccagcaagaccctggtggaccagcgcttcctgatctag

SEQ ID NO: 174049 - DNA, 2988 bp, Artificial Sequence
  Description of Artificial Sequence: Synthetic coding sequence
atggccacccggggcggggccggcgtggccatggctgtgtggagcctgctgagcgcccgggctgtgacagccttcctgctgctcttcctgccccgcttcctgcaggcccagaccttctccttccccttccagcagcctgagaagtgtgacaacaaccagtactttgacatcagcgccctgagctgtgtgccctgtggggccaaccagaggcaggatgcccggggcaccagctgtgtgtgcctgcccggcttccagatgatcagcaacaacggcggccctgccatcatctgcaagaagtgcccagagaacatgaagggcgtgacagaagatggctggaactgcatcagctgccccagcgacctgacagctgagggcaagtgccactgccccatcggccacatcctggtggagcgggacatcaatggcaccctgctgagccaggccacctgtgagctgtgtgatggaaatgaaaattccttcatggtggtgaatgccctgggggacagatgtgtgcgctgtgagcccacctttgtgaacaccagccgcagctgtgcctgcagcgagcccaacatcctgactggaggcctgtgcttcagcagcactggaaacttccccctgcggcgcatctctgctgcccgctacggggaggtgggcatgagcctgaccagcgagtggtttgccaagtacctgcagagcagcgctgctgcctgctgggtgtatgccaacctgaccagctgccaggccctgggcaacatgtgtgtgatgaacatgaacagctatgactttgccacctttgatgcctgtggcctcttccagttcatctttgagaacacagctggcctgagcacagtgcacagcatctccttctggaggcagaacctgccctggctgttctatggagaccagctgggcctggccccccaggtgctgagcagcaccagcctgcccaccaacttctccttcaagggggagaaccagaacaccaagctgaagtttgtggccgccagctatgacatccggggcaacttcctgaagtggcagaccctggagggcggcgtgctgcagctgtgcccagacacagagacccggctgaatgctgcctacagctttggcaccacctaccagcagaactgtgagatccccatcagcaagatcctgattgacttccccacccccatcttctatgatgtgtacctggagtacacagatgagaaccagcaccagtacatcctggccgtgcctgtgctgaacctgaacctgcagcacaacaagatctttgtgaaccaggacagcaacagcggcaagtggctgctgacccggcgcatcttcctggtggatgctgtgtctggccgggagaatgacctgggcacccagcccagggtcatccgggtggccacccagatcagcctgtctgtgcacctggtgcccaacaccatcaatggaaacatctacccacccctcatcaccatcgcctacagcgacatcgacatcaaggatgccaacagccagagcgtgaaggtgtccttctctgtgacctatgagatggaccatggagaggcccacgtgcagacagacatcgccctgggcgtgctgggcggcctggccgtgctggccagcctgctgaagacagctggctggaagaggcgcatcggcagccccatgattgacctgcagacagtggtgaagttcctggtgtactatgctggggacctggccaacgtgttcttcatcatcaccgtgggcaccggcctgtactggctgatcttcttcaaggcccagaagtctgtgtctgtgctgctgcccatgcccatccaggaggagagatttgtgacctacgtgggctgtgcctttgccctgaaggccctgcagttcctgcacaagctgatcagccagatcaccattgatgtgttcttcatcgactgggagcggcccaagggcaaggtgctgaaggctgtggagggggagggcggcgtgcgcagcgccaccgtgcctgtgtccatctggaggacctactttgtggccaatgagtggaatgagatccagacagtgaggaagatcaacagcctcttccaggtgctgactgtgctcttcttcctggaggtggtgggcttcaagaacctggccctgatggacagcagcagcagcctgagcaggaacccccccagctacatcgccccctacagctgcatcctgcgctatgctgtgtctgctgccctgtggctggccatcggcatcatccaggtggtgttctttgctgtgttctatgagcgcttcatcgaggacaagatccggcagtttgtggacctgtgcagcatgagcaacatcagcgtcttcctgctgagccacaagtgcttcggctactacatccacggccgctctgtgcacggccacgccgacaccaacatggaggagatgaacatgaacctgaagcgggaggccgagaacctgtgcagccagaggggcctggtgcccaacacagatggccagacctttgaaattgccatcagcaaccagatgaggcagcactatgaccgcatccacgagaccctcatcaggaagaatggacctgcccggctgctgagcagcagcgccagcacctttgagcagagcatcaaggcctaccacatgatgaacaagttcctgggcagcttcatcgaccacgtgcacaaggagatggactacttcatcaaggacaagctgctgctggagcgcatcctgggcatggagttcatggagcccatggagaagagcatcttctacaatgatgagggctacagcttcagctctgtgctgtactatggaaatgaggccaccctgctgatctttgacctgctcttcttctgtgtggtggacctggcctgccagaacttcatcctggccagcttcctgacctacctgcagcaggagatcttccgctacatccggaacacagtgggccagaagaacctggccagcaagaccctggtggaccagcgcttcctgatctag

SEQ ID NO: 174050 - DNA, 783 bp, Artificial Sequence
  Description of Artificial Sequence: Synthetic coding sequence
atgctgttcctggccctgggcagcccctgggccgtggagctgcccctgtgtggcagaagaacagccctgtgtgccgctgctgccctgcggggcccccgggcctctgtgtcccgggccagcagcagcagcggccccagcggccctgtggccggctggagcacaggccccagcggggccgcccggctgctgcggcggcccggccgggcccagatccctgtgtactgggagggctacgtgcgcttcctgaacacccccagcgacaagtcagaagatggccgcctcatctacacaggcaacatggcccgggctgtgtttggagtgaagtgcttctcctacagcaccagcctgattggcctgaccttcctgccctacatcttcacccagaacaatgccatcagcgagagcgtgcccctgcccatccagatcatcttctacggcatcatgggcagcttcaccgtcatcacccctgtgctgctgcacttcatcaccaagggctacgtgatccggctgtaccacgaggccaccacagacacctacaaggccatcacctacaatgccatgctggccgagaccagcacagtgttccaccagaatgatgtgaagatcccagatgccaagcacgtgttcaccaccttctacgccaagaccaagagcctgctggtgaaccctgtgctcttccccaaccgggaggactacatccacctgatgggctatgacaaggaggagttcatcctgtacatggaggagaccagcgaggagaagaggcacaaggatgacaagtag

SEQ ID NO: 174051 - DNA, 324 bp, Artificial Sequence
  Description of Artificial Sequence: Synthetic coding sequence
atgctgttcctggccctgggcagcccctgggccgtggagctgcccctgtgtggcagaagaacagccctgtgtgccgctgctgccctgcggggcccccgggcctctgtgtcccgggccagcagcagcagcggccccagcggccctgtggccggctggagcacaggccccagcggggccgcccggctgctgcggcggcccggccgggcccagatccctgtgtactgggagggctacgtgcgcttcctgaacacccccagcgacaagtcagaagatggccgcctcatctacacaggcaacatggcccgggctgtgtttgggaagtag

SEQ ID NO: 174052 - DNA, 918 bp, Artificial Sequence
  Description of Artificial Sequence: Synthetic coding sequence
atggagctgcactacctggccaagaagagcaaccaggccgacctgtgtgatgcccgggactggagcagccggggcctgcccggggaccaggccgacacagctgccacccgggccgccctgtgctgccagaagcagtgtgccagcaccccccgggccacagagatggagggcagcaagctgagcagcagccctgccagccccagcagcagcctgcagaacagcaccctgcagccagatgccttccccccaggcctgctgcacagcggcaacaaccagatcacagctgagaggaaggtgtgcaactgctgcagccaggagctggagaccagcttcacctacgtggacaagaacatcaacctggagcagaggaacagaagcagccccagcgccaagggccacaaccaccctggagagctgggctgggagaaccccaatgagtggagccaggaggccgccatcagcctcatcagcgaggaggaggatgacaccagcagcgaggccaccagcagcggcaagagcattgattatggcttcatcagcgccatcctcttcctggtgacaggcatcctgctggtgatcatctcctacatcgtgccccgggaggtgacagtggaccccaacacagtggccgcccgggagatggagcggctggagaaggagagcgcccggctgggcgcccacctggacagatgtgtgattgctggcctgtgcctgctgaccctgggcggcgtcatcctgagctgcctgctgatgatgtccatgtggaagggggagctgtacagaagaaacagatttgccagcagcaaggagagcgccaagctgtatggcagcttcaacttcaggatgaagaccagcaccaatgaaaacaccctggagctgagcctggtggaggaggatgccctggccgtgcagagctag

SEQ ID NO: 174053 - DNA, 951 bp, Artificial Sequence
  Description of Artificial Sequence: Synthetic coding sequence
atgtctggggacacctgcctgtgcccagccagcggggccaagcccaagctgagcggcttcaagggcggcggcctgggcaacaagtatgtgcagctgaatgtgggcggcagcctgtactacaccaccgtgcgggccctgaccaggcatgacaccatgctgaaggccatgttcagcggccgcatggaggtgctgacagacaaggagggctggatcctgattgacagatgtgggaagcacttcggcaccatcctgaactacctgagagatgacaccatcaccctgccccagaaccggcaggagatcaaggagctgatggccgaggccaagtactacctgatccagggcctggtgaacatgtgccagagcgccctgcaggacaagaaggacagctaccagcctgtgtgcaacatccccatcatcaccagcctgaaggaggaggagcggctcatcgagagcagcaccaagcctgtggtgaagctgctgtacaacagaagcaacaacaagtacagctacaccagcaacagtgatgaccacctgctgaagaacatcgagctgtttgacaagctgagcctgcgcttcaacggccgggtgctcttcatcaaggatgtgattggagatgagatctgctgctggagcttctacggccagggcaggaagctggccgaggtgtgctgcaccagcatcgtgtatgccacagagaagaagcagaccaaggtggagttccctgaggcccgcatctatgaggagaccctgaatgtgctgctgtatgagaccccccgggtgcctgacaacagcctgctggaggccaccagccgcagccgcagccaggccagccccagtgaagatgaggagacctttgagctgcgggacagagtgcggcgcatccacgtgaagcgctacagcacctatgatgaccggcagctgggccaccagagcacccaccgggactag

SEQ ID NO: 174054 - DNA, 210 bp, Artificial Sequence
  Description of Artificial Sequence: Synthetic coding sequence
atgaccaccctcatccccatcctgagcaccttcctgtttgaggacttcagcaaggccagcggcttcaagggccagaggcctgagaccctgcacgagcggctgaccctggtgtctgtgtatgccccctacctgctgatccccttcatcctgctgatcttcatgctgcggagcccctactacaagtatgaggagaagaggaagaagaagtag

SEQ ID NO: 174055 - DNA, 1125 bp, Artificial Sequence
  Description of Artificial Sequence: Synthetic coding sequence
atggtgctgtgggagagcccccggcagtgcagctcctggaccctgtgtgagggcttctgctggctgctgctgctgcctgtgatgctgctgattgtggcccggcctgtgaagctggccgccttccccaccagcctgagtgactgccagacccccaccggctggaactgcagcggctatgatgacagagaaaatgacctcttcctgtgtgacaccaacacctgcaagtttgatggagaatgtctgagaattggagacacagtgacctgtgtgtgccagttcaagtgcaacaatgactatgtgcctgtgtgtggcagcaatggagagagctaccagaatgaatgctacctgcggcaggccgcctgcaagcagcagagcgagatcctggtggtgtctgagggcagctgtgccacagatgctggcagcggcagcggagatggagtgcatgagggcagcggggagaccagccagaaggagaccagcacctgtgacatctgccagtttggagcagaatgtgatgaagatgctgaagatgtgtggtgtgtgtgcaacatcgactgcagccagaccaacttcaaccccctgtgtgccagtgatggcaagagctatgacaatgcctgccagatcaaggaggccagctgccagaagcaggagaagattgaggtgatgagcctgggccgctgccaggacaacaccaccaccaccaccaagtcagaagatggccactacgccaggacagattatgcagaaaatgccaacaagctggaggagagcgcccgggagcaccacatcccctgcccagagcactacaacggcttctgcatgcatggaaaatgtgagcacagcatcaacatgcaggagcccagctgccgctgtgatgctggctacacaggccagcactgtgagaagaaggactacagcgtgctgtatgtggtgcccggccctgtgcgcttccagtatgtgctgattgctgctgtgattggcaccatccagattgctgtgatctgtgtggtggtgctgtgcatcaccaggaagtgccccaggagcaaccgcatccaccggcagaagcagaacacaggccactacagcagtgacaacaccacccgggccagcaccaggctcatctag

SEQ ID NO: 174056 - DNA, 528 bp, Artificial Sequence
  Description of Artificial Sequence: Synthetic coding sequence
atggtgctgtgggagagcccccggcagtgcagctcctggaccctgtgtgagggcttctgctggctgctgctgctgcctgtgatgctgctgattgtggcccggcctgtgaagctggccgccttccccaccagcctgagtgactgccagacccccaccggctggaactgcagcggctatgatgacagagaaaatgacctcttcctgtgtgacaccaacacctgcaagtttgatggagaatgtctgagaattggagacacagtgacctgtgtgtgccagttcaagtgcaacaatgactatgtgcctgtgtgtggcagcaatggagagagctaccagaatgaatgctacctgcggcaggccgcctgcaagcagcagagcgagatcctggtggtgtctgagggcagctgtgccacagatgctggcagcggcagcggagatggcggccgcagctgcctcttcacctacctgaagatctactggtggatcctgctgtgcatcttcacctacgtgtgcagcatcagtgacatctag

SEQ ID NO: 174057 - DNA, 2427 bp, Artificial Sequence
  Description of Artificial Sequence: Synthetic coding sequence
atggccgagctgctggccagcgctggcagcgcctgctcctgggacttcccccgggccccacccagcttccccccacctgctgccagcagaggaggcctgggcggcaccaggagcttccggccccacagaggagctgagagcccccggcccggccgggacagagatggagtgcgggtgcccatggccagcagccgctgcccagccccccggggctgccgctgcctgcccggggccagcctggcctggctgggcaccgtgctgctgctgctggccgactgggtgctgctgaggacagccctgccccgcatcttcagcctgctggtgcccacagccctgcccctgctgcgggtgtgggccgtgggcctgagccgctgggccgtgctgtggctgggcgcctgtggggtgctgcgggccaccgtgggcagcaagtcagaaaatgctggggcccagggctggctggccgccctgaagcccctggccgccgccctgggcctggccctgcccggcctggccctcttccgggagctgatctcctggggcgcccctggcagcgctgacagcacccggctgctgcactggggcagccaccccacagcctttgtggtgtcctatgctgctgccctgcctgctgctgccctgtggcacaagctgggcagcctgtgggtgcctgggggccagggcggcagcggcaaccctgtgcggcggctgctgggctgcctgggcagcgagacccggcggctgagcctcttcctggtgctggtggtgctgagcagcctgggggagatggccatccccttcttcaccggccgcctgacagactggatcctgcaggacggcagcgctgacaccttcaccaggaacctgaccctgatgagcatcctgaccatcgccagcgctgtgctggagtttgtgggagatggcatctacaacaacaccatgggccacgtgcacagccacctgcagggcgaggtgtttggagctgtgctgcggcaggagacagagttcttccagcagaaccagacaggcaacatcatgagccgggtgacagaggacaccagcaccctgagtgacagcctgtctgagaacctgagcctcttcctgtggtacctggtgcggggcctgtgcctgctgggcatcatgctgtggggctctgtgtccctgaccatggtgaccctcatcaccctgcccctgctcttcctgctgcccaagaaggtgggcaagtggtaccagctgctggaggtgcaggtgcgggagagcctggccaagagcagccaggtggccatcgaggccctgagcgccatgcccaccgtgcgcagctttgccaatgaggagggggaggcccagaagttccgggagaagctgcaggagatcaagaccctgaaccagaaggaggccgtggcctatgctgtgaacagctggaccaccagcatcagcggcatgctgctgaaggtgggcatcctgtacatcggcggccagctggtgaccagcggggctgtgagcagcggcaacctggtgacctttgtgctgtaccagatgcagttcacccaggccgtggaggtgctgctgagcatctacccccgggtgcagaaggctgtgggcagcagcgagaagatctttgagtacctggacaggaccccccgctgccccccatctggcctgctgacccccctgcacctggagggcctggtgcagttccaggatgtgtcctttgcctaccccaacagaccagatgtgctggtgctgcagggcctgaccttcaccctgcggcctggagaggtgacagccctggtgggccccaacggcagcggcaagagcacagtggccgccctgctgcagaacctgtaccagcccaccggcggccagctgctgctggatggcaagcccctgccccagtatgagcaccgctacctgcaccggcaggtggccgctgtgggccaggagccccaggtgtttggccgcagcctgcaggagaacatcgcctacggcctgacccagaagcccaccatggaggagatcacagctgctgctgtgaagagcggggcccacagcttcatcagcggcctgccccagggctatgacacagaggtggatgaagctggcagccagctgagcggcggccagaggcaggccgtggccctggcccgggccctgatcaggaagccctgtgtgctgatcctggatgatgccaccagcgccctggatgccaacagccagctgcaggtggagcagctgctgtatgagagccctgagcgctacagccgctctgtgctgctgatcacccagcacctgagcctggtggagcaggccgaccacatcctcttcctggagggcggggccatccgggagggcggcacccaccagcagctgatggagaagaagggctgctactgggccatggtgcaggccccagcagatgcccctgagtag

SEQ ID NO: 174058 - DNA, 2427 bp, Artificial Sequence; identical to SEQ ID NO: 174057
  Description of Artificial Sequence: Synthetic coding sequence

SEQ ID NO: 174059 - DNA, 2427 bp, Artificial Sequence; identical to SEQ ID NO: 174057
  Description of Artificial Sequence: Synthetic coding sequence

SEQ ID NO: 174060 - DNA, 2427 bp, Artificial Sequence; identical to SEQ ID NO: 174057
  Description of Artificial Sequence: Synthetic coding sequence

SEQ ID NO: 174061 - DNA, 2427 bp, Artificial Sequence; identical to SEQ ID NO: 174057
  Description of Artificial Sequence: Synthetic coding sequence

SEQ ID NO: 174062 - DNA, 1644 bp, Artificial Sequence
  Description of Artificial Sequence: Synthetic coding sequence
atggccatccccttcttcaccggccgcctgacagactggatcctgcaggacggcagcgctgacaccttcaccaggaacctgaccctgatgagcatcctgaccatcgccagcgctgtgctggagtttgtgggagatggcatctacaacaacaccatgggccacgtgcacagccacctgcagggcgaggtgtttggagctgtgctgcggcaggagacagagttcttccagcagaaccagacaggcaacatcatgagccgggtgacagaggacaccagcaccctgagtgacagcctgtctgagaacctgagcctcttcctgtggtacctggtgcggggcctgtgcctgctgggcatcatgctgtggggctctgtgtccctgaccatggtgaccctcatcaccctgcccctgctcttcctgctgcccaagaaggtgggcaagtggtaccagctgctggaggtgcaggtgcgggagagcctggccaagagcagccaggtggccatcgaggccctgagcgccatgcccaccgtgcgcagctttgccaatgaggagggggaggcccagaagttccgggagaagctgcaggagatcaagaccctgaaccagaaggaggccgtggcctatgctgtgaacagctggaccaccagcatcagcggcatgctgctgaaggtgggcatcctgtacatcggcggccagctggtgaccagcggggctgtgagcagcggcaacctggtgacctttgtgctgtaccagatgcagttcacccaggccgtggaggtgctgctgagcatctacccccgggtgcagaaggctgtgggcagcagcgagaagatctttgagtacctggacaggaccccccgctgcccccccagcggcctgctgacccccctgcacctggagggcctggtgcagttccaggatgtgtcctttgcctaccccaacagaccagatgtgctggtgctgcagggcctgaccttcaccctgcggcctggagaggtgacagccctggtgggccccaatggaagtggcaagagcacagtggccgccctgctgcagaacctgtaccagcccactggaggccagctgctgctggatggcaagcccctgccccagtatgagcaccgctacctgcaccggcaggtggccgctgtgggccaggagccccaggtgtttggccgcagcctgcaggagaacatcgcctacggcctgacccagaagcccaccatggaggagatcacagctgctgctgtgaagagcggggcccacagcttcatcagcggcctgccccagggctatgacacagaggtggatgaggccggcagccagctgagcggcggccagaggcaggccgtggccctggcccgggccctgatcaggaagccctgtgtgctgatcctggatgatgccaccagcgccctggatgccaacagccagctgcaggtggagcagctgctgtatgagagccctgagcgctacagccgctctgtgctgctgatcacccagcacctgagcctggtggagcaggccgaccacatcctcttcctggagggcggggccatccgggagggcggcacccaccagcagctgatggagaagaagggctgctactgggccatggtgcaggccccagcagatgcccctgagtag

SEQ ID NO: 174063 - DNA, 2427 bp, Artificial Sequence
  Description of Artificial Sequence: Synthetic coding sequence
atggccgagctgctggccagcgctggcagcgcctgctcctgggacttcccccgggccccacccagcttccccccacctgctgccagcagaggaggcctgggcggcaccaggagcttccggccccacagaggagctgagagcccccggcccggccgggacagagatggagtgcgggtgcccatggccagcagccgctgcccagccccccggggctgccgctgcctgcccggggccagcctggcctggctgggcaccgtgctgctgctgctggccgactgggtgctgctgaggacagccctgccccgcatcttcagcctgctggtgcccacagccctgcccctgctgcgggtgtgggccgtgggcctgagccgctgggccgtgctgtggctgggcgcctgtggggtgctgcgggccactggaggcagcaagtcagaaaatgctggggcccagggctggctggccgccctgaagcccctggccgccgccctgggcctggccctgcccggcctggccctcttccgggagctgatctcctggggcgcccctggcagcgctgacagcacccggctgctgcactggggcagccaccccacagcctttgtggtgtcctatgctgctgccctgcctgctgctgccctgtggcacaagctgggcagcctgtgggtgcctgggggccagggcggcagcggcaaccctgtgcggcggctgctgggctgcctgggcagcgagacccggcggctgagcctcttcctggtgctggtggtgctgagcagcctgggggagatggccatccccttcttcaccggccgcctgacagactggatcctgcaggacggcagcgctgacaccttcaccaggaacctgaccctgatgagcatcctgaccatcgccagcgctgtgctggagtttgtgggagatggcatctacaacaacaccatgggccacgtgcacagccacctgcagggcgaggtgtttggagctgtgctgcggcaggagacagagttcttccagcagaaccagacaggcaacatcatgagccgggtgacagaggacaccagcaccctgagtgacagcctgtctgagaacctgagcctcttcctgtggtacctggtgcggggcctgtgcctgctgggcatcatgctgtggggctctgtgtccctgaccatggtgaccctcatcaccctgcccctgctcttcctgctgcccaagaaggtgggcaagtggtaccagctgctggaggtgcaggtgcgggagagcctggccaagagcagccaggtggccatcgaggccctgagcgccatgcccaccgtgcgcagctttgccaatgaggagggggaggcccagaagttccgggagaagctgcaggagatcaagaccctgaaccagaaggaggccgtggcctatgctgtgaacagctggaccaccagcatcagcggcatgctgctgaaggtgggcatcctgtacatcggcggccagctggtgaccagcggggctgtgagcagcggcaacctggtgacctttgtgctgtaccagatgcagttcacccaggccgtggaggtgctgctgagcatctacccccgggtgcagaaggctgtgggcagcagcgagaagatctttgagtacctggacaggaccccccgctgccccccatctggcctgctgacccccctgcacctggagggcctggtgcagttccaggatgtgtcctttgcctaccccaacagaccagatgtgctggtgctgcagggcctgaccttcaccctgcggcctggagaggtgacagccctggtgggccccaacggcagcggcaagagcacagtggccgccctgctgcagaacctgtaccagcccaccggcggccagctgctgctggatggcaagcccctgccccagtatgagcaccgctacctgcaccggcaggtggccgctgtgggccaggagccccaggtgtttggccgcagcctgcaggagaacatcgcctacggcctgacccagaagcccaccatggaggagatcacagctgctgctgtgaagagcggggcccacagcttcatcagcggcctgccccagggctatgacacagaggtggatgaagctggcagccagctgagcggcggccagaggcaggccgtggccctggcccgggccctgatcaggaagccctgtgtgctgatcctggatgatgccaccagcgccctggatgccaacagccagctgcaggtggagcagctgctgtatgagagccctgagcgctacagccgctctgtgctgctgatcacccagcacctgagcctggtggagcaggccgaccacatcctcttcctggagggcggggccatccgggagggcggcacccaccagcagctgatggagaagaagggctgctactgggccatggtgcaggccccagcagatgcccctgagtag

SEQ ID NO: 174064 - DNA, 2427 bp, Artificial Sequence; identical to SEQ ID NO: 174057
  Description of Artificial Sequence: Synthetic coding sequence

SEQ ID NO: 174065 - DNA, 2427 bp, Artificial Sequence; identical to SEQ ID NO: 174057
  Description of Artificial Sequence: Synthetic coding sequence

SEQ ID NO: 174066 - DNA, 1644 bp, Artificial Sequence; identical to SEQ ID NO: 174062
  Description of Artificial Sequence: Synthetic coding sequence

SEQ ID NO: 174067 - DNA, 1644 bp, Artificial Sequence; identical to SEQ ID NO: 174062
  Description of Artificial Sequence: Synthetic coding sequence

SEQ ID NO: 174068 - DNA, 1644 bp, Artificial Sequence; identical to SEQ ID NO: 174062
  Description of Artificial Sequence: Synthetic coding sequence

SEQ ID NO: 174069 - DNA, 1644 bp, Artificial Sequence; identical to SEQ ID NO: 174062
  Description of Artificial Sequence: Synthetic coding sequence

SEQ ID NO: 174070 - DNA, 1644 bp, Artificial Sequence; identical to SEQ ID NO: 174062
  Description of Artificial Sequence: Synthetic coding sequence

SEQ ID NO: 174071 - DNA, 1644 bp, Artificial Sequence; identical to SEQ ID NO: 174062
  Description of Artificial Sequence: Synthetic coding sequence

SEQ ID NO: 174072 - DNA, 1644 bp, Artificial Sequence; identical to SEQ ID NO: 174062
  Description of Artificial Sequence: Synthetic coding sequence

SEQ ID NO: 174073 - DNA, 2061 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctggtgcggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcgcctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccctgcaggactggaacagcagaggagacagaacagtgctggtgattgcccaccggctgcagacagtgcagagggcccaccagatcctggtgctgcaggagggcaagctgcagaagctggcccagctgtag

SEQ ID NO: 174074 - DNA, 1962 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctggtgcggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcgcctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccaagaccctgtggaagttcatgatcttctag

SEQ ID NO: 174075 - DNA, 2061 bp, Artificial Sequence; identical to SEQ ID NO: 174073
  Description of Artificial Sequence: Synthetic coding sequence

SEQ ID NO: 174076 - DNA, 1962 bp, Artificial Sequence; identical to SEQ ID NO: 174074
  Description of Artificial Sequence: Synthetic coding sequence

SEQ ID NO: 174077 - DNA, 2061 bp, Artificial Sequence; identical to SEQ ID NO: 174073
  Description of Artificial Sequence: Synthetic coding sequence

SEQ ID NO: 174078 - DNA, 1962 bp, Artificial Sequence; identical to SEQ ID NO: 174074
  Description of Artificial Sequence: Synthetic coding sequence

SEQ ID NO: 174079 - DNA, 1962 bp, Artificial Sequence; identical to SEQ ID NO: 174074
  Description of Artificial Sequence: Synthetic coding sequence

SEQ ID NO: 174080 - DNA, 2061 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctgatccggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcacctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccctgcaggactggaacagcagaggagacagaacagtgctggtgattgcccaccggctgcagacagtgcagagggcccaccagatcctggtgctgcaggagggcaagctgcagaagctggcccagctgtag

SEQ ID NO: 174081 - DNA, 1962 bp, Artificial Sequence; identical to SEQ ID NO: 174074
  Description of Artificial Sequence: Synthetic coding sequence

SEQ ID NO: 174082 - DNA, 1962 bp, Artificial Sequence; identical to SEQ ID NO: 174074
  Description of Artificial Sequence: Synthetic coding sequence

SEQ ID NO: 174083 - DNA, 2061 bp, Artificial Sequence; identical to SEQ ID NO: 174073
  Description of Artificial Sequence: Synthetic coding sequence

SEQ ID NO: 174084 - DNA, 1962 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctgatccggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcacctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccaagaccctgtggaagttcatgatcttctag

SEQ ID NO: 174085 - DNA, 1962 bp, Artificial Sequence; identical to SEQ ID NO: 174074
  Description of Artificial Sequence: Synthetic coding sequence

SEQ ID NO: 174086 - DNA, 2112 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctggtgcggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcgcctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccctgcaggactggaacagcagaggagacagaacagtgctggtgattgcccaccggctgcaggccgtgcagagggcccaccagatcctggtgctgcaggagggcaagctgcagaagctggcccagctgcaggagggccaggacctgtacagccggctggtgcagcagaggctgatggactag

SEQ ID NO: 174087 - DNA, 2112 bp, Artificial Sequence; identical to SEQ ID NO: 174086
  Description of Artificial Sequence: Synthetic coding sequence

SEQ ID NO: 174088 - DNA, 2112 bp, Artificial Sequence; identical to SEQ ID NO: 174086
  Description of Artificial Sequence: Synthetic coding sequence

SEQ ID NO: 174089 - DNA, 2310 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctggtgcggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcgcctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccaacggcttctgggtgggccccctgggcggcggcagcgccagcgagagtgaccccaccggcttcctgcatgacagccgccaccggctgagcagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggtgcagcctgaggtgacagtgtacccagagaggacccccctgctgcaccagcacaacctgctgcactgcagcgtgacaggcttctacccaggggacatcaagatcaagtggttcctgaatggccagtag

SEQ ID NO: 174090 - DNA, 2310 bp, Artificial Sequence; identical to SEQ ID NO: 174089
  Description of Artificial Sequence: Synthetic coding sequence

SEQ ID NO: 174091 - DNA, 2310 bp, Artificial Sequence; identical to SEQ ID NO: 174089
  Description of Artificial Sequence: Synthetic coding sequence

SEQ ID NO: 174092 - DNA, 2310 bp, Artificial Sequence
  Description of Artificial Sequence: Synthetic coding sequence
atgaggctgcctgacctgcggccctggaccagcctgctgctggtggatgctgccctgctgtggctgctgcagggccccctgggcaccctgctgccccagggcctgcccggcctgtggctggagggcaccctgcggctgggcggcctgtggggcctgctgaagctgcggggcctgctgggctttgtgggcaccctgctgctgcccctgtgcctggccacccccctgactgtgtccctgcgggccctggtggccggggccagccgggcccccccagcccgggtggccagcgccccctggagctggctgctggtgggctacggggctgctggcctgtcctggagcctgtgggccgtgctgagccccccaggggcccaggagaaggagcaggaccaggtgaacaacaaggtgctgatgtggaggctgctgaagctgagcaggccagacctgcccctgctggtggccgccttcttcttcctggtgctggccgtgctgggggagaccctcatcccccactacagcggccgggtgattgacatcctgggcggggactttgacccccacgcctttgccagcgccatcttcttcatgtgcctcttctcctttggcagcagcctgtctgctggctgccggggcggctgcttcacctacaccatgagccgcatcaacctgcgcatccgggagcagctgttcagcagcctgctgcggcaggacctgggcttcttccaggagaccaagacaggagagctgaacagccggctgagcagtgacaccaccctgatgagcaactggctgcccctgaatgccaacgtgctgctgcggagcctggtgaaggtggtgggcctgtatggcttcatgctgagcatcagcccccggctgaccctgctgagcctgctgcacatgcccttcaccatcgctgctgagaaggtgtacaacaccaggcaccaggaggtgctgcgggagatccaggatgctgtggcccgggccggccaggtggtgcgggaggccgtgggcggcctgcagacagtgcgcagctttggagctgaggagcacgaggtgtgccgctacaaggaggccctggagcagtgccggcagctgtactggaggcgggacctggagcgggccctgtacctgctgatccggcgggtgctgcacctgggcgtgcagatgctgatgctgagctgtggcctgcagcagatgcaggatggagagctgacccagggcagcctgctgtccttcatgatctaccaggagagcgtgggcagctatgtgcagaccctggtgtacatctacggggacatgctgagcaatgtgggcgctgctgagaaggtgttctcctacatggaccggcagcccaacctgcccagccctggcaccctggcccccaccaccctgcagggcgtggtgaagttccaggatgtgtcctttgcctaccccaacagaccagacaggcctgtgctgaagggcctgaccttcaccctgcggcctggagaggtgacagccctggtgggccccaatggaagtggcaagagcacagtggccgccctgctgcagaacctgtaccagcccactggaggccaggtgctgctggatgagaagcccatcagccagtatgagcactgctacctgcacagccaggtggtgtctgtgggccaggagcctgtgctcttcagcggctctgtgaggaacaacatcacctacggcctgcagagctgtgaagatgacaaggtgatggctgctgcccaggccgcccatgctgatgacttcatccaggagatggagcacggcatctacacagatgtgggggagaagggcagccagctggccgccggccagaagcagaggctggccatcgcccgggccctggtgcgggacccccgggtgctgatcctggatgaggccaccagcgccctggatgtgcagtgtgagcaggccaacggcttctgggtgggccccctgggcggcggcagcgccagcgagagtgaccccaccggcttcctgcatgacagccgccaccggctgagcagtgatgtgggcatgtttgtggccctgaccaagctgggccagccagatgctgagcagtggaacagccggctggacctgctggagaggagccggcaggccgtggatggagtgtgccgccacaactaccgcctgggcgcccccttcaccgtgggcaggaaggtgcagcctgaggtgacagtgtacccagagaggacccccctgctgcaccagcacaacctgctgcactgcagcgtgacaggcttctacccaggggacatcaagatcaagtggttcctgaatggccagtag

SEQ ID NO: 174093 - DNA, 2310 bp, Artificial Sequence; identical to SEQ ID NO: 174089
  Description of Artificial Sequence: Synthetic coding sequence

SEQ ID NO: 174094 - DNA, 2310 bp, Artificial Sequence; identical to SEQ ID NO: 174089
  Description of Artificial Sequence: Synthetic coding sequence

SEQ ID NO: 174095 - DNA, 2697 bp, Artificial Sequence
  Description of Artificial Sequence: Synthetic coding sequence
atggtgtgggaccggcagaccaagatggagtatgagtggaagccagatgagcagggcctgcagcagatcctgcagctgctgaaggagagccagagcccagacaccaccatccagaggacagtgcagcagaagctggagcagctgaaccagtacccagacttcaacaactacctgatctttgtgctgaccaagctgaagtcagaagatgagcccaccaggagcctgagcggcctcatcctgaagaacaacgtgaaggcccacttccagaacttccccaatggagtgacagacttcatcaagtctgagtgcctgaacaacattggagacagcagccccctcatccgggccaccgtgggcatcctgatcaccaccatcgccagcaagggggagctgcagaactggccagacctgctgcccaagctgtgcagcctgctggacagcgaggactacaacacctgtgagggcgcctttggagccctgcagaagatctgtgaagattctgctgagatcctggacagtgatgtgctggaccggcccctgaacatcatgatccccaagttcctgcagttcttcaagcacagcagccccaagatccgcagccatgctgtggcctgtgtgaaccagttcatcatcagcaggacccaggccctgatgctgcacatcgacagcttcatcgagaacctgtttgccctggccggagatgaggagcctgaggtgaggaagaatgtgtgccgggccctggtgatgctgctggaggtgaggatggaccggctgctgccccacatgcacaacatcgtggagtacatgctgcagaggacccaggaccaggatgaaaatgtggccctggaggcctgtgagttctggctgaccctggccgagcagcccatctgcaaggatgtgctggtgcgccacctgcccaagctgatccctgtgctggtgaatggcatgaagtacagcgacatcgacatcatcctgctgaagggagatgtggaggaggatgagaccatcccagattctgagcaggacatccggccccgcttccacaggagcaggacagtggcccagcagcatgatgaagatggcatcgaggaggaggatgatgatgatgatgaaattgatgatgatgacaccatcagtgactggaacctgaggaaatgttctgctgctgccctggatgtgctggccaacgtgtacagagatgagctgctgccccacatcctgcccctgctgaaggagctgctcttccaccacgagtgggtggtgaaggagagcggcatcctggtgctgggcgccatcgccgagggctgcatgcagggcatgatcccctacctgcctgagctgatcccccacctgatccagtgcctgagtgacaagaaggccctggtgcgcagcatcacctgctggaccctgagccgctatgcccactgggtggtgtcccagcccccagacacctacctgaagcccctgatgacagagctgctgaagaggatcctggacagcaacaagagggtgcaggaggccgcctgcagcgcctttgccaccctggaggaggaggcctgcacagagctggtgccctacctggcctacatcctggacaccctggtgtttgccttcagcaagtaccagcacaagaacctgctgatcctgtatgatgccatcggcaccctggccgacagcgtgggccaccacctgaacaagccagagtacatccagatgctgatgcctcctctcatccagaagtggaacatgctgaaggatgaggacaaggacctcttccccctgctggagtgcctgagctctgtggccacagccctgcagagcggcttcctgccctactgtgagcctgtgtaccagagatgtgtgaacctggtgcagaagaccctggcccaggccatgctgaacaatgcccagcctgaccagtatgaggccccagacaaggacttcatgattgtggccctggacctgctgagcggcctggccgagggcctgggcggcaacatcgagcagctggtggcccggagcaacatcctgaccctgatgtaccagtgcatgcaggacaagatgcctgaggtgcggcagagcagctttgccctgctgggggacctgaccaaggcctgcttccagcacgtgaagccctgcatcgctgacttcatgcccatcctgggcaccaacctgaaccctgagttcatctctgtgtgcaacaatgccacctgggccatcggggagatcagcatccagatgggcatcgagatgcagccctacatccccatggtgctgcaccagctggtggagatcatcaaccggcccaacacccccaagaccctgctggagaacacagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcaccatgatctctgtgaaccccagcggggtcatccaggacttcatcttcttctgtgatgctgtggcctcctggatcaaccccaaggatgacctgcgggacatgttctgcaagatcctgcacggcttcaagaaccaggtgggagatgagaactggaggcgcttcagtgaccagttccccctgcccctgaaggagcggctggccgccttctacggcgtgtag

SEQ ID NO: 174096 - DNA, 387 bp, Artificial Sequence
  Description of Artificial Sequence: Synthetic coding sequence
atggagtatgagtggaagccagatgagcagggcctgcagcagatcctgcagctgctgaaggagagccagagcccagacaccaccatccagaggacagtgcagcagaagctggagcagctgaaccagtacccagacttcaacaactacctgatctttgtgctgaccaagctgaagtcagaagatgagcccaccaggagcctgagcggcctcatcctgaagaacaacgtgaaggcccacttccagaacttccccaatggagtgacagacttcatcaagtctgagtgcctgaacaacattggagacagcagccccctcatccgggccaccgtgggcctgaccctgctgcacgtgtccatcagcctgagctctgtgggcctgaagctgtag

SEQ ID NO: 174097 - DNA, 2547 bp, Artificial Sequence
  Description of Artificial Sequence: Synthetic coding sequence
atggtgtgggaccggcagaccaagatggagtatgagtggaagccagatgagcagggcctgcagcagatcctgcagctgctgaaggagagccagagcccagacaccaccatccagaggacagtgcagcagaagctggagcagctgaaccagtacccagacttcaacaactacctgatctttgtgctgaccaagctgaagtctgagggcatcctgatcaccaccatcgccagcaagggggagctgcagaactggccagacctgctgcccaagctgtgcagcctgctggacagcgaggactacaacacctgtgagggcgcctttggagccctgcagaagatctgtgaagattctgctgagatcctggacagtgatgtgctggaccggcccctgaacatcatgatccccaagttcctgcagttcttcaagcacagcagccccaagatccgcagccatgctgtggcctgtgtgaaccagttcatcatcagcaggacccaggccctgatgctgcacatcgacagcttcatcgagaacctgtttgccctggccggagatgaggagcctgaggtgaggaagaatgtgtgccgggccctggtgatgctgctggaggtgaggatggaccggctgctgccccacatgcacaacatcgtggagtacatgctgcagaggacccaggaccaggatgaaaatgtggccctggaggcctgtgagttctggctgaccctggccgagcagcccatctgcaaggatgtgctggtgcgccacctgcccaagctgatccctgtgctggtgaatggcatgaagtacagcgacatcgacatcatcctgctgaagggagatgtggaggaggatgagaccatcccagattctgagcaggacatccggccccgcttccacaggagcaggacagtggcccagcagcatgatgaagatggcatcgaggaggaggatgatgatgatgatgaaattgatgatgatgacaccatcagtgactggaacctgaggaaatgttctgctgctgccctggatgtgctggccaacgtgtacagagatgagctgctgccccacatcctgcccctgctgaaggagctgctcttccaccacgagtgggtggtgaaggagagcggcatcctggtgctgggcgccatcgccgagggctgcatgcagggcatgatcccctacctgcctgagctgatcccccacctgatccagtgcctgagtgacaagaaggccctggtgcgcagcatcacctgctggaccctgagccgctatgcccactgggtggtgtcccagcccccagacacctacctgaagcccctgatgacagagctgctgaagaggatcctggacagcaacaagagggtgcaggaggccgcctgcagcgcctttgccaccctggaggaggaggcctgcacagagctggtgccctacctggcctacatcctggacaccctggtgtttgccttcagcaagtaccagcacaagaacctgctgatcctgtatgatgccatcggcaccctggccgacagcgtgggccaccacctgaacaagccagagtacatccagatgctgatgcctcctctcatccagaagtggaacatgctgaaggatgaggacaaggacctcttccccctgctggagtgcctgagctctgtggccacagccctgcagagcggcttcctgccctactgtgagcctgtgtaccagagatgtgtgaacctggtgcagaagaccctggcccaggccatgctgaacaatgcccagcctgaccagtatgaggccccagacaaggacttcatgattgtggccctggacctgctgagcggcctggccgagggcctgggcggcaacatcgagcagctggtggcccggagcaacatcctgaccctgatgtaccagtgcatgcaggacaagatgcctgaggtgcggcagagcagctttgccctgctgggggacctgaccaaggcctgcttccagcacgtgaagccctgcatcgctgacttcatgcccatcctgggcaccaacctgaaccctgagttcatctctgtgtgcaacaatgccacctgggccatcggggagatcagcatccagatgggcatcgagatgcagccctacatccccatggtgctgcaccagctggtggagatcatcaaccggcccaacacccccaagaccctgctggagaacacagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcaccatgatctctgtgaaccccagcggggtcatccaggacttcatcttcttctgtgatgctgtggcctcctggatcaaccccaaggatgacctgcgggacatgttctgcaagatcctgcacggcttcaagaaccaggtgggagatgagaactggaggcgcttcagtgaccagttccccctgcccctgaaggagcggctggccgccttctacggcgtgtag

SEQ ID NO: 174098 - DNA, 2673 bp, Artificial Sequence
  Description of Artificial Sequence: Synthetic coding sequence
atggagtatgagtggaagccagatgagcagggcctgcagcagatcctgcagctgctgaaggagagccagagcccagacaccaccatccagaggacagtgcagcagaagctggagcagctgaaccagtacccagacttcaacaactacctgatctttgtgctgaccaagctgaagtcagaagatgagcccaccaggagcctgagcggcctcatcctgaagaacaacgtgaaggcccacttccagaacttccccaatggagtgacagacttcatcaagtctgagtgcctgaacaacattggagacagcagccccctcatccgggccaccgtgggcatcctgatcaccaccatcgccagcaagggggagctgcagaactggccagacctgctgcccaagctgtgcagcctgctggacagcgaggactacaacacctgtgagggcgcctttggagccctgcagaagatctgtgaagattctgctgagatcctggacagtgatgtgctggaccggcccctgaacatcatgatccccaagttcctgcagttcttcaagcacagcagccccaagatccgcagccatgctgtggcctgtgtgaaccagttcatcatcagcaggacccaggccctgatgctgcacatcgacagcttcatcgagaacctgtttgccctggccggagatgaggagcctgaggtgaggaagaatgtgtgccgggccctggtgatgctgctggaggtgaggatggaccggctgctgccccacatgcacaacatcgtggagtacatgctgcagaggacccaggaccaggatgaaaatgtggccctggaggcctgtgagttctggctgaccctggccgagcagcccatctgcaaggatgtgctggtgcgccacctgcccaagctgatccctgtgctggtgaatggcatgaagtacagcgacatcgacatcatcctgctgaagggagatgtggaggaggatgagaccatcccagattctgagcaggacatccggccccgcttccacaggagcaggacagtggcccagcagcatgatgaagatggcatcgaggaggaggatgatgatgatgatgaaattgatgatgatgacaccatcagtgactggaacctgaggaaatgttctgctgctgccctggatgtgctggccaacgtgtacagagatgagctgctgccccacatcctgcccctgctgaaggagctgctcttccaccacgagtgggtggtgaaggagagcggcatcctggtgctgggcgccatcgccgagggctgcatgcagggcatgatcccctacctgcctgagctgatcccccacctgatccagtgcctgagtgacaagaaggccctggtgcgcagcatcacctgctggaccctgagccgctatgcccactgggtggtgtcccagcccccagacacctacctgaagcccctgatgacagagctgctgaagaggatcctggacagcaacaagagggtgcaggaggccgcctgcagcgcctttgccaccctggaggaggaggcctgcacagagctggtgccctacctggcctacatcctggacaccctggtgtttgccttcagcaagtaccagcacaagaacctgctgatcctgtatgatgccatcggcaccctggccgacagcgtgggccaccacctgaacaagccagagtacatccagatgctgatgcctcctctcatccagaagtggaacatgctgaaggatgaggacaaggacctcttccccctgctggagtgcctgagctctgtggccacagccctgcagagcggcttcctgccctactgtgagcctgtgtaccagagatgtgtgaacctggtgcagaagaccctggcccaggccatgctgaacaatgcccagcctgaccagtatgaggccccagacaaggacttcatgattgtggccctggacctgctgagcggcctggccgagggcctgggcggcaacatcgagcagctggtggcccggagcaacatcctgaccctgatgtaccagtgcatgcaggacaagatgcctgaggtgcggcagagcagctttgccctgctgggggacctgaccaaggcctgcttccagcacgtgaagccctgcatcgctgacttcatgcccatcctgggcaccaacctgaaccctgagttcatctctgtgtgcaacaatgccacctgggccatcggggagatcagcatccagatgggcatcgagatgcagccctacatccccatggtgctgcaccagctggtggagatcatcaaccggcccaacacccccaagaccctgctggagaacacagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcaccatgatctctgtgaaccccagcggggtcatccaggacttcatcttcttctgtgatgctgtggcctcctggatcaaccccaaggatgacctgcgggacatgttctgcaagatcctgcacggcttcaagaaccaggtgggagatgagaactggaggcgcttcagtgaccagttccccctgcccctgaaggagcggctggccgccttctacggcgtgtag

SEQ ID NO: 174099 - DNA, 2664 bp, Artificial Sequence
  Description of Artificial Sequence: Synthetic coding sequence
atggactggcagccagatgagcagggcctgcagcaggtgctgcagctgctgaaggacagccagagccccaacacagccacccagagaattgtgcaggacaagctgaagcagctgaaccagttcccagacttcaacaactacctgatctttgtgctgacccggctgaagtcagaagatgagcccaccaggagcctgagcggcctcatcctgaagaacaacgtgaaggcccactaccagagcttccccccacctgtggccgacttcatcaagcaggagtgcctgaacaacattggagatgccagcagcctcatccgggccaccatcggcatcctgatcaccaccatcgccagcaagggggagctgcagatgtggccagagctgctgccccagctgtgcaacctgctgaacagcgaggactacaacacctgtgagggcgcctttggagccctgcagaagatctgtgaggacagcagcgagctgctggacagtgatgccctgaaccggcccctgaacatcatgatccccaagttcctgcagttcttcaagcactgcagccccaagatccgcagccacgccatcgcctgtgtgaaccagttcatcatggaccgggcccaggccctgatggacaacatcgacaccttcatcgagcacctgtttgccctggccgtggatgatgatcctgaggtgaggaagaatgtgtgccgggccctggtgatgctgctggaggtgagaattgacaggctcatcccccacatgcacagcatcatccagtacatgctgcagaggacccaggaccatgatgaaaatgtggccctggaggcctgtgagttctggctgaccctggccgagcagcccatctgcaaggaggtgctggccagccacctggtgcagctgatccccatcctggtgaatggcatgaagtacagcgagattgacatcatcctgctgaagggagatgtggaggaggatgaagctgtgcctgattctgagcaggacatcaagccccgcttccacaagagcaggacagtgaccctgccccatgaagctgagaggccagatggctctgaagatgctgaagatgatgatgatgatgatgccctgagtgactggaacctgaggaagtgcagcgctgctgccctggatgtgctggccaacgtgttccgggaggagctgctgccccacctgctgcccctgctgaagggcctgctcttccaccctgagtgggtggtgaaggagagcggcatcctggtgctgggcgccatcgccgagggctgcatgcagggcatggtgccctacctgcctgagctgatcccccacctgatccagtgcctgagtgacaagaaggccctggtgcgcagcatcgcctgctggaccctgagccgctatgcccactgggtggtgtcccagcccccagacatgcacctgaagcccctgatgacagagctgctgaagaggatcctggatggcaacaagagggtgcaggaggccgcctgcagcgcctttgccaccctggaggaggaggcctgcacagagctggtgccctacctgagctacatcctggacaccctggtgtttgccttcggcaagtaccagcacaagaacctgctgatcctgtatgatgccatcggcaccctggccgacagcgtgggccaccacctgaaccagcctgagtacatccagaagctgatgccacccctcatccagaagtggaatgagctgaaggatgaggacaaggacctcttccccctgctggagtgcctgagctctgtggccacagccctgcagagcggcttcctgccctactgtgagcctgtgtaccagagatgtgtgaccctggtgcagaagaccctggcccaggccatgatgtacacccagcaccctgagcagtatgaggccccagacaaggacttcatgattgtggccctggacctgctgagcggcctggccgagggcctgggcggccacgtggagcagctggtggcccggagcaacatcatgaccctgctcttccagtgcatgcaggacagcatgcctgaggtgcggcagagcagctttgccctgctgggggacctgaccaaggcctgcttcatccacgtgaagccctgcatcgccgagttcatgcccatcctgggcaccaacctgaaccctgagttcatctctgtgtgcaacaatgccacctgggccatcggggagatctgcatgcagatgggcgctgagatgcagccctacgtgcagatggtgctgaacaacctggtggagatcatcaaccggcccaacacccccaagaccctgctggagaacacagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcatgatgattggagtgaaccctgggggcgtggtgcaggacttcatcttcttctgtgatgctgtggcctcctgggtgagccccaaggatgacctgcgggacatgttctacaagatcctgcacggcttcaaggaccaggtgggggaggacaactggcagcagttcagcgagcagttcccccccctgctgaaggagcggctggccgccttctatggagtgtag

SEQ ID NO: 174100 - DNA, 2100 bp, Artificial Sequence
  Description of Artificial Sequence: Synthetic coding sequence
atggactggcagccagatgagcagggcctgcagcaggtgctgcagctgctgaaggacagccagagccccaacacagccacccagagaattgtgcaggacaagctgaagcagctgaaccagttcccagacttcaacaactacctgatctttgtgctgacccggctgaagtcagaagatgagcccaccaggagcctgagcggcctcatcctgaagaacaacgtgaaggcccactaccagagcttccccccacctgtggccgacttcatcaagcaggagtgcctgaacaacattggagatgccagcagcctcatccgggccaccatcggcatcctgatcaccaccatcgccagcaagggggagctgcagatgtggccagagctgctgccccagctgtgcaacctgctgaacagcgaggactacaacacctgtgagggcgcctttggagccctgcagaagatctgtgaggacagcagcgagctgctggacagtgatgccctgaaccggcccctgaacatcatgatccccaagttcctgcagttcttcaagcactgcagccccaagatccgcagccacgccatcgcctgtgtgaaccagttcatcatggaccgggcccaggccctgatggacaacatcgacaccttcatcgagcacctgtttgccctggccgtggatgatgatcctgaggtgaggaagaatgtgtgccgggccctggtgatgctgctggaggtgagaattgacaggctcatcccccacatgcacagcatcatccagtacatgctgcagaggacccaggaccatgatgaaaatgtggccctggaggcctgtgagttctggctgaccctggccgagcagcccatctgcaaggaggtgctggccagccacctggtgcagctgatccccatcctggtgaatggcatgaagtacagcgagattgacatcatcctgctgaagggagatgtggaggaggatgaagctgtgcctgattctgagcaggacatcaagccccgcttccacaagagcaggacagtgaccctgccccatgaagctgagaggccagatggctctgaagatgctgaagatgatgatgatgatgatgccctgagtgactggaacctgaggaagtgcagcgctgctgccctggatgtgctggccaacgtgttccgggaggagctgctgccccacctgctgcccctgctgaagggcctgctcttccaccctgagtgggtggtgaaggagagcggcatcctggtgctgggcgccatcgccgagggctgcatgcagggcatggtgccctacctgcctgagctgatcccccacctgatccagtgcctgagtgacaagaaggccctggtgcgcagcatcgcctgctggaccctgagccgctatgcccactgggtggtgtcccagcccccagacatgcacctgaagcccctgatgacagagctgctgaagaggatcctggatggcaacaagagggtgcaggaggccgcctgcagcgcctttgccaccctggaggaggaggcctgcacagagctggtgccctacctgagctacatcctggacaccctggtgtttgccttcggcaagtaccagcacaagaacctgctgatcctgtatgatgccatcggcaccctggccgacagcgtgggccaccacctgaaccagcctgagtacatccagaagctgatgccacccctcatccagaagtggaatgagctgaaggatgaggacaaggacctcttccccctgctggagtgcctgagctctgtggccacagccctgcagagcggcttcctgccctactgtgagcctgtgtaccagagatgtgtgaccctggtgcagaagaccctggcccaggccatgatgtacacccagcaccctgagcagtatgaggccccagacaaggacttcatgattgtggccctggacctgctgagcggcctggccgagggcctgggcggccacgtggagcagctggtggcccacagccccagcttccccccccaccccctgcccccagctggcagccgggtgtgcccctttgtgacagtgctgtgctggggcctggccccccgctggagggagatccccctggtgtag

SEQ ID NO: 174101 - DNA, 2694 bp, Artificial Sequence
  Description of Artificial Sequence: Synthetic coding sequence
atggactggcagccagatgagcagggcctgcagcaggtgctgcagctgctgaaggacagccagagccccaacacagccacccagagaattgtgcaggacaagctgaagcagctgaaccagttcccagacttcaacaactacctgatctttgtgctgacccggctgaagtcagaagatgagcccaccaggagcctgagcggcctcatcctgaagaacaacgtgaaggcccactaccagagcttccccccacctgtggccgacttcatcaagcaggagtgcctgaacaacattggagatgccagcagcctcatccgggccaccatcggcatcctgatcaccaccatcgccagcaagggggagctgcagatgtggccagagctgctgccccagctgtgcaacctgctgaacagcgaggactacaacacctgtgagggcgcctttggagccctgcagaagatctgtgaggacagcagcgagctgctggacagtgatgccctgaaccggcccctgaacatcatgatccccaagttcctgcagttcttcaagcactgcagccccaagatccgcagccacgccatcgcctgtgtgaaccagttcatcatggaccgggcccaggccctgatggacaacatcgacaccttcatcgagcacctgtttgccctggccgtggatgatgatcctgaggtgaggaagaatgtgtgccgggccctggtgatgctgctggaggtgagaattgacaggctcatcccccacatgcacagcatcatccagtacatgctgcagaggacccaggaccatgatgaaaatgtggccctggaggcctgtgagttctggctgaccctggccgagcagcccatctgcaaggaggtgctggccagccacctggtgcagctgatccccatcctggtgaatggcatgaagtacagcgagattgacatcatcctgctgaagggagatgtggaggaggatgaagctgtgcctgattctgagcaggacatcaagccccgcttccacaagagcaggacagtgaccctgccccatgaagctgagaggccagatggctctgaagatgctgaagatgatgatgatgatgatgccctgagtgactggaacctgaggaagtgcagcgctgctgccctggatgtgctggccaacgtgttccgggaggagctgctgccccacctgctgcccctgctgaagggcctgctcttccaccctgagtgggtggtgaaggagagcggcatcctggtgctgggcgccatcgccgagggctgcatgcagggcatggtgccctacctgcctgagctgatcccccacctgatccagtgcctgagtgacaagaaggccctggtgcgcagcatcgcctgctggaccctgagccgctatgcccactgggtggtgtcccagcccccagacatgcacctgaagcccctgatgacagagctgctgaagaggatcctggatggcaacaagagggtgcaggaggccgcctgcagcgcctttgccaccctggaggaggaggcctgcacagagctggtgccctacctgagctacatcctggacaccctggtgtttgccttcggcaagtaccagcacaagaacctgctgatcctgtatgatgccatcggcaccctggccgacagcgtgggccaccacctgaaccagcctgagtacatccagaagctgatgccacccctcatccagaagtggaatgagctgaaggatgaggacaaggacctcttccccctgctggagtgcctgagctctgtggccacagccctgcagagcggcttcctgccctactgtgagcctgtgtaccagagatgtgtgaccctggtgcagaagaccctggcccaggccatgatgtacacccagcaccctgagcagtatgaggccccagacaaggacttcatgattgtggccctggacctgctgagcggcctggccgagggcctgggcggccacgtggagcagctggtggcccggagcaacatcatgaccctgctcttccagtgcatgcaggacagcatgcctgaggtgcggcagagcagctttgccctgctgggggacctgaccaaggcctgcttcatccacgtgaagccctgcatcgccgagttcatgcccatcctgggcaccaacctgaaccctgagttcatctctgtgtgcaacaatgccacctgggccatcggggagatctgcatgcagatgggcgctgagatgcagccctacgtgcagatggtgctgaacaacctggtggagatcatcaaccggcccaacacccccaagaccctgctggagaacacaggccgcctgaccagccccagcgccatcccagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcatgatgattggagtgaaccctgggggcgtggtgcaggacttcatcttcttctgtgatgctgtggcctcctgggtgagccccaaggatgacctgcgggacatgttctacaagatcctgcacggcttcaaggaccaggtgggggaggacaactggcagcagttcagcgagcagttcccccccctgctgaaggagcggctggccgccttctatggagtgtag

SEQ ID NO: 174102 - DNA, 2664 bp, Artificial Sequence; identical to SEQ ID NO: 174099
  Description of Artificial Sequence: Synthetic coding sequence

SEQ ID NO: 174103 - DNA, 2694 bp, Artificial Sequence; identical to SEQ ID NO: 174101
  Description of Artificial Sequence: Synthetic coding sequence

SEQ ID NO: 174104 - DNA, 3156 bp, Artificial Sequence
  Description of Artificial Sequence: Synthetic coding sequence
ggccagagcgtgggcggccggggcctcttccgggactgtgcctgcatcgaggagaccaccggggccggggccctgagccgcagcggggccggccccctggatgtggaggccgccggccccagccccagccgctgtgagggcggcggcagcctgcgggcccggagccggggccagagacatggccccccctgggatgagggcagcagcctgggccccatgaggatccggcgggcccctcctcctcctcctgtggcccgcttccacatccccccaccagccctgcccagcccccggctgcggggccggggctggaggtcctggaggggccccaggacctgggccggcgtggaccggcggcccccacctgtgcggcggggccgcagcagaagacatgctgccacagctgccagcggggcccctcctggcagccacacagagccccagaggccttctgctgaccccggcccctacctgcggagcctgccctgtgccatggactggcagccagatgagcagggcctgcagcaggtgctgcagctgctgaaggacagccagagccccaacacagccacccagagaattgtgcaggacaagctgaagcagctgaaccagttcccagacttcaacaactacctgatctttgtgctgacccggctgaagtcagaagatgagcccaccaggagcctgagcggcctcatcctgaagaacaacgtgaaggcccactaccagagcttccccccacctgtggccgacttcatcaagcaggagtgcctgaacaacattggagatgccagcagcctcatccgggccaccatcggcatcctgatcaccaccatcgccagcaagggggagctgcagatgtggccagagctgctgccccagctgtgcaacctgctgaacagcgaggactacaacacctgtgagggcgcctttggagccctgcagaagatctgtgaggacagcagcgagctgctggacagtgatgccctgaaccggcccctgaacatcatgatccccaagttcctgcagttcttcaagcactgcagccccaagatccgcagccacgccatcgcctgtgtgaaccagttcatcatggaccgggcccaggccctgatggacaacatcgacaccttcatcgagcacctgtttgccctggccgtggatgatgatcctgaggtgaggaagaatgtgtgccgggccctggtgatgctgctggaggtgagaattgacaggctcatcccccacatgcacagcatcatccagtacatgctgcagaggacccaggaccatgatgaaaatgtggccctggaggcctgtgagttctggctgaccctggccgagcagcccatctgcaaggaggtgctggccagccacctggtgcagctgatccccatcctggtgaatggcatgaagtacagcgagattgacatcatcctgctgaagggagatgtggaggaggatgaagctgtgcctgattctgagcaggacatcaagccccgcttccacaagagcaggacagtgaccctgccccatgaagctgagaggccagatggctctgaagatgctgaagatgatgatgatgatgatgccctgagtgactggaacctgaggaagtgcagcgctgctgccctggatgtgctggccaacgtgttccgggaggagctgctgccccacctgctgcccctgctgaagggcctgctcttccaccctgagtgggtggtgaaggagagcggcatcctggtgctgggcgccatcgccgagggctgcatgcagggcatggtgccctacctgcctgagctgatcccccacctgatccagtgcctgagtgacaagaaggccctggtgcgcagcatcgcctgctggaccctgagccgctatgcccactgggtggtgtcccagcccccagacatgcacctgaagcccctgatgacagagctgctgaagaggatcctggatggcaacaagagggtgcaggaggccgcctgcagcgcctttgccaccctggaggaggaggcctgcacagagctggtgccctacctgagctacatcctggacaccctggtgtttgccttcggcaagtaccagcacaagaacctgctgatcctgtatgatgccatcggcaccctggccgacagcgtgggccaccacctgaaccagcctgagtacatccagaagctgatgccacccctcatccagaagtggaatgagctgaaggatgaggacaaggacctcttccccctgctggagtgcctgagctctgtggccacagccctgcagagcggcttcctgccctactgtgagcctgtgtaccagagatgtgtgaccctggtgcagaagaccctggcccaggccatgatgtacacccagcaccctgagcagtatgaggccccagacaaggacttcatgattgtggccctggacctgctgagcggcctggccgagggcctgggcggccacgtggagcagctggtggcccggagcaacatcatgaccctgctcttccagtgcatgcaggacagcatgcctgaggtgcggcagagcagctttgccctgctgggggacctgaccaaggcctgcttcatccacgtgaagccctgcatcgccgagttcatgcccatcctgggcaccaacctgaaccctgagttcatctctgtgtgcaacaatgccacctgggccatcggggagatctgcatgcagatgggcgctgagatgcagccctacgtgcagatggtgctgaacaacctggtggagatcatcaaccggcccaacacccccaagaccctgctggagaacacagccatcaccatcggccgcctgggctacgtgtgcccccaggaggtggcccccatgctgcagcagttcatccggccctggtgcaccagcctgaggaacatccgggacaatgaggagaaggacagcgccttccggggcatctgcatgatgattggagtgaaccctgggggcgtggtgcaggacttcatcttcttctgtgatgctgtggcctcctgggtgagccccaaggatgacctgcgggacatgttctacaagatcctgcacggcttcaaggaccaggtgggggaggacaactggcagcagttcagcgagcagttcccccccctgctgaaggagcggctggccgccttctatggagtgtag

SEQ ID NO: 174105 - DNA, 2316 bp, Artificial Sequence
  Description of Artificial Sequence: Synthetic coding sequence
atggactggcagccagatgagcagggcctgcagcaggtgctgcagctgctgaaggacagccagagccccaacacagccacccagagaattgtgcaggacaagctgaagcagctgaaccagttcccagacttcaacaactacctgatctttgtgctgacccggctgaagtcagaagatgagcccaccaggagcctgagcggcctcatcctgaagaacaacgtgaaggcccactaccagagcttccccccacctgtggccgacttcatcaagcaggagtgcctgaacaacattggagatgccagcagcctcatccgggccaccatcggcatcctgatcaccaccatcgccagcaagggggagctgcagatgtggccagagctgctgccccagctgtgcaacctgctgaacagcgaggactacaacacctgtgagggcgcctttggagccctgcagaagatctgtgaggacagcagcgagctgctggacagtgatgccctgaaccggcccctgaacatcatgatccccaagttcctgcagttcttcaagcactgcagccccaagatccgcagccacgccatcgcctgtgtgaaccagttcatcatggaccgggcccaggccctgatggacaacatcgacaccttcatcgagcacctgtttgccctggccgtggatgatgatcctgaggtgaggaagaatgtgtgccgggccctggtgatgctgctggaggtgagaattgacaggctcatcccccacatgcacagcatcatccagtacatgctgcagaggacccaggaccatgatgaaaatgtggccctggaggcctgtgagttctggctgaccctggccgagcagcccatctgcaaggaggtgctggccagccacctggtgcagctgatccccatcctggtgaatggcatgaagtacagcgagattgacatcatcctgctgaagggagatgtggaggaggatgaagctgtgcctgattctgagcaggacatcaagccccgcttccacaagagcaggacagtgaccctgccccatgaagctgagaggccagatggctctgaagatgctgaagatgatgatgatgatgatgccctgagtgactggaacctgaggaagtgcagcgctgctgccctggatgtgctggccaacgtgttccgggaggagctgctgccccacctgctgcccctgctgaagggcctgctcttccaccctgagtgggtggtgaaggagagcggcatcctggtgctgggcgccatcgccgagggctgcatgcagggcatggtgccctacctgcctgagctgatcccccacctgatccagtgcctgagtgacaagaaggccctggtgcgcagcatcgcctgctggaccctgagccgctatgcccactgggtggtgtcccagcccccagacatgcacctgaagcccctgatgacagagctgctgaagaggatcctggatggcaacaagagggtgcaggaggccgcctgcagcgcctttgccaccctggaggaggaggcctgcacagagctggtgccctacctgagctacatcctggacaccctggtgtttgccttcggcaagtaccagcacaagaacctgctgatcctgtatgatgccatcggcaccctggccgacagcgtgggccaccacctgaaccagcctgagtacatccagaagctgatgccacccctcatccagaagtggaatgagctgaaggatgaggacaaggacctcttccccctgctggagtgcctgagctctgtggccacagccctgcagagcggcttcctgccctactgtgagcctgtgtaccagagatgtgtgaccctggtgcagaagaccctggcccaggccatgatgtacacccagcaccctgagcagtatgaggccccagacaaggacttcatgattgtggccctggacctgctgagcggcctggccgagggcctgggcggccacgtggagcagctggtggcccggagcaacatcatgaccctgctcttccagtgcatgcaggacagcatgcctgaggtgcggcagagcagctttgccctgctgggggacctgaccaaggcctgcttcatccacgtgaagccctgcatcgccgagttcatgcccatcctgggcaccaacctgaaccctgagttcatctctgtgtgcaacaatgccacctgggccatcggggagatctgcatgcagatgggcgctgagatgcagccctacgtgcagatggtgctgaacaacctggtggagatcatcaaccggcccacccccagccagaagcagaacaagaccaagaagaacaagtag

SEQ ID NO: 174106 - DNA, 2772 bp, Artificial Sequence
  Description of Artificial Sequence: Synthetic coding sequence
atggagggcgccaagcccaccctgcagctggtgtaccaggccgtgcaggccctgtaccatgaccctgaccccagcggcaaggagcgggccagcttctggctgggggagctgcagaggtctgtgcacgcctgggagatcagtgaccagctgctgcagatccggcaggatgtggagagctgctactttgctgcccagaccatgaagatgaagatccagaccagcttctatgagctgcccacagacagccacgccagcctgcgggacagcctgctgacccacatccagaacctgaaggacctgagccctgtgattgtgacccagctggccctggccatcgctgacctggccctgcagatgcccagctggaagggctgtgtgcagaccctggtggagaagtacagcaatgatgtgaccagcctgcccttcctgctggagatcctgactgtgctgcctgaggaggtgcacagccgcagcctgagaattggagccaacagaagaacagagatcatcgaggacctggccttctacagcagcacagtggtgtccctgctgatgacctgtgtggagaaggccggcacagatgagaagatgctgatgaaggtgttccgctgcctgggctcctggttcaacctgggcgtgctggacagcaacttcatggccaacaacaagctgctggccctgctgtttgaggtgctgcagcaggacaagaccagcagcaacctgcacgaggccgccagtgactgtgtgtgcagcgccctgtatgccattgaaaatgtggagaccaacctgcccctggccatgcagctgttccagggcgtgctgaccctggagacagcctaccacatggctgtggcccgggaggacctggacaaggtgctgaactactgccgcatcttcacagagctgtgtgagaccttcctggagaagatcgtgtgcaccccaggccagggcctgggggacctgcggaccctggagctgctgctgatctgtgccggccacccccagtatgaggtggtggagatctccttcaacttctggtaccgcctgggggagcacctgtacaagaccaatgatgaggtgatccacggcatcttcaaggcctacatccagaggctgctgcacgccctggcccggcactgccagctggagccagaccacgagggcgtgcctgaggagacagatgactttggagagttcaggatgagggtgtctgacctggtgaaggacctgatcttcctgattggctccatggagtgctttgcccagctgtacagcaccctgaaggagggcaaccccccctgggaggtgacagaagctgtgctcttcatcatggccgccatcgccaagtctgtggaccctgagaacaaccccaccctggtggaggtgctggagggcgtggtgcggctgcctgagaccgtgcacacagctgtgcgctacaccagcattgagctggtgggggagatgtctgaggtggtggacaggaacccccagttcctggaccctgtgctgggctacctgatgaagggcctgtgtgagaagcccctggccagcgctgctgccaaggccatccacaacatctgcagcgtgtgccgggaccacatggcccagcacttcaacggcctgctggagatcgcccggagcctggacagcttcctgctgagccctgaggccgctgtgggcctgctgaagggcacagccctggtgctggcccggctgcccctggacaagatcacagaatgtctgtctgagctgtgcagcgtgcaggtgatggccctgaagaagctgctgagccaggagcccagcaatggcatcagcagtgaccccaccgtcttcctggaccggctggccgtcatcttccgccacaccaaccccatcgtggagaatggccagacccacccctgccagaaggtgatccaggagatctggcctgtgctgtctgagaccctgaacaagcacagagctgacaaccgcatcgtggagcgctgctgccgctgcctgcgctttgctgtgcgctgtgtgggcaaaggatctgctgccctgctgcagcccctggtgacccagatggtgaatgtgtaccacgtgcaccagcacagctgcttcctgtacctgggcagcatcctggtggatgaatatggcatggaggagggctgccggcagggcctgctggacatgctgcaggccctgtgcatccccaccttccagctgctggagcagcagaatggcctgcagaaccacccagacacagtggatgacctcttccggctggccacccgcttcatccagaggagccctgtgaccctgctgcggagccaggtggtgatccccatcctgcagtgggccatcgccagcaccaccctggaccacagagatgccaactgcagcgtgatgaggttcctgcgggacctgatccacactggagtggccaatgaccatgaagaagattttgagctgaggaaggagctgattggccaggtgatgaaccagctgggccagcagctggtgtcccagctgctgcacacctgctgcttctgcctgcccccctacaccctgcctgatgtggccgaggtgctgtgggagatcatgcaggtggaccggcccaccttctgccgctggctggagaacagcctgaagggcctgcccaaggagaccaccgtgggcgctgtgacagtgacccacaagcagctgacagacttccacaagcaggtgaccagcgctgaggagtgcaagcaggtgtgctgggccctgcgggacttcaccaggctcttcagatag

SEQ ID NO: 174107 - DNA, 2874 bp, Artificial Sequence
  Description of Artificial Sequence: Synthetic coding sequence
atggagggcgccaagcccaccctgcagctggtgtaccaggccgtgcaggccctgtaccatgaccctgaccccagcggcaaggagcgggccagcttctggctgggggagctgcagaggtctgtgcacgcctgggagatcagtgaccagctgctgcagatccggcaggatgtggagagctgctactttgctgcccagaccatgaagatgaagatccagaccagcttctatgagctgcccacagacagccacgccagcctgcgggacagcctgctgacccacatccagaacctgaaggacctgagccctgtgattgtgacccagctggccctggccatcgctgacctggccctgcagatgcccagctggaagggctgtgtgcagaccctggtggagaagtacagcaatgatgtgaccagcctgcccttcctgctggagatcctgactgtgctgcctgaggaggtgcacagccgcagcctgagaattggagccaacagaagaacagagatcatcgaggacctggccttctacagcagcacagtggtgtccctgctgatgacctgtgtggagaaggccggcacagatgagaagatgctgatgaaggtgttccgctgcctgggctcctggttcaacctgggcgtgctggacagcaacttcatggccaacaacaagctgctggccctgctgtttgaggtgctgcagcaggacaagaccagcagcaacctgcacgaggccgccagtgactgtgtgtgcagcgccctgtatgccattgaaaatgtggagaccaacctgcccctggccatgcagctgttccagggcgtgctgaccctggagacagcctaccacatggctgtggcccgggaggacctggacaaggtgctgaactactgccgcatcttcacagagctgtgtgagaccttcctggagaagatcgtgtgcaccccaggccagggcctgggggacctgcggaccctggagctgctgctgatctgtgccggccacccccagtatgaggtggtggagatctccttcaacttctggtaccgcctgggggagcacctgtacaagaccaatgatgaggtgatccacggcatcttcaaggcctacatccagaggctgctgcacgccctggcccggcactgccagctggagccagaccacgagggcgtgcctgaggagacagatgactttggagagttcaggatgagggtgtctgacctggtgaaggacctgatcttcctgattggctccatggagtgctttgcccagctgtacagcaccctgaaggagggcaaccccccctgggaggtgacagaagctgtgctcttcatcatggccgccatcgccaagtctgtggaccccaagaagcccttcagcaatgctgtgtgccgccacagcctgctgtttggccagaacatcaccagcgagatcagcaactgtgagtacctgccccctgtgctgcgggagaacaaccccaccctggtggaggtgctggagggcgtggtgcggctgcctgagaccgtgcacacagctgtgcgctacaccagcattgagctggtgggggagatgtctgaggtggtggacaggaacccccagttcctggaccctgtgctgggctacctgatgaagggcctgtgtgagaagcccctggccagcgctgctgccaaggccatccacaacatctgcagcgtgtgccgggaccacatggcccagcacttcaacggcctgctggagatcgcccggagcctggacagcttcctgctgagccctgaggccgctgtgggcctgctgaagggcacagccctggtgctggcccggctgcccctggacaagatcacagaatgtctgtctgagctgtgcagcgtgcaggtgatggccctgaagaagctgctgagccaggagcccagcaatggcatcagcagtgaccccaccgtcttcctggaccggctggccgtcatcttccgccacaccaaccccatcgtggagaatggccagacccacccctgccagaaggtgatccaggagatctggcctgtgctgtctgagaccctgaacaagcacagagctgacaaccgcatcgtggagcgctgctgccgctgcctgcgctttgctgtgcgctgtgtgggcaaaggatctgctgccctgctgcagcccctggtgacccagatggtgaatgtgtaccacgtgcaccagcacagctgcttcctgtacctgggcagcatcctggtggatgaatatggcatggaggagggctgccggcagggcctgctggacatgctgcaggccctgtgcatccccaccttccagctgctggagcagcagaatggcctgcagaaccacccagacacagtggatgacctcttccggctggccacccgcttcatccagaggagccctgtgaccctgctgcggagccaggtggtgatccccatcctgcagtgggccatcgccagcaccaccctggaccacagagatgccaactgcagcgtgatgaggttcctgcgggacctgatccacactggagtggccaatgaccatgaagaagattttgagctgaggaaggagctgattggccaggtgatgaaccagctgggccagcagctggtgtcccagctgctgcacacctgctgcttctgcctgcccccctacaccctgcctgatgtggccgaggtgctgtgggagatcatgcaggtggaccggcccaccttctgccgctggctggagaacagcctgaagggcctgcccaaggagaccaccgtgggcgctgtgacagtgacccacaagcagctgacagacttccacaagcaggtgaccagcgctgaggagtgcaagcaggtgtgctgggccctgcgggacttcaccaggctcttcagatag

SEQ ID NO: 174108 - DNA, 2874 bp, Artificial Sequence; identical to SEQ ID NO: 174107
  Description of Artificial Sequence: Synthetic coding sequence

SEQ ID NO: 174109 - DNA, 2580 bp, Artificial Sequence
  Description of Artificial Sequence: Synthetic coding sequence
atggagggcgccaagcccaccctgcagctggtgtaccaggccgtgcaggccctgtaccatgaccctgaccccagcggcaaggagcgggccagcttctggctgggggagctgcagaggtctgtgcacgcctgggagatcagtgaccagctgctgcagatccggcaggatgtggagagctgctactttgctgcccagaccatgaagatgaagatccagaccagcttctatgagctgcccacagacagccacgccagcctgcgggacagcctgctgacccacatccagaacctgaaggacctgagccctgtgattgtgacccagctggccctggccatcgctgacctggccctgcagatgcccagctggaagggctgtgtgcagaccctggtggagaagtacagcaatgatgtgaccagcctgcccttcctgctggagatcctgactgtgctgcctgaggaggtgcacagccgcagcctgagaattggagccaacagaagaacagagatcatcgaggacctggccttctacagcagcacagtggtgtccctgctgatgacctgtgtggagaaggccggcacagatgagaagatgctgatgaaggtgttccgctgcctgggctcctggttcaacctgggcgtgctggacagcaacttcatggccaacaacaagctgctggccctgctgtttgaggtgctgcagcaggacaagaccagcagcaacctgcacgaggccgccagtgactgtgtgtgcagcgccctgtatgccattgaaaatgtggagaccaacctgcccctggccatgcagctgttccagggcgtgctgaccctggagacagcctaccacatggctgtggcccgggaggacctggacaaggtgctgaactactgccgcatcttcacagagctgtgtgagaccttcctggagaagatcgtgtgcaccccaggccagggcctgggggacctgcggaccctggagctgctgctgatctgtgccggccacccccagtatgaggtggtggagatctccttcaacttctggtaccgcctgggggagcacctgtacaagaccaatgatgaggtgatccacggcatcttcaaggcctacatccagaggctgctgcacgccctggcccggcactgccagctggagccagaccacgagggcgtgcctgaggagacagatgactttggagagttcaggatgagggtgtctgacctggtgaaggacctgatcttcctgattggctccatggagtgctttgcccagctgtacagcaccctgaaggagggcaaccccccctgggaggtgacagaagctgtgctcttcatcatggccgccatcgccaagtctgtggaccctgagaacaaccccaccctggtggaggtgctggagggcgtggtgcggctgcctgagaccgtgcacacagctgtgcgctacaccagcattgagctggtgggggagatgtctgaggtggtggacaggaacccccagttcctgggcacagccctggtgctggcccggctgcccctggacaagatcacagaatgtctgtctgagctgtgcagcgtgcaggtgatggccctgaagaagctgctgagccaggagcccagcaatggcatcagcagtgaccccaccgtcttcctggaccggctggccgtcatcttccgccacaccaaccccatcgtggagaatggccagacccacccctgccagaaggtgatccaggagatctggcctgtgctgtctgagaccctgaacaagcacagagctgacaaccgcatcgtggagcgctgctgccgctgcctgcgctttgctgtgcgctgtgtgggcaaaggatctgctgccctgctgcagcccctggtgacccagatggtgaatgtgtaccacgtgcaccagcacagctgcttcctgtacctgggcagcatcctggtggatgaatatggcatggaggagggctgccggcagggcctgctggacatgctgcaggccctgtgcatccccaccttccagctgctggagcagcagaatggcctgcagaaccacccagacacagtggatgacctcttccggctggccacccgcttcatccagaggagccctgtgaccctgctgcggagccaggtggtgatccccatcctgcagtgggccatcgccagcaccaccctggaccacagagatgccaactgcagcgtgatgaggttcctgcgggacctgatccacactggagtggccaatgaccatgaagaagattttgagctgaggaaggagctgattggccaggtgatgaaccagctgggccagcagctggtgtcccagctgctgcacacctgctgcttctgcctgcccccctacaccctgcctgatgtggccgaggtgctgtgggagatcatgcaggtggaccggcccaccttctgccgctggctggagaacagcctgaagggcctgcccaaggagaccaccgtgggcgctgtgacagtgacccacaagcagctgacagacttccacaagcaggtgaccagcgctgaggagtgcaagcaggtgtgctgggccctgcgggacttcaccaggctcttcagatag

SEQ ID NO: 174110 - DNA, 4236 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggaggtgaaggccagcgagaagatcctgcaggtgcgggccgccagcgccccagccaagggcacccctgggaagggggccaccccagcccctcctgggaaggccggggctgtggccagccagaccaaggccggcaagccagaggaggacagcgagagcagcagcgaggagagcagtgacagcgaggaggagaccccagctgccaaggccctgctgcaggccaaggccagcggcaagaccagccaggtgggcgccgccagcgccccagccaaggagagccccaggaaaggagctgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaagggggccgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaagggggccggccctgtgcccccaggcaaggtgggccctgccacccccagcgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggcccagaagaagattctggcagcagcgaggaggagagtgacagcgaggaggaggccgagaccctggcccaggtgaagcccagcggcaagacccaccagatccgggccgccctggccccagccaaggagagccccaggaagggggccgcccccaccccacctgggaagacaggccccagcgctgcccaggccggcaagcaggatgattctggcagcagcagcgaggagagtgacagtgatggagaggccccagctgctgtgaccagcgcccaggtgatcaagccacccctcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccacccccgcatcgcccccaaggcctccatggccggggccagcagcagcaaggagagcagccgcatcagtgatggcaagaagcaggagggccctgccacccaggtgtccaagaagaacccagccagcctgcccctgacccaggccgccctgaaggtgctggcccagaaggccagcgaggcccagccccctgtggcccggacccagcccagcagtggagtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgattctgaggacagcagtgacagcagcagcggctctgaagaagatggagagggcccccagggcgccaagagcgcccacaccctgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggggccggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174111 - DNA, 4470 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccaggtgatcaagcccccactcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccaccccagaattgcccccaaggcctccatggccggggccagcagcagcaaggagagcagccgcatcagtgatggcaagaagcaggagggccctgccacccaggtgtccaagaagaacccagccagcctgcccctgacccaggccgccctgaaggtgctggcccagaaggccagcgaggcccagccccctgtggcccggacccagcccagcagcggcgtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgacagcgaggacagcagtgacagcagcagcggcagcgaggaggatggagagggcccccagggcgccaagagcgcccacaccctggtgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggggccggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174112 - DNA, 2877 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccaggaccaggagagcagctag

SEQ ID NO: 174113 - DNA, 4245 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccaggtgatcaagcccccactcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccaccccagaattgcccccaaggcctccatggccggggccagcagcagcaaggagagcagccgcatcagtgatggcaagaagcaggagggccctgccacccaggtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgacagcgaggacagcagtgacagcagcagcggcagcgaggaggatggagagggcccccagggcgccaagagcgcccacaccctgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggagctggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaagtag

SEQ ID NO: 174114 - DNA, 4356 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccaggtgatcaagcccccactcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccaccccagaattgcccccaaggcctccatggccggggccagcagcagcaaggagagcagccgcatcagtgatggcaagaagcaggagggccctgccacccaggtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgacagcgaggacagcagtgacagcagcagcggcagcgaggaggatggagagggcccccagggcgccaagagcgcccacaccctggtgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggggccggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174115 - DNA, 4239 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggaggtgaaggccagcgagaagatcctgcaggtgcgggccgccagcgccccagccaagggcacccctgggaagggggccaccccagcccctcctgggaaggccggggctgtggccagccagaccaaggccggcaagccagaggaggacagcgagagcagcagcgaggagagcagtgacagcgaggaggagaccccagctgccaaggccctgctgcaggccaaggccagcggcaagaccagccaggtgggcgccgccagcgccccagccaaggagagccccaggaaaggagctgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaagggggccgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaagggggccggccctgtgcccccaggcaaggtgggccctgccacccccagcgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggcccagaagaagattctggcagcagcgaggaggagagtgacagcgaggaggaggccgagaccctggcccaggtgaagcccagcggcaagacccaccagatccgggccgccctggccccagccaaggagagccccaggaagggggccgcccccaccccacctgggaagacaggccccagcgctgcccaggccggcaagcaggatgattctggcagcagcagcgaggagagtgacagtgatggagaggccccagctgctgtgaccagcgcccaggtgatcaagccacccctcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccacccccgcatcgcccccaaggcctccatggccggggccagcagcagcaaggagagcagccgcatcagtgatggcaagaagcaggagggccctgccacccaggtgtccaagaagaacccagccagcctgcccctgacccaggccgccctgaaggtgctggcccagaaggccagcgaggcccagccccctgtggcccggacccagcccagcagtggagtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgattctgaggacagcagtgacagcagcagcggctctgaagaagatggagagggcccccagggcgccaagagcgcccacaccctggtgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggagctggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174116 - DNA, 4578 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccagaaggacagcaacagcaagccagcccggagcaagaccctggccccagcccctcctgagaggaacacagagggcagcagcgagagcagcgaggaggagctgcccctgacccaggtgatcaagccacccctcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccacccccgcatcgcccccaaggcctccatggccggggccagcagcagcaaggagagcagccgcatcagtgatggcaagaagcaggagggccctgccacccaggtgtccaagaagaacccagccagcctgcccctgacccaggccgccctgaaggtgctggcccagaaggccagcgaggcccagccccctgtggcccggacccagcccagcagtggagtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgattctgaggacagcagtgacagcagcagcggctctgaagaagatggagagggcccccagggcgccaagagcgcccacaccctgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggggccggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174117 - DNA, 4467 bp, Artificial Sequence
  Description of Artificial Sequence: Synthetic coding sequence
atggccgaggccaggaagagaagagagctgctgcccctcatctaccaccacctgctgcgggccggctacgtgcgggccgcccgggaggtgaaggagcagagcggccagaagtgcttcctggcccagcctgtgaccctgctggacatctacacccactggcagcagaccagcgagctgggcaggaagaggaaggccgaggaggatgctgccctgcaggccaagaagaccagggtgtctgaccccatcagcaccagcgagagcagcgaggaggaggaggaggccgaggccgagacagccaaggccaccccccggctggccagcaccaacagctctgtgctgggcgctgacctgcccagctccatgaaggagaaggccaaggccgagacagagaaggccggcaagacaggcaacagcatgccccacccagccaccgggaagacagtggccaacctgctgagcggcaagagccccaggaagtctgctgagcccagcgccaacaccaccctggtgtctgaaacagaggaggagggctctgtgcctgccttcggggctgctgccaagccaggcatggtgtctgctggccaggccgacagcagcagcgaggacaccagcagcagcagtgatgaaacagatgtggagggcaagcccagcgtgaagccagcccaggtgaaggccagctctgtgtccaccaaggagagccctgccaggaaggccgccccagcccctgggaaggtgggagatgtgaccccccaggtgaagggcggggccctgcccccagccaagagggccaagaagccagaggaggagagcgagagcagcgaggagggcagcgagagcgaggaggaggccccagctggcaccaggagccaggtgaaggccagcgagaagatcctgcaggtgcgggccgccagcgccccagccaagggcaccccaggaaaaggagccaccccagcccctcctgggaaggccggggctgtggccagccagaccaaggccggcaagccagaagaagattctgagagcagcagcgaggagagcagtgacagcgaggaggagaccccagctgccaaggccctgctgcaggccaaggccagcggcaagaccagccaggtgggcgccgccagcgccccagccaaggagagccccaggaagggggccgccccagcccctcctgggaagacaggccctgctgtggccaaggcccaggccggcaagcgggaggaggacagccagagcagcagcgaggagagtgacagcgaggaggaggccccagcccaggccaagcccagcggcaaggccccccaggtgcgggccgccagcgccccagccaaggagagccccaggaaaggagctgccccagccccacccaggaagacaggccctgctgctgcccaggtgcaggtgggcaagcaggaggaggacagccgcagcagcagcgaggagagtgacagcgaccgggaggccctggccgccatgaatgctgcccaggtgaagcccctgggcaagagcccccaggtgaagccagccagcaccatgggcatgggccccctgggcaaaggagctggccctgtgcccccaggcaaggtgggccctgccaccccatctgcccaggtgggcaagtgggaggaggacagcgagagcagcagcgaggagagcagtgacagcagtgatggagaggtgcccacagctgtggccccagcccaggagaagagcctgggcaacatcctgcaggccaagcccaccagcagccctgccaagggccccccccagaaggccggccctgtggccgtgcaggtgaaggccgagaagcccatggacaacagcgagagcagcgaggagagcagtgacagcgctgacagcgaggaggccccagctgccatgacagctgcccaggccaagccagccctgaagatcccccagaccaaggcctgccccaagaagaccaacaccacagccagcgccaaggtggcccctgtgcgggtgggcacccaggcccccaggaaggccggcacagccaccagccctgctggcagcagccctgctgtggccggcggcacccagaggcctgctgaggacagcagcagcagcgaggagagtgacagcgaggaggagaagacaggcctggccgtgacagtgggccaggccaagtctgtgggcaagggcctgcaggtgaaggccgcctctgtgcctgtgaagggcagcctgggccagggcacagcccctgtgctgcccgggaagacaggccccaccgtgacccaggtgaaggccgagaagcaggaggacagcgagagcagcgaggaggagagtgacagcgaggaggccgccgccagccctgcccaggtgaagacctctgtgaagaagacccaggccaaggccaacccagctgctgcccgggcccccagcgccaagggcaccatcagcgcccctgggaaggtggtgacagctgctgcccaggccaagcagaggagccccagcaaggtgaagccccctgtgaggaacccccagaacagcacagtgctggcccggggccctgcctctgtgcccagcgtgggcaaggctgtggccacagctgcccaggcccagacaggccctgaggaggacagcggcagcagcgaggaggagagtgacagcgaggaggaggccgagaccctggcccaggtgaagcccagcggcaagacccaccagatccgggccgccctggccccagccaaggagagccccaggaaaggagctgcccccaccccacctgggaagacaggccccagcgctgcccaggccggcaagcaggatgacagcggcagcagcagcgaggagagtgacagtgatggagaggccccagctgctgtgaccagcgcccaggtgatcaagcccccactcatctttgtggaccccaacagaagccctgctggccctgctgccaccccagcccaggcccaggccgccagcacccccaggaaggcccgggccagcgagagcacagcccggagcagcagcagcgagagtgaagatgaagatgtgatcccagccacccagtgcctgaccccaggcatccgcaccaacgtggtgaccatgcccacagcccaccccagaattgcccccaaggcctccatggccggggccagcagcagcaaggagagcagccgcatcagtgatggcaagaagcaggagggccctgccacccaggtgtccaagaagaacccagccagcctgcccctgacccaggccgccctgaaggtgctggcccagaaggccagcgaggcccagccccctgtggcccggacccagcccagcagcggcgtggacagcgctgtgggcaccctgcctgccaccagcccccagagcacctctgtgcaggccaagggcaccaacaagctgaggaagcccaagctgcctgaggtgcagcaggccaccaaggcccctgagagcagtgatgacagcgaggacagcagtgacagcagcagcggcagcgaggaggatggagagggcccccagggcgccaagagcgcccacaccctgggccccacccccagcaggacagagaccctggtggaggagacagctgctgagagcagtgaagatgatgtggtggcccccagccagagcctgctgagcggctacatgaccccaggcctgaccccagccaacagccaggccagcaaggccacccccaagctggacagcagccccagcgtgagcagcaccctggccgccaaggatgatcctgatggcaagcaggaggccaagccccagcaggccgccggcatgctgagccccaagacaggaggcaaggaggccgccagcggcaccaccccccagaagagcaggaagcccaagaagggagctggcaacccccaggccagcaccctggccctgcagagcaacatcacccagtgcctgctgggccagccctggcccctgaatgaggcccaggtgcaggcctctgtggtgaaggtgctgacagagctgctggagcaggagaggaagaaggtggtggacaccaccaaggagagcagcaggaagggctgggagagcaggaagaggaagctgagcggggaccagcctgctgcccggacccccaggagcaagaagaagaagaagctgggcgctggggagggcggggaggcctctgtgtccccagagaagaccagcaccaccagcaagggcaaggccaagagggacaaggccagcggagatgtgaaggagaagaagggcaagggcagcctgggcagccagggcgccaaggatgagcctgaggaggagctgcagaagggcatgggcaccgtggagggcggggaccagagcaaccccaagagcaagaaggagaagaagaagagtgacaagaggaagaaggacaaggagaagaaggagaagaagaagaaggccaagaaggccagcaccaaggacagcgagagccccagccagaagaagaagaagaagaagaagaagacagctgagcagacagtgtag

SEQ ID NO: 174118 - DNA, 255 bp, Artificial Sequence
  Description of Artificial Sequence: Synthetic coding sequence
atggccaccatggagaacaaggtgatctgtgccctggtgctggtgtccatgctggccctgggcaccctggccgaggcccagacagagacctgcaccgtggccccccgggagcggcagaactgtggcttccctggggtgacccccagccagtgtgccaacaagggctgctgctttgatgacacagtgcggggcgtgccctggtgcttctaccccaacaccattgatgtgcccccagaggaggagtgtgagttctag

SEQ ID NO: 174119 - DNA, 390 bp, Artificial Sequence
  Description of Artificial Sequence: Synthetic coding sequence
atgggcagaagagatgcccagctgctggccgccctgctggtgctgggcctgtgtgccctggccggcagcgagaagcccagcccctgccagtgcagccggctgagcccccacaacagaaccaactgtggcttccctggcatcaccagtgaccagtgctttgacaatggctgctgctttgacagctctgtgactggagtgccctggtgcttccaccccctgcccaagcaggagagtgaccagtgtgtgatggaggtgtctgacagaagaaactgtggctacccaggcatcagccctgaggagtgtgccagcaggaagtgctgcttcagcaacttcatctttgaggtgccctggtgcttcttccccaagtctgtggaggactgccactactag

SEQ ID NO: 174120 - DNA, 1749 bp, Artificial Sequence
  Description of Artificial Sequence: Synthetic coding sequence
atgcctggccgcacctgggagctgtgcctgctgctgctgctgggcctgggcctgggcagccaggaggccctgcccccaccctgtgagagcgagatctactgccacggggagctgctgaaccaggtgcagatggccaagctgtaccaggatgacaagcagtttgtggacatgcccctgagcatcgcccctgagcaggtgctgcagaccttcacagagctgagccgggaccacaaccacagcatcccccgggagcagctgcaggcctttgtgcatgagcacttccaggccaagggccaggagctgcagccctggaccccagctgactggaaggacagcccccagttcctgcagaagatcagtgatgccaagctgcgggcctgggccggccagctgcaccagctgtggaagaagctgggcaagaagatgaagccagaggtgctgagccaccctgagcgcttcagcctcatctacagcgagcaccccttcatcgtgcctgggggccgctttgtggagttctactactgggacagctactgggtgatggagggcctgctgctgtctgagatggccgagaccgtgaagggcatgctgcagaacttcctggacctggtgaagacctacggccacgtgcccaacggcggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctacggcggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctgggcaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaacggggtggtgctgatgctgctggaccgctacggggaccggctgaccagcggccccaagctgcccttcctggagccccactgcctggccaccctgctgcccagcctgctgctgagcctgctgccctggtag

SEQ ID NO: 174121 - DNA, 1656 bp, Artificial Sequence
  Description of Artificial Sequence: Synthetic coding sequence
atgcctggccgcacctgggagctgtgcctgctgctgctgctgggcctgggcctgggcagccaggaggccctgcccccaccctgtgagagcgagatctactgccacggggagctgctgaaccaggtgcagatggccaagctgtaccaggatgacaagcagtttgtggacatgcccctgagcatcgcccctgagcaggtgctgcagaccttcacagagctgagccgggaccacaaccacagcatcccccgggagcagctgcaggcctttgtgcatgagcacttccaggccaagggccaggagctgcagccctggaccccagctgactggaaggacagcccccagttcctgcagaagatcagtgatgccaagctgcgggcctgggccggccagctgcaccagctgtggaagaagctgggcaagaagatgaagccagaggtgctgagccaccctgagcgcttcagcctcatctacagcgagcaccccttcatcgtgcctgggggccgctttgtggagttctactactgctacggccacgtgcccaatggaggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctatggaggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctgggcaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaatggagtggtgctgatgctgctggacagatatggagaccggctgaccagcggccccaagctgcccttcctggagccccactgcctggccaccctgctgcccagcctgctgctgagcctgctgccctggtag

SEQ ID NO: 174122 - DNA, 1380 bp, Artificial Sequence
  Description of Artificial Sequence: Synthetic coding sequence
atgcccaactgtgtgcccggccagggcagctgcatcagcagcggccgctcctggggccgccgctaccagaggcctggccctgcccagggcctgaccaagggcacagaggagagaaatgtgcctggggcccacagcgtgtttggagcccagatccgggacagctactgggtgatggagggcctgctgctgtctgagatggccgagaccgtgaagggcatgctgcagaacttcctggacctggtgaagacctacggccacgtgcccaatggaggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctatggaggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctgggcaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaatggagtggtgctgatgctgctggacagatatggagaccggctgaccagcggccccaagctgcccttcctggagccccactgcctggccaccctgctgcccagcctgctgctgagcctgctgccctggtag

SEQ ID NO: 174123 - DNA, 1641 bp, Artificial Sequence
  Description of Artificial Sequence: Synthetic coding sequence
atgcctggccgcacctgggagctgtgcctgctgctgctgctgggcctgggcctgggcagccaggaggccctgcccccaccctgtgagagcgagatctactgccacggggagctgctgaaccaggtgcagatggccaagctgtaccaggatgacaagcagtttgtggacatgcccctgagcatcgcccctgagcaggtgctgcagaccttcacagagctgagccgggaccacaaccacagcatcccccgggagcagctgcaggcctttgtgcatgagcacttccaggccaagggccaggagctgcagccctggaccccagctgactggaaggacagcccccagttcctgcagaagatcagtgatgccaagctgcgggcctgggccggccagctgcaccagctgtggaagaagctgggcaagaagatgaagccagaggtgctgagccaccctgagcgcttcagcctcatctacagcgagcaccccttcatcgtgcctgggggccgctttgtggagttctactactgctacggccacgtgcccaatggaggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctatggaggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctgggcaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaatggagtggtgctgatgctgctggacagatatggagaccggctgaccagcggccccaagctgcccttcctggagccccactgcctgggcccccccttctgcccagccagctgctag

SEQ ID NO: 174124 - DNA, 1734 bp, Artificial Sequence
  Description of Artificial Sequence: Synthetic coding sequence
atgcctggccgcacctgggagctgtgcctgctgctgctgctgggcctgggcctgggcagccaggaggccctgcccccaccctgtgagagcgagatctactgccacggggagctgctgaaccaggtgcagatggccaagctgtaccaggatgacaagcagtttgtggacatgcccctgagcatcgcccctgagcaggtgctgcagaccttcacagagctgagccgggaccacaaccacagcatcccccgggagcagctgcaggcctttgtgcatgagcacttccaggccaagggccaggagctgcagccctggaccccagctgactggaaggacagcccccagttcctgcagaagatcagtgatgccaagctgcgggcctgggccggccagctgcaccagctgtggaagaagctgggcaagaagatgaagccagaggtgctgagccaccctgagcgcttcagcctcatctacagcgagcaccccttcatcgtgcctgggggccgctttgtggagttctactactgggacagctactgggtgatggagggcctgctgctgtctgagatggccgagaccgtgaagggcatgctgcagaacttcctggacctggtgaagacctacggccacgtgcccaacggcggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctacggcggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctgggcaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaacggggtggtgctgatgctgctggaccgctacggggaccggctgaccagcggccccaagctgcccttcctggagccccactgcctgggcccccccttctgcccagccagctgctag

SEQ ID NO: 174125 - DNA, 273 bp, Artificial Sequence
  Description of Artificial Sequence: Synthetic coding sequence
atggaggagaccacagactggatctacggcttcttcagcctgctgagtgacatcatcagcagtgaagatgaagaagatgatgatggagatgaggacacagacaagggggagattgatgagccccccctgaggaagaaggagatccacaaggacaagacagagaagcaggagaagccagagaggaagatccagaccaaggactggagcgccaacagcagcaccatccgcaccctgaagctgacccagctgaagcccatctacatctgcacctag

SEQ ID NO: 174126 - DNA, 654 bp, Artificial Sequence
  Description of Artificial Sequence: Synthetic coding sequence
atggaggagaccacagactggatctacggcttcttcagcctgctgagtgacatcatcagcagtgaagatgaagaagatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaagggcttccctggccctggcatccggaacagcagctactactgccagtacatcaagggccagatcaatgcctggaatgacctgcggaccagcctgctgcccatcccctacctgagctgtgggaagatgtgcagcaacttcaacaactag

SEQ ID NO: 174127 - DNA, 2166 bp, Artificial Sequence
  Description of Artificial Sequence: Synthetic coding sequence
atgacagagatcacagctgagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaaggaccagtatgccttctgccgctacatgattgacatctttgtgcatggagacctgaagccaggccagagccctgccatccccccacccctgcccacagagcaggccagccggcccaccccagccagccctgccctggaggagaaggagggggagaagaagaaggccgagaagaaggtgaccagcgagaccaagaagaaggagaaggaggacatcaagaagaagtctgagaaggagacagccattgatgtggagaagaaggagcccgggaaggccagcgagaccaagcagggcaccgtgaagattgctgcccaggccgccgccaagaaggatgagaagaaggaggacagcaagaagaccaagaagccagctgaggtggagcagcccaagggcaagaagcaggagaagaaggagaagcacgtggagcccgccaagagccccaagaaggagcacagcgtgcccagcgacaagcaggtgaaggccaagacagagcgggccaaggaggagattggagctgtgtccatcaagaaggctgtgcctgggaagaaggaggagaagaccaccaagacagtggagcaggagatcaggaaggagaagagcggcaagaccagcagcatcctgaaggacaaggagcccatcaagggcaaggaggagaaggtgcctgccagcctgaaggagaaggagcctgagaccaagaaggatgagaagatgagcaaggccggcaaggaggtgaagcccaagccaccccagctgcagggcaagaaggaggagaagccagagccccagatcaagaaggaggccaagccagccatcagcgagaaggtgcagatccacaagcaggacatcgtgaagccagagaagacagtgagccacggcaagccagaggagaaggtgctgaagcaggtgaaggctgtgaccatcgagaagacagccaagcccaagcccaccaagaaggccgagcaccgggagcgggagcccccatccatcaagacagacaagcccaagcccacccccaagggcaccagcgaggtgacagagagcggcaagaagaagacagagatcagcgagaaggagagcaaggagaaggctgacatgaagcacctgcgggaggagaaggtgtccaccaggaaggagagcctgcagctgcacaacgtgaccaaggaggatgtggaggatgtgcctgccagcaagaaggccaaggagggcacagaagatgtgagccccaccaagcagaagagccccatctccttcttccagtgtgtgtacctggatggctacaacggctacggcttccagttccccttcaccccagctgacaggcctggagagagcagcggccaggccaacagccctggccagaagcagcagggccagtag

SEQ ID NO: 174128 - DNA, 81 bp, Artificial Sequence
  Description of Artificial Sequence: Synthetic coding sequence
tgaatccacaaggacaagacagagaagcaggagaagccagagaggaagatccagaccaaggaggtgggccacagcagctag

SEQ ID NO: 174129 - DNA, 456 bp, Artificial Sequence
  Description of Artificial Sequence: Synthetic coding sequence
tgaacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaagggcttccctggccctggcatccggaacagcagctactactgccagtacatcaagggccagatcaatgcctggaatgacctgcggaccagcctgctgcccatcccctacctgagctgtgggaagatgtgcagcaacttcaacaactag

SEQ ID NO: 174130 - DNA, 2196 bp, Artificial Sequence
  Description of Artificial Sequence: Synthetic coding sequence
attgtggagatctacccccagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaaggaccagtatgccttctgccgctacatgattgacatctttgtgcatggagacctgaagccaggccagagccctgccatccccccacccctgcccacagagcaggccagccggcccaccccagccagccctgccctggaggagaaggagggggagaagaagaaggccgagaagaaggtgaccagcgagaccaagaagaaggagaaggaggacatcaagaagaagtctgagaaggagacagccattgatgtggagaagaaggtgcaggagcccgggaaggccagcgagaccaagcagggcaccgtgaagattgctgcccaggccgccgccaagaaggatgagaagaaggaggacagcaagaagaccaagaagccagctgaggtggagcagcccaagggcaagaagcaggagaagaaggagaagcacgtggagcccgccaagagccccaagaaggagcacagcgtgcccagcgacaagcaggtgaaggccaagacagagcgggccaaggaggagattggagctgtgtccatcaagaaggctgtgcctgggaagaaggaggagaagaccaccaagacagtggagcaggagatcaggaaggagaagagcggcaagaccagcagcatcctgaaggacaaggagcccatcaagggcaaggaggagaaggtgcctgccagcctgaaggagaaggagcctgagaccaagaaggatgagaagatgagcaaggccggcaaggaggtgaagcccaagccaccccagctgcagggcaagaaggaggagaagccagagccccagatcaagaaggaggccaagccagccatcagcgagaaggtgcagatccacaagcaggacatcgtgaagccagagaagacagtgagccacggcaagccagaggagaaggtgctgaagcaggtgaaggctgtgaccatcgagaagacagccaagcccaagcccaccaagaaggccgagcaccgggagcgggagcccccatccatcaagacagacaagcccaagcccacccccaagggcaccagcgaggtgacagagagcggcaagaagaagacagagatcagcgagaaggagagcaaggagaaggctgacatgaagcacctgcgggaggagaaggtgtccaccaggaaggagagcctgcagctgcacaacgtgaccaaggccgaggaggtggacagcaccctggaggatgtggaggatgtgcctgccagcaagaaggccaaggagggcacagaagatgtgagccccaccaagcagaagagccccatctccttcttccagtgtgtgtacctggatggctacaacggctacggcttccagttccccttcaccccagctgacaggcctggagagagcagcggccaggccaacagccctggccagaagcagcagggccagtag

SEQ ID NO: 174131 - DNA, 2190 bp, Artificial Sequence
  Description of Artificial Sequence: Synthetic coding sequence
atgacagagatcacagctgagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaaggaccagtatgccttctgccgctacatgattgacatctttgtgcatggagacctgaagccaggccagagccctgccatccccccacccctgcccacagagcaggccagccggcccaccccagccagccctgccctggaggagaaggagggggagaagaagaaggccgagaagaaggtgaccagcgagaccaagaagaaggagaaggaggacatcaagaagaagtctgagaaggagacagccattgatgtggagaagaaggagcccgggaaggccagcgagaccaagcagggcaccgtgaagattgctgcccaggccgccgccaagaaggatgagaagaaggaggacagcaagaagaccaagaagccagctgaggtggagcagcccaagggcaagaagcaggagaagaaggagaagcacgtggagcccgccaagagccccaagaaggagcacagcgtgcccagcgacaagcaggtgaaggccaagacagagcgggccaaggaggagattggagctgtgtccatcaagaaggctgtgcctgggaagaaggaggagaagaccaccaagacagtggagcaggagatcaggaaggagaagagcggcaagaccagcagcatcctgaaggacaaggagcccatcaagggcaaggaggagaaggtgcctgccagcctgaaggagaaggagcctgagaccaagaaggatgagaagatgagcaaggccggcaaggaggtgaagcccaagccaccccagctgcagggcaagaaggaggagaagccagagccccagatcaagaaggaggccaagccagccatcagcgagaaggtgcagatccacaagcaggacatcgtgaagccagagaagacagtgagccacggcaagccagaggagaaggtgctgaagcaggtgaaggctgtgaccatcgagaagacagccaagcccaagcccaccaagaaggccgagcaccgggagcgggagcccccatccatcaagacagacaagcccaagcccacccccaagggcaccagcgaggtgacagagagcggcaagaagaagacagagatcagcgagaaggagagcaaggagaaggctgacatgaagcacctgcgggaggagaaggtgtccaccaggaaggagagcctgcagctgcacaacgtgaccaaggccgagaagccagcccgggtgtccaaggatgtggaggatgtgcctgccagcaagaaggccaaggagggcacagaagatgtgagccccaccaagcagaagagccccatctccttcttccagtgtgtgtacctggatggctacaacggctacggcttccagttccccttcaccccagctgacaggcctggagagagcagcggccaggccaacagccctggccagaagcagcagggccagtag

SEQ ID NO: 174132 - DNA, 135 bp, Artificial Sequence
  Description of Artificial Sequence: Synthetic coding sequence
tgaatccacaaggacaagacagagaagcaggagaagccagagaggaagatccagaccaaggactggagcgccaacagcagcaccatccgcaccctgaagctgacccagctgaagcccatctacatctgcacctag

SEQ ID NO: 174133 - DNA, 1038 bp, Artificial Sequence
  Description of Artificial Sequence: Synthetic coding sequence
attgtggagatctacccccagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaaggaccagtatgccttctgccgctacatgattgacatctttgtgcatggagacctgaagccaggccagagccctgccatccccccacccctgcccacagagcaggccagccggcccaccccagccagccctgccctggaggagaaggagggggagaagaagaaggccgagaagaaggtgaccagcgagaccaagaagaaggagaaggaggacatcaagaagaagaagaagaagaagaagaagaagtag

SEQ ID NO: 174134 - DNA, 504 bp, Artificial Sequence
  Description of Artificial Sequence: Synthetic coding sequence
atgacagagatcacagctgagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggaggtgggccacagcagctag

SEQ ID NO: 174135 - DNA, 987 bp, Artificial Sequence
  Description of Artificial Sequence: Synthetic coding sequence
atgacagagatcacagctgagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaaggaccagtatgccttctgccgctacatgattgacatctttgtgcatggagacctgaagccaggccagagccctgccatccccccacccctgcccacagagcaggccagccggcccaccccagccagccctgccctggagggggacaaggccagcaaggagaagaagaggaagatgaagaggatgtctgagaagtag

SEQ ID NO: 174136 - DNA, 894 bp, Artificial Sequence
  Description of Artificial Sequence: Synthetic coding sequence
atgacagagatcacagctgagggcaatgccagcaccaccaccaccgtgattgacagcaagaatggatctgtgcccaagagccctgggaaggtgctgaagaggacagtgacagaggacatcgtgaccaccttcagcagccctgctgcctggctgctggtgattgccctgatcatcacctggagcgctgtggccatcgtgatgtttgacctggtggactacaagaacttcagcgccagcagcatcgccaagattggaagtgaccccctgaagctggtgagagatgccatggaggagaccacagactggatctacggcttcttcagcctgctgagtgacatcatcagcagtgaagatgaggaggatgatgatggagatgaggacacagacaagggggagattgatgagccccccctgaggaagaaggagatccacaaggacaagacagagaagcaggagaagccagagaggaagatccagaccaaggtgacccacaaggagaaggagaagggcaaggagaaggtgcgggagaaggagaagccagagaagaaggccacccacaaggagaagattgagaagaaggagaagccagagaccaagaccctggccaaggagcagaagaaggccaagacagctgagaagtctgaggagaagaccaagaaggaggtgaagggcggcaagcaggagaaggtgaagcagacagctgccaaggtgaaggaggtgcagaagacccccagcaagcccaaggagaaggaggacaaggagaaggctgctgtgtccaagcatgagcagaagggccagagccctgccatccccccacccctgcccacagagcaggccagccggcccaccccagccagccctgccctggagggcaagtacttcttcttctcctag

SEQ ID NO: 174137 - DNA, 5832 bp, Artificial Sequence
  Description of Artificial Sequence: Synthetic coding sequence
atgagccccctgctgcggagcatctgtgacatcacagagatcttcaaccagtatgtgtcccatgactgtgatggagctgccctgaccaagaaggacctgaagaacctgctggagcgggagtttggagctgtgctgcggcggccccatgaccccaagacagtggacctgatcctggagctgctggacctggacagcaatggccgggtggacttcaatgagttcctgctcttcatcttcaaggtggcccaggcctgctactatgccctgggccaggccaccggcctggatgaggagaagagggcccgctgtgatggcaaggagagcctgctgcaggaccggcggcaggaggaggaccagaggagatttgagccccgggaccggcagctggaggaggagcccggccagaggcggcggcagaagaggcaggagcaggagcgggagctggccgagggggaggagcagagcgagaagcaggagcggctggagcagagggaccggcagaggagagatgaggagctgtggaggcagaggcaggagtggcaggagcgggaggagcggcgggcagaggaggagcagctgcagagctgcaagggccatgaaacagaggagttcccagatgaggagcagctgcggcggcgggagctgctggagctgcggaggaagggccgggaggagaagcagcagcagaggcgggagcggcaggacagagtcttccaggaggaggaggagaaggagtggaggaagcgggagaccgtgctgaggaaggaggaggagaagctgcaggaggaggagccccagaggcagcgggagctgcaggaggaggaggagcagctgaggaagctggagcggcaggagctgcggcgggagcggcaggaggaggagcagcagcagcagaggctgcggcgggagcagcagctgcggaggaagcaggaggaggagcggcgggagcagcaggaggagcggcgggagcagcaggagcggcgggagcagcaggaggagcggcgggagcagcagctgcggcgggagcaggaggagcggcgggagcagcagctgcggcgggagcaggaggaggagcggcgggagcagcagctgcggcgggagcaggaggaggagcggcgggagcagcagctgcggcgggagcagcagctgcggcgggagcagcagctgcggcgggagcagcagctgcggcgggagcagcagctgcggcgggagcagcagctgcggcgggagcagcagctgcggcgggagcagcagctgcggcgggagcagcagctgcggcgggagcaggaggaggagagacatgagcagaagcatgagcaggagcggcgggagcagaggctgaagcgggagcaggaggagcggcgggactggctgaagcgggaggaggagacagaaagacatgagcaggagaggaggaagcagcagctgaagagggaccaggaggaggagcggcgggagcgctggctgaagctggaggaggaggagcggcgggagcagcaggagcggcgggagcagcagctgcggcgggagcaggaggagcggcgggagcagaggctgaagaggcaggaggaggaggagcggctgcagcagaggctgcggtctgagcagcagctgcggcgggagcaggaggagcggcgggagcagctgctgaagcgggaggaggagaagaggctggagcaggagcggcgggagcagaggctgaagcgggagcaggaggagcggcgggaccagctgctgaagcgggaggaggagcggcggcagcagaggctgaagcgggagcaggaggagcggctggagcagaggctgaagcgggaggaggtggagcggctggagcaggaggagcggcgggagcagaggctgaagcgggaggagcctgaggaggagcggcggcagcagctgctgaagtctgaggagcaggaggagcggcggcagcagcagctgcggcgggagcagcaggagcggcgggagcagaggctgaagcgggaggaggaggaggagcggctggagcagaggctgaagcgggagcacgaggaggagcggcgggagcaggagctggccgaggaggagcaggagcaggcccgggagcgcatcaagagccgcatccccaagtggcagtggcagctggagagcgaggctgatgcccggcagagcaaggtgtacagccggcccaggaagcaggagggccagaggcggcggcaggagcaggaggagaagagaagaagaagagagagcgagctgcagtggcaggaggaggagcgggcccaccggcagcagcaggaggaggagcagaggcgggacttcacctggcagtggcaggccgaggagaagtctgagcggggccggcagaggctgagcgcccggccccccctgcgggagcagcgggagcggcagctgcgggcagaggagcggcagcagcgggagcagcgcttcctgcctgaggaggaggagaaggagcagaggcggcggcagaggcgggagcgggagaaggagctgcagttcctggaggaggaggagcagctgcagaggcgggagcgggcccagcagctgcaggaggaggaggatggcctgcaggaggaccaggagaggagaagaagccaggagcagaggcgggaccagaagtggcgctggcagctggaggaggagaggaagagaagaagacacaccctgtatgccaagccagccctgcaggagcagctgaggaaggagcagcagctgctgcaggaggaggaggaggagctgcagcgggaggagcgggagaagagaagacggcaggagcaggagcggcagtaccgggaggaggagcagctgcagcaggaggaggagcagctgctgcgggaggagcgggagaagagaagacggcaggagcgggagcggcagtacaggaaggacaagaagctgcagcagaaggaggagcagctgctgggggaggagcctgagaagagaagacggcaggagcgggagaagaagtaccgggaggaggaggagctgcagcaggaggaggagcagctgctgcgggaggagcgggagaagagaagacggcaggagtgggagcggcagtacaggaagaaggatgagctgcagcaggaggaggagcagctgctgcgggaggagcgggagaagaggcggctgcaggagcgggagcggcagtaccgggaggaggaggagctgcagcaggaggaggagcagctgctgggggaggagcgggagacccggcggcggcaggagctggagcggcagtacaggaaggaggaggagctgcagcaggaggaggagcagctgctgcgggaggagcctgagaagagaagacggcaggagcgggagcggcagtgccgggaggaggaggagctgcagcaggaggaggagcagctgctgcgggaggagcgggagaagagaagacggcaggagctggagcggcagtaccgggaggaggaggaggtgcagcaggaggaggagcagctgctgcgggaggagcctgagaagagaagacggcaggagctggagcggcagtaccgggaggaggaggagctgcagcaggaggaggagcagctgctgcgggaggagcaggagaagaggcggcaggagcgggagcggcagtaccgggaggaggaggagctgcagaggcagaagaggaagcagcgctacagagatgaggaccagaggagtgacctgaagtggcagtgggagcctgagaaggaaaatgctgtgcgggacaacaaggtgtactgcaagggccgggagaatgagcagttccggcagctggaggacagccagctgcgggaccggcagagccagcaggacctgcagcacctgctgggggagcagcaggagcgggaccgggagcaggagcggcggcgctggcagcagagggacagacacttccctgaggaggagcagctggagcgggaggagcagaaggaggccaagagaagagacaggaagagccaggaggagaagcagctgctgcgggaggagcgggaggagaagagaagacggcaggagacagacaggaagttccgggaggaggagcagctgctgcaggagcgggaggagcagcccctgcggcggcaggagcgggacaggaagttccgggaggaggagctgcggcaccaggagcagggcaggaagttcctggaggaggagcagaggctgcggcggcaggagcgggagaggaagttcctgaaggaggagcagcagctgcgctgccaggagcgggagcagcagctgcggcaggaccgggacaggaagttccgggaggaggagcagcagctgagccggcaggagcgggacaggaagttccgggaggaggagcagcaggtgcggcggcaggagcgggagaggaagttcctggaggaggagcagcagctgcggcaggagcggcacaggaagttccgggaggaggagcagctgctgcaggagcgggaggagcagcagctgcaccggcaggagcgggacaggaagttcctggaggaggagcagcagctgcggcggcaggagcgggacaggaagttccgggagcaggagctgcggagccaggagcctgagaggaagttcctggaggaggagcagcagctgcaccggcagcagaggcagaggaagttcctgcaggaggagcagcagctgcggcggcaggagcggggccagcagaggcggcaggaccgggacaggaagttccgggaggaggagcagctgcggcaggagcgggaggagcagcagctgagccggcaggagcgggacaggaagttccggctggaggagcagaaggtgcggcggcaggagcaggagaggaagttcatggaggatgagcagcagctgcggcggcaggagggccagcagcagctgcggcaggagcgggacaggaagttcagagaagatgagcagctgctgcaggagcgggaggagcagcagctgcaccggcaggagcgggacaggaagttcctggaggaggagccccagctgcggcggcaggagcgggagcagcagctgcggcatgaccgggacaggaagttccgggaggaggagcagctgctgcaggagggggaggagcagcagctgcggcggcaggagcgggacaggaagttccgggaggaggagcagcagctgcggcggcaggagcgggagaggaagttcctgcaggaggagcagcagctgcggcggcaggagctggagaggaagttccgggaggaggagcagctgcggcaggagacagagcaggagcagctgcggcggcaggagcgctacaggaagatcctggaggaggagcagctgcggcctgagcgggaggagcagcagctgcggcggcaggagcgggacaggaagttccgggaggaggagcagctgcggcaggagcgggaggagcagcagctgcggagccaggagagtgacaggaagttccgggaggaggagcagctgcggcaggagcgggaggagcagcagctgcggccccagcagagagatggcaagtaccgctgggaggaggagcagctgcagctggaggagcaggagcagaggctgcggcaggagcgggaccggcagtacagagctgaggagcagtttgccacccaggagaagagccggcgggaggagcaggagctgtggcaggaggaggagcagaagaggcggcaggagcgggagaggaagctgcgggaggagcacatccggcggcagcagaaggaggagcagaggcaccggcaggtgggggagatcaagagccaggagggcaaaggacatggccgcctgctggagcccggcacccaccagtttgcctctgtgcctgtgcgcagcagccccctgtatgagtacatccaggagcagaggagccagtaccggccctag

SEQ ID NO: 174138 - DNA, 540 bp, Artificial Sequence
  Description of Artificial Sequence: Synthetic coding sequence
atggccaagacagccatggcctacaaggagaagatgaaggagctgtccatgctgagcctcatctgcagctgcttctacccagagcccaggaacatcaacatctacacctatgatgacatggaggtgaagcagatcaacaagagggccagcggccaggcctttgagctgatcctgaagccacccagccccatcagcgaggcccccaggaccctggccagccccaagaagaaggacctgagcctggaggagatccagaagaagctggaggccgctgaggagaggaggaagagccaggaggcccaggtgctgaagcagctggccgagaagcgggagcacgagcgggaggtgctgcagaaggccctggaggagaacaacaacttcagcaagatggccgaggagaagctgatcctgaagatggagcagatcaaggagaaccgggaggccaacctggccgccatcatcgagcggctgcaggagaaggagagacatgctgctgaggtgagaagaaacaaggagctgcaggtggagctgagcggctag

SEQ ID NO: 174139 - DNA, 3885 bp, Artificial Sequence
  Description of Artificial Sequence: Synthetic coding sequence
atgccctatgaggtgaatgccggctatgacttcaccaacatggtgaggaagaagaacccccccctgagaaatgtggccagcgagggggagggccagatcctggagcccatcggcacagagagcaaggtgtctgggaagaacaaggagttctctgctgaccagatgtctgaaaatacagaccagagtgatgctgctgagctgaaccacaaggaggagcacagcctgcacgtgcaggaccccagcagcagcagcaagaaggacctgaagtctgctgtgctgtctgagaaggccggcttcaactatgagagccccagcaagggcggcaacttccccagcttcccccatgatgaggtgacagacaggaacatgctggccttcagcagccctgctgctggaggagtgtgtgagcccctgaagagcccccagagagctgaggctgatgacccccaggacatggcctgcaccccatctggggacagcctggagaccaaggaggaccagaagatgagccccaaggccacagaggagaccggccaggcccagagcggccaggccaactgccagggcctgagccctgtgtctgtggccagcaagaacccccaggtgcccagtgatggaggagtgcggctgaacaagagcaagacagacctgctggtgaatgacaacccagaccctgcccccctgagccctgagctgcaggacttcaagtgcaacatctgtggctacggctactatggaaatgaccccacagacctgatcaagcacttcaggaagtaccacctgggcctgcacaacagaacccggcaggatgctgagctggacagcaagatcctggccctgcacaacatggtgcagttcagccacagcaaggacttccagaaggtgaacagaagtgtcttctctggagtgctgcaggacatcaacagcagcaggcctgtgctgctgaatggcacctatgatgtgcaggtgaccagcggcggcaccttcatcggcatcggcaggaagaccccagactgccagggcaacaccaagtacttccgctgcaagttctgcaacttcacctacatgggcaacagcagcacagagctggagcagcacttcctgcagacccaccccaacaagatcaaggccagcctgcccagcagcgaggtggccaagcccagcgagaagaacagcaacaagagcatcccagccctgcagagcagtgacagcggggacctgggcaagtggcaggacaagatcaccgtgaaggctggagatgacacccctgtgggctacagcgtgcccatcaagcccctggacagcagccggcagaatggaacagaggccaccagctactactggtgcaagttctgcagcttcagctgtgagagcagcagcagcctgaagctgctggagcactacggcaagcagcacggggctgtgcagagcggcggcctgaaccctgagctgaatgacaagctgagccggggcagcgtcatcaaccagaatgacctggccaagagcagcgagggggagaccatgaccaagacagacaagagcagcagcggggccaagaagaaggacttcagcagcaaaggagctgaggacaacatggtgaccagctacaactgccagttctgtgacttccgctacagcaagagccacggcccagatgtgattgtggtgggccccctgctgcggcactaccagcagctgcacaacatccacaagtgcaccatcaagcactgccccttctgcccccggggcctgtgcagccctgagaagcacctgggggagatcacctacccctttgcctgcaggaagagcaactgcagccactgtgccctgctgctgctgcacctgagccctggagctgctggcagcagccgggtgaagcaccagtgccaccagtgcagcttcaccaccccagatgtggatgtgctgctcttccactatgagagcgtgcatgagagccaggccagtgatgtgaagcaggaggccaaccacctgcagggcagtgatggccagcagagcgtgaaggagagcaaggagcacagctgcaccaagtgtgacttcatcacccaggtggaggaggagatcagccgccactacagaagagcccacagctgctacaagtgccggcagtgcagcttcaccgctgctgacacccagagcctgctggagcacttcaacacagtgcactgccaggagcaggacatcaccacagccaacggggaggaggatggccacgccatcagcaccatcaaggaggagcccaagattgacttccgggtgtacaacctgctgaccccagacagcaagatgggagagcctgtgtctgagagcgtggtgaagcgggagaagctggaggagaaggatggcctgaaggagaaggtgtggacagagagcagcagtgatgacctgagaaatgtgacctggagaggagctgacatcctgcggggcagccccagctacacccaggccagcctgggcctgctgacccctgtgtctggcacccaggagcagaccaagaccctgcgggacagccccaacgtggaggccgcccacctggcccggcccatctacggcctggccgtggagaccaagggcttcctgcagggcgccccagctggaggagagaagagcggggccctgccccagcagtacccagccagcggggagaacaagagcaaggatgagagccagagcctgctgcggcggcggcggggcagcggggtcttctgtgccaactgcctgaccaccaagaccagcctgtggaggaagaatgccaatggaggctacgtgtgcaatgcctgtggcctgtaccagaagctgcacagcaccccccggcccctgaacatcatcaagcagaacaatggagagcagatcatcagaagaaggaccaggaagaggctgaaccctgaggccctgcaggccgagcagctgaacaagcagcagaggggcagcaatgaggagcaggtgaatggcagccccctggagaggagaagtgaggaccacctgacagagagccaccagcgggagatccccctgcccagcctgagcaaatatgaggcccagggcagcctgaccaagagccacagcgcccagcagcctgtgctggtgtcccagaccctggacatccacaagaggatgcagcccctgcacatccagatcaagagcccccaggagagcactggagaccccggcaacagcagctctgtgtctgagggcaagggcagcagcgagcggggcagccccatcgagaagtacatgaggcctgccaagcaccccaactacagccccccaggcagccccatcgagaagtaccagtaccccctgtttggcctgccctttgtgcacaatgacttccagagcgaggccgactggctgcgcttctggagcaagtacaagctgtctgtgcccggcaacccccactacctgagccacgtgcccggcctgcccaacccctgccagaactacgtgccctaccccaccttcaacctgcccccccacttctctgctgtgggcagtgacaatgacatccccctggacctggccatcaagcacagccggcccggccccacagccaatggagccagcaaggagaagaccaaggcccccccaaatgtgaagaatgaaggccccctgaatgtggtgaagacagagaaggtggacaggagcacccaggatgagctgagcaccaagtgtgtgcactgcggcatcgtgttcctggatgaggtgatgtatgccctgcacatgagctgccacggggacagcggccccttccagtgcagcatctgccagcacctgtgcacagacaagtatgacttcaccacccacatccagaggggcctgcacagaaataatgcccaggtggagaagaatggcaagcccaaggagtag

SEQ ID NO: 174140 - DNA, 3858 bp, Artificial Sequence
  Description of Artificial Sequence: Synthetic coding sequence
atgcagagcaacatggtgaggaagaagaacccccccctgagaaatgtggccagcgagggggagggccagatcctggagcccatcggcacagagagcaaggtgtctgggaagaacaaggagttctctgctgaccagatgtctgagaacacagaccagagtgatgctgctgagctgaaccacaaggaggagcacagcctgcacgtgcaggaccccagcagcagcagcaagaaggacctgaagtctgctgtgctgtctgagaaggccggcttcaactatgagagccccagcaaaggaggcaacttccccagcttcccccatgatgaggtgacagacaggaacatgctggccttcagcagccctgctgctgggggcgtgtgtgagcccctgaagagcccccagagagctgaggctgatgacccccaggacatggcctgcacccccagcggggacagcctggagaccaaggaggaccagaagatgagccccaaggccacagaggagaccggccaggcccagagcggccaggccaactgccagggcctgagccctgtgtctgtggccagcaagaacccccaggtgcccagtgatggcggcgtgcggctgaacaagagcaagacagacctgctggtgaatgacaacccagaccctgcccccctgagccctgagctgcaggacttcaagtgcaacatctgtggctacggctactatggaaatgaccccacagacctgatcaagcacttcaggaagtaccacctgggcctgcacaacagaacccggcaggatgctgagctggacagcaagatcctggccctgcacaacatggtgcagttcagccacagcaaggacttccagaaggtgaacagatctgtgttcagcggcgtgctgcaggacatcaacagcagcaggcctgtgctgctgaatggcacctatgatgtgcaggtgaccagcggcggcaccttcatcggcattggaaggaagaccccagactgccagggcaacaccaagtacttccgctgcaagttctgcaacttcacctacatgggcaacagcagcacagagctggagcagcacttcctgcagacccaccccaacaagatcaaggccagcctgcccagcagcgaggtggccaagcccagcgagaagaacagcaacaagagcatcccagccctgcagagcagtgacagcggggacctgggcaagtggcaggacaagatcaccgtgaaggctggagatgacacccctgtgggctacagcgtgcccatcaagcccctggacagcagccggcagaatggaacagaggccaccagctactactggtgcaagttctgcagcttcagctgtgagagcagcagcagcctgaagctgctggagcactacggcaagcagcacggggctgtgcagagcggcggcctgaaccctgagctgaatgacaagctgagccggggcagcgtcatcaaccagaatgacctggccaagagcagcgagggggagaccatgaccaagacagacaagagcagcagcggggccaagaagaaggacttcagcagcaaaggagctgaggacaacatggtgaccagctacaactgccagttctgtgacttccgctacagcaagagccacggcccagatgtgattgtggtgggccccctgctgcggcactaccagcagctgcacaacatccacaagtgcaccatcaagcactgccccttctgcccccggggcctgtgcagccctgagaagcacctgggggagatcacctacccctttgcctgcaggaagagcaactgcagccactgtgccctgctgctgctgcacctgagccctggagctgctggcagcagccgggtgaagcaccagtgccaccagtgcagcttcaccaccccagatgtggatgtgctgctcttccactatgaatctgtgcatgagagccaggccagtgatgtgaagcaggaggccaaccacctgcagggcagtgatggccagcagagcgtgaaggagagcaaggagcacagctgcaccaagtgtgacttcatcacccaggtggaggaggagatcagccgccactaccgccgggcccacagctgctacaagtgccggcagtgcagcttcaccgctgctgacacccagagcctgctggagcacttcaacacagtgcactgccaggagcaggacatcaccacagccaatggagaggaggatggccacgccatcagcaccatcaaggaggagcccaagattgacttccgggtgtacaacctgctgaccccagacagcaagatgggagagcctgtgtctgagagcgtggtgaagcgggagaagctggaggagaaggatggcctgaaggagaaggtgtggacagagagcagcagtgatgacctgagaaatgtgacctggagaggagctgacatcctgcggggcagccccagctacacccaggccagcctgggcctgctgacccctgtgtctggcacccaggagcagaccaagaccctgcgggacagccccaacgtggaggccgcccacctggcccggcccatctacggcctggccgtggagaccaagggcttcctgcagggcgccccagctggaggagagaagagcggggccctgccccagcagtacccagccagcggggagaacaagagcaaggatgagagccagagcctgctgcggaggagaagaggcagcggggtcttctgtgccaactgcctgaccaccaagaccagcctgtggaggaagaatgccaacggcggctacgtgtgcaatgcctgtggcctgtaccagaagctgcacagcaccccccggcccctgaacatcatcaagcagaacaacggggagcagatcatcagaagaaggaccaggaagaggctgaaccctgaggccctgcaggccgagcagctgaacaagcagcagaggggcagcaatgaggagcaggtgaatggcagccccctggagcggcgctctgaggaccacctgacagagagccaccagcgggagatccccctgcccagcctgagcaaatatgaggcccagggcagcctgaccaagagccacagcgcccagcagcctgtgctggtgtcccagaccctggacatccacaagaggatgcagcccctgcacatccagatcaagagcccccaggagagcactggagaccccggcaacagcagctctgtgtctgagggcaagggcagcagcgagcggggcagccccatcgagaagtacatgaggcctgccaagcaccccaactacagccccccaggcagccccatcgagaagtaccagtaccccctgtttggcctgccctttgtgcacaatgacttccagagcgaggccgactggctgcgcttctggagcaagtacaagctgtctgtgcccggcaacccccactacctgagccacgtgcccggcctgcccaacccctgccagaactacgtgccctaccccaccttcaacctgcccccccacttctctgctgtgggcagtgacaatgacatccccctggacctggccatcaagcacagcaggcctggccccacagccaacggggccagcaaggagaagaccaaggccccacccaacgtgaagaatgaaggccccctgaatgtggtgaagacagagaaggtggacaggagcacccaggatgagctgagcaccaagtgtgtgcactgcggcatcgtgttcctggatgaggtgatgtatgccctgcacatgagctgccacggggacagcggccccttccagtgcagcatctgccagcacctgtgcacagacaagtatgacttcaccacccacatccagaggggcctgcacaggaacaatgcccaggtggagaagaatggcaagcccaaggagtag

SEQ ID NO: 174141 - DNA, 705 bp, Artificial Sequence
  Description of Artificial Sequence: Synthetic coding sequence
atgaggaagacccggctgtggggcctgctgtggatgctgtttgtgtctgagctgcgggccgccaccaagctgacagaggagaagtatgagctgaaggagggccagaccctggatgtgaagtgtgactacaccctggagaagtttgccagcagccagaaggcctggcagatcatcagagatggagagatgcccaagaccctggcctgcacagagcggcccagcaagaacagccaccctgtgcaggtgggccgcatcatcctggaggactaccatgaccacggcctgctgcgggtgaggatggtgaacctgcaggtggaggacagcggcctgtaccagtgtgtgatctaccagccccccaaggagccccacatgctgtttgaccgcatccggctggtggtgaccaagggcttcagcggcaccccaggcagcaatgaaaacagcacccagaatgtgtacaagatcccccccaccaccaccaaggccctgtgccccctgtacaccagccccaggacagtgacccaggccccacccaagagcacagcagatgtgtccaccccagacagcgagatcaacctgaccaacgtgacagacatcatccgggtgcctgtgttcaacatcgtcatcctgctggccggcggcttcctgagcaagagcctggtgttttctgtgctgtttgctgtgaccctgcggagctttgtgccctag

SEQ ID NO: 174142 - DNA, 453 bp, Artificial Sequence
  Description of Artificial Sequence: Synthetic coding sequence
atgaggaagacccggctgtggggcctgctgtggatgctgtttgtgtctgagctgcgggccgccaccaagctgacagaggagaagtatgagctgaaggagggccagaccctggatgtgaagtgtgactacaccctggagaagtttgccagcagccagaaggcctggcagatcatcagagatggagagatgcccaagaccctggcctgcacagagcggcccagcaagaacagccaccctgtgcaggtgggccgcatcatcctggaggactaccatgaccacggcctgctgcgggtgaggatggtgaacctgcaggtggaggacagcggcctgtaccagtgtgtgatctaccagccccccaaggagccccacatgctgtttgaccgcatccggctggtggtgaccaagggcttccgctgcagcaccctgtccttctcctggctggtggacagctag

SEQ ID NO: 174143 - DNA, 678 bp, Artificial Sequence
  Description of Artificial Sequence: Synthetic coding sequence
atgaggaagacccggctgtggggcctgctgtggatgctgtttgtgtctgagctgcgggccgccaccaagctgacagaggagaagtatgagctgaaggagggccagaccctggatgtgaagtgtgactacaccctggagaagtttgccagcagccagaaggcctggcagatcatcagagatggagagatgcccaagaccctggcctgcacagagcggcccagcaagaacagccaccctgtgcaggtgggccgcatcatcctggaggactaccatgaccacggcctgctgcgggtgaggatggtgaacctgcaggtggaggacagcggcctgtaccagtgtgtgatctaccagccccccaaggagccccacatgctgtttgaccgcatccggctggtggtgaccaagggcttcagcggcaccccaggcagcaatgaaaacagcacccagaatgtgtacaagatcccccccaccaccaccaaggccctgtgccccctgtacaccagccccaggacagtgacccaggccccacccaagagcacagcagatgtgtccaccccagacagcgagatcaacctgaccaacgtgacagacatcatccgctacagcttccaggtgcccggccccctggtgtggaccctgagccccctcttccccagcctgtgtgccgagaggatgtag

SEQ ID NO: 174144 - DNA, 501 bp, Artificial Sequence
  Description of Artificial Sequence: Synthetic coding sequence
atggagcccctgcggctgctgatcctgctgtttgtgacagagctgagcggggcccacaacaccaccgtcttccagggcgtggccggccagagcctgcaggtgtcctgcccctatgacagcatgaagcactggggccgcaggaaggcctggtgccggcagctgggggagaagggcccctgccagagggtggtgtccacccacaacctgtggctgctgtccttcctgcggcgctggaatggcagcacagccatcacagatgacaccctgggcggcaccctgaccatcaccctgaggaacctgcagccccatgatgctggcctgtaccagtgccagagcctgcacggcagcgaggccgacaccctgaggaaggtgctggtggaggtgctggccgaccccctggaccacagagatgctggggacctgtggttccctggagagagcgagagctttgaagatgcccacgtggagcacagcatcagcagagctgagagacatgtgtag

SEQ ID NO: 174145 - DNA, 693 bp, Artificial Sequence
  Description of Artificial Sequence: Synthetic coding sequence
atggagcccctgcggctgctgatcctgctgtttgtgacagagctgagcggggcccacaacaccaccgtcttccagggcgtggccggccagagcctgcaggtgtcctgcccctatgacagcatgaagcactggggccgcaggaaggcctggtgccggcagctgggggagaagggcccctgccagagggtggtgtccacccacaacctgtggctgctgtccttcctgcggcgctggaatggcagcacagccatcacagatgacaccctgggcggcaccctgaccatcaccctgaggaacctgcagccccatgatgctggcctgtaccagtgccagagcctgcacggcagcgaggccgacaccctgaggaaggtgctggtggaggtgctggccgaccccctggaccacagagatgctggggacctgtggttccctggagagagcgagagctttgaagatgcccacgtggagcacagcatcagccgcagcctgctggagggggagatccccttcccccccaccagcatcctgctgctgctggcctgcatcttcctgatcaagatcctggccgccagcgccctgtgggccgccgcctggcacggccagaagccaggcacccaccccccatctgagctggactgtggccatgaccccggctaccagctgcagaccctgcccggcctgcgggacacctag

SEQ ID NO: 174146 - DNA, 660 bp, Artificial Sequence
  Description of Artificial Sequence: Synthetic coding sequence
atggagcccctgcggctgctgatcctgctgtttgtgacagagctgagcggggcccacaacaccaccgtcttccagggcgtggccggccagagcctgcaggtgtcctgcccctatgacagcatgaagcactggggccgcaggaaggcctggtgccggcagctgggggagaagggcccctgccagagggtggtgtccacccacaacctgtggctgctgtccttcctgcggcgctggaatggcagcacagccatcacagatgacaccctgggcggcaccctgaccatcaccctgaggaacctgcagccccatgatgctggcctgtaccagtgccagagcctgcacggcagcgaggccgacaccctgaggaaggtgctggtggaggtgctggccgaccccctggaccacagagatgctggggacctgtggttccctggagagagcgagagctttgaagatgcccacgtggagcacagcatcagcagagctgagagacatgtgaaggaggatgatggcaggaagagccctggagaggtgcccccaggcaccagccctgcctgcatcctggccacctggcccccaggcctgctggtgctgctgtggcaggagaccaccctgcctgagcactgcttctcctggaccctggaggccggcaccggctag

SEQ ID NO: 174147 - DNA, 936 bp, Artificial Sequence
  Description of Artificial Sequence: Synthetic coding sequence
atgggcctgaccctgctgctgctgctgctgctgggcctggagggccagggcatcgtgggcagcctgcctgaggtgctgcaggcccctgtgggcagcagcatcctggtgcagtgccactaccgcctgcaggatgtgaaggcccagaaggtgtggtgccgcttcctgcctgagggctgccagcccctggtgtcctctgctgtggacagaagagccccagctggaagaaggaccttcctgacagacctgggcggcggcctgctgcaggtggagatggtgaccctgcaggaggaggatgctggggagtatggctgcatggtggatggagcccggggcccccagatcctgcaccgggtgtccctgaacatcctgcccccagaggaggaggaggagacccacaagattggcagcctggctgaaaatgccttcagtgaccctgctggcagcgccaaccccctggagcccagccaggatgagaagagcatccccctcatctggggcgctgtgctgctggtgggcctgctggtggccgctgtggtgctgtttgctgtgatggccaagaggaagcagggcaaccggctgggcgtgtgtggccgcttcctgagcagccgggtgtctggcatgaaccccagctctgtggtgcaccacgtgtctgattctggccctgctgctgagctgcccctggatgtgccccacatccggctggacagccccccatcctttgacaacaccacctacaccagcctgcccctggacagccccagcggcaagcccagcctgcctgcccccagcagcctgccccccctgccccccaaggtgctggtgtgcagcaagcctgtgacctacgccaccgtcatcttccctgggggcaacaagggcggcggcaccagctgtggccctgcccagaacccccccaacaaccagacccccagcagctag

SEQ ID NO: 174148 - DNA, 600 bp, Artificial Sequence
  Description of Artificial Sequence: Synthetic coding sequence
atgggcctgaccctgctgctgctgctgctgctgggcctggagggccagggcatcgtgggcagcctgcctgaggtgctgcaggcccctgtgggcagcagcatcctggtgcagtgccactaccgcctgcaggatgtgaaggcccagaaggtgtggtgccgcttcctgcctgagggctgccagcccctggtgtcctctgctgtggacagaagagccccagctggaagaaggaccttcctgacagacctgggcggcggcctgctgcaggtggagatggtgaccctgcaggaggaggatgctggggagtatggctgcatggtggatggagcccggggcccccagatcctgcaccgggtgtccctgaacatcctgcccccagaggaggaggaggagacccacaagattggcagcctggctgaaaatgccttcagtgaccctgctggcagcgccaaccccctggagcccagccaggatgagaagagcatccccctcatctggggcgctgtgctgctggtgggcctgctggtggccgctgtggtgctgtttgctgtgatggccaagaggaagcaggagagcctgctgagcggccccccccggcagtag

SEQ ID NO: 174149 - DNA, 603 bp, Artificial Sequence
  Description of Artificial Sequence: Synthetic coding sequence
atgggcctgaccctgctgctgctgctgctgctgggcctggaggaggaggaggaggagacccacaagattggcagcctggccgagaatgccttcagtgaccctgctggcagcgccaaccccctggagcccagccaggatgagaagagcatccccctcatctggggcgctgtgctgctggtgggcctgctggtggccgctgtggtgctgtttgctgtgatggccaagaggaagcagggcaaccggctgggcgtgtgtggccgcttcctgagcagccgggtgtctggcatgaaccccagctctgtggtgcaccacgtgtctgacagcggccctgctgctgagctgcccctggatgtgccccacatccggctggacagcccccccagctttgacaacaccacctacaccagcctgcccctggacagccccagcggcaagcccagcctgcctgcccccagcagcctgccccccctgccccccaaggtgctggtgtgcagcaagcctgtgacctacgccaccgtcatcttccctgggggcaacaagggcggcggcaccagctgtggccctgcccagaacccccccaacaaccagacccccagcagctag

SEQ ID NO: 174150 - DNA, 966 bp, Artificial Sequence
  Description of Artificial Sequence: Synthetic coding sequence
atggccccagccttcctgctgctgctgctgctgtggccccagggctgtgtgtctggccccagcgctgacagcgtgtacaccaaggtgcggctgctggagggggagaccctgtctgtgcagtgcagctacaagggctacaagaacagagtggagggcaaggtgtggtgcaagatcaggaagaagaagtgtgagcccggctttgcccgggtgtgggtgaagggcccccgctacctgctgcaggatgatgcccaggccaaggtggtgaacatcaccatggtggccctgaagctgcaggacagcggccgctactggtgcatgaggaacaccagcggcatcctgtaccccctgatgggcttccagctggatgtgtccccagccccccagacagaaagaaacatccccttcacccacctggacaacatcctgaagagcggcaccgtgaccaccggccaggcccccaccagcggcccagatgcccccttcaccactggagtgatggtgttcaccccaggcctcatcaccctgccccggctgctggccagcaccaggcctgccagcaagacaggctacagcttcaccgccaccagcaccaccagccagggccccaggaggaccatgggcagccagacagtgacagccagccccagcaatgcccgggacagcagcgctggccctgagagcatcagcaccaagagcggggacctgagcaccaggagccccaccaccggcctgtgcctgaccagccgcagcctgctgaaccggctgcccagcatgcccagcatccgccaccaggatgtgtacagcacagtgctgggcgtggtgctgaccctgctggtgctgatgctgatcatggtgtatggcttctggaagaagaggcacatggccagctacagcatgtgcagcgaccccagcacccgggaccccccaggccggcctgagccctacgtggaggtgtacctgatctag

SEQ ID NO: 174151 - DNA, 2562 bp, Artificial Sequence
  Description of Artificial Sequence: Synthetic coding sequence
atgtgctgtgagaagtggagccgggtggccgagatgttcctgttcatcgaggagcgggaggactgcaagatcctgtgcctgtgcagccgggcctttgtggaggacaggaagctgtacaacctgggcctgaagggctactacatccgggacagcggcaacaacagcggggaccaggccacagaggaggaggagggcggctacagctgtggcacagctgagagccatgacagcaagggcatcggcctggatgaaagtgagctggacagcgaggccgagctgatgaggtccatgggcctgcccctgcagtttggccgcatcacagcccacaaggactttgaggtgtccatgaacaccaggaacaaggtgaagatcaagaagaagaagcaccagaagaagtacctggatgaaattgtgcaggagagctggaggaaggagtatgaggaggatgacatcctggccagtgatgaccccagcagcattgagcagtatgagaacaccaggacctatgagctgcagagcaagaaggacacagaaacagagaacccccctgtggagaacaccctgagccccaagctggagatcacagagaagtgggagaagtactggaatgaatatggaggcggcctgctgtggcagagctggcaggagaagcaccctggccaggccctgagcagcgagccctggaacttcccagacaccaaggaggagtgggagcagcactacagccagctgtactggtactacctggagcagttccagtactgggaggcccagggctggacctttgatgccagccagagctgtgacacagacacctacaccagcaagacagaagcagatgacaagaatgatgagaagtgcatgaaggtggacctggtgtccttccccagcagccccatcatggtggacaatgacagcagcggcaccagtgacaaggaccacagcgagatcctggatggcatcagcaacatcaagctgaacagcgaggaggtgacccagagccagctggacagctgcaccagccatgatggccaccagcagctgtctgaggtgagcagcaagcgggagtgcccagccagcggccagagcgagcccagaaatggaggcaccaatgaggagagcaacagcagcggcaacaccaacacagaccccccagctgaggacagccagaagagcagcggggccaacaccagcaaggaccggccccacgccagcggcacagatggagatgagagcgaggaggaccccccagagcacaagcccagcaagctgaagaggagccatgagctggacattgatgagaacccagccagtgactttgatgattctggcagcctgctgggcttcaagtatggcagcggccagaagtatggaggcatccccaacttcagccaccggcaggtgcgctacctggagaagaatgtgaagctgaagagcaagtacctggacatgaggcggcagatcaagatgaagaacaagcacatcttcttcaccaaggagagcgagaagcccttcttcaagaagagcaagatcctgagcaaggtggagaagttcctgacctgggtgaacaagcccatggatgaggaggccagccaggagagcagcagccatgacaacgtgcatgatgccagcaccagcagtgacagcgaggagcaggacatgtctgtgaagaagggagatgacctgctggagaccaacaaccctgagcctgagaagtgccagagcgtgagcagcgctggggagctggagacagaaaattatgagcgggacagcctgctggccaccgtgcctgatgagcaggactgtgtgacccaggaggtgcctgacagccggcaggccgagacagaagctgaggtgaagaagaagaagaacaagaagaagaacaagaaggtgaatggcctgcccccagaaattgctgctgtgcctgagctggccaagtactgggcccagcgctaccgcctcttcagcagatttgatgatggcatcaagctggaccgggagggctggttctctgtgaccccagagaagattgctgagcacatcgccggccgggtgtcccagagcttcaagtgtgatgtggtggtggatgccttctgtggggtgggcggcaacaccatccagtttgccctgaccggcatgagggtcatcgccatcgacatcgaccctgtgaagatcgccctggccagaaataatgctgaggtgtatggaattgctgacaagattgagttcatctgtggggacttcctgctgctggccagcttcctgaaggcagatgtggtgttcctgagccccccctggggcggccctgactatgccacagctgagacctttgacatccgcaccatgatgagcccagatggctttgagatcttccggctgagcaagaagatcaccaacaacatcgtgtacttcctgcccagaaatgctgacatcgaccaggtggccagcctggccggccctgggggccaggtggagattgagcagaacttcctgaacaacaagctgaagaccatcacagcctactttggagacctgatcagaagacctgccagcgagacctag

SEQ ID NO: 174152 - DNA, 1266 bp, Artificial Sequence
  Description of Artificial Sequence: Synthetic coding sequence
atgtggtaccaccggctgagccacctgcacagccggctgcaggacctgctgaagggcggcgtcatctacccagccctgccccagcccaacttcaagagcctgctgcccctggccgtgcactggcaccacacagccagcaagagcctgacctgtgcctggcagcagcacgaggaccactttgagctgaagtatgccaacacagtgatgagatttgattatgtgtggctgcgggaccactgccgcagcgccagctgctacaacagcaagacccaccagaggagcctggacacagcctctgtggacctgtgcatcaagcccaagaccatccggctggatgagaccaccctcttcttcacctggccagatggccacgtgaccaagtatgacctgaactggctggtgaagaacagctatgagggccagaagcagaaggtgatccagccccgcatcctgtggaatgctgagatctaccagcaggcccaggtgcccagcgtggactgccagagcttcctggagaccaatgaaggcctgaagaagttcctgcagaacttcctgctgtatggaattgcctttgtggagaatgtgccccccacccaggagcacacagagaagctggccgagcgcatcagcctcatccgggagaccatctacggccgcatgtggtacttcaccagtgacttcagcagaggagacacagcctacaccaagctggccctggacagacacacagacaccacctacttccaggagccctgtggcatccaggtgttccactgcctgaagcatgagggcactggaggccgcaccctgctggtggatggcttctatgctgctgagcaggtgctgcagaaggcccctgaggagtttgagctgctgagcaaggtgcccctgaagcatgagtacattgaagatgtgggggagtgccacaaccacatgattggaattggccctgtgctgaacatctacccctggaacaaggagctgtacctgatccgctacaacaactatgacagagctgtgatcaacacagtgccctatgatgtggtgcaccgctggtacacagcccacaggaccctgaccatcgagctgcggcggccagaaaatgagttctgggtgaagctgaagccaggccgggtgctcttcatcgacaactggagggtgctgcacggccgggagtgcttcaccggctaccggcagctgtgtggctgctacctgaccagagatgatgtgctgaacacagcccggctgctgggcctgcaggcctag

SEQ ID NO: 174153 - DNA, 1131 bp, Artificial Sequence
  Description of Artificial Sequence: Synthetic coding sequence
atgtggtaccaccggctgagccacctgcacagccggctgcaggacctgctgaagggcggcgtcatctacccagccctgccccagcccaacttcaagagcctgctgcccctggccgtgcactggcaccacacagccagcaagagcctgacctgtgcctggcagcagcacgaggaccactttgagctgaagtatgccaacacagtgatgagatttgattatgtgtggctgcgggaccactgccgcagcgccagctgctacaacagcaagacccaccagaggagcctggacacagcctctgtggacctgtgcatcaagcccaagaccatccggctggatgagaccaccctcttcttcacctggccagatggccacgtgaccaagtatgacctgaactggctggtgaagaacagctatgagggccagaagcagaaggtgatccagccccgcatcctgtggaatgctgagatctaccagcaggcccaggtgcccagcgtggactgccagagcttcctggagaccaatgaaggcctgaagaagttcctgcagaacttcctgctgtatggaattgcctttgtggagaatgtgccccccacccaggagcacacagagaagctggccgagcgcatcagcctcatccgggagaccatctacggccgcatgtggtacttcaccagtgacttcagcagaggagacacagcctacaccaagctggccctggacagacacacagacaccacctacttccaggagccctgtggcatccaggtgttccactgcctgaagcatgagggcactggaggccgcaccctgctggtggatggcttctatgctgctgagcaggtgctgcagaaggcccctgaggagtttgagctgctgagcaaggtgcccctgaagcatgagtacattgaagatgtgggggagtgccacaaccacatgattggaattggccctgtgctgaacatctacccctggaacaaggagctgtacctgatccgcctcttcaaggagaagcagaacacagtgaaccggcagtggaacagcagcctgcagtgtgacatccctgagcgcatcctgacctaccgccactttgtgtctggcaccagcattgagcaccggggcagcctcatctag

SEQ ID NO: 174154 - DNA, 5889 bp, Artificial Sequence
  Description of Artificial Sequence: Synthetic coding sequence
atgagggagctggaggccaaggccaccaaggatgtggagaggaacctgagccgggacctggtgcaggaggaggagcagctgatggaggagaagaagaagaagaaggatgacaagaagaagaaggaggccgcccagaagaaggccacagagcagaagatcaaggtgcctgagcagatcaagcccagcgtgtcccagccccagcctgccaacagcaacaacggcaccagcacagccaccagcaccaacaacaatgccaagagggccacagccaacaaccagcagccccagcagcagcagcagcagcagcagccccagcagcagcagccccagcagcagccccagccccagccccagcagcagcagccccagcagcagccccaggccctgccccgctacccccgggaggtgcccccacgcttccgccaccaggagcacaagcagctgctgaagaggggccagcacttccctgtgattgctgccaacctgggcagcgctgtgaaggtgctgaacagccagagcgagagcagcgccctgaccaaccagcagccccagaacaacggggaggtgcagaacagcaagaaccagagcgacatcaaccacagcaccagcggcagccactatgagaacagccagaggggccctgtgagcagcaccagtgacagcagcaccaactgcaagaatgctgtggtgtctgacctgtctgagaaggaggcctggcccagcgcccctggcagtgaccctgagctggccagcgagtgcatggatgctgacagcgccagcagcagcgagagcgagaggaacatcaccatcatggccagcggcaacacaggaggagagaaggatggcctgaggaacagcacaggcctgggcagccagaacaagtttgtggtgggcagcagcagcaacaacgtgggccacggcagcagcacaggcccctggggcttcagccatggagccatcatcagcacctgccaggtgtctgtggatgcccctgagagcaagtctgagagcagcaacaacaggatgaatgcctggggcaccgtgagcagcagcagcaatggaggcctgaaccccagcaccctgaacagcgccagcaaccacggggcctggcctgtgctggagaacaacggcctggccctgaagggccctgtgggcagcggcagcagcggcatcaacatccagtgcagcaccatcggccagatgcccaacaaccagagcatcaacagcaaggtgtctgggggcagcacccacggcacctggggcagcctgcaggagacctgtgagagcgaggtgtctggcacccagaaggtgtccttcagcggccagccccagaacatcaccacagagatgacaggccccaacaacaccaccaacttcatgaccagcagcctgcccaacagcggctctgtgcagaacaatgagctgcccagcagcaacacaggagcctggagggtgtccaccatgaaccacccccagatgcaggcccccagcggcatgaatggcaccagcctgagccacctgagcaatggagagagcaagagcggcggcagctatggcaccacctggggcgcctacggcagcaactacagcggggacaagtgcagcggccccaacggccaggccaacggggacacagtgaatgccaccctgatgcagcccggggtgaatggccccatgggcaccaacttccaggtgaacaccaacaagggcggcggcgtgtgggagagcggggccgccaacagccagagcacctcctggggcagcggaaatggagccaacagcggcggcagccggcggggctggggcaccccagcccagaacacaggcaccaacctgcccagcgtggagtggaacaagctgcccagcaaccagcacagcaatgattctgccaatggaaatggcaagaccttcaccaacggctggaagagcacagaggaggaggaccagggcagcgccaccagccagaccaatgagcagagctctgtgtgggccaagacaggaggcaccgtggagagtgatggcagcacagagagcacaggccgcctggaggagaagggcactggagagagccagagccgggacaggaggaagattgaccagcacaccctgctgcagagcatcgtgaacagaacagacctggacccccgggtgctgagcaacagcggctggggccagacccccatcaagcagaacacagcctgggacacagagaccagccccagaggagagaggaagacagacaatggaacagaggcctggggcagcagcgccacccagaccttcaacagcggggcctgcatcgacaagaccagccccaatggaaatgacaccagctctgtgtctggctggggagaccccaagccagccctgcgctggggagacagcaagggcagcaactgccagggcggctgggaggatgacagcgctgccaccggcatggtgaagagcaaccagtggggcaactgcaaggaggagaaggccgcctggaatgacagccagaagaacaagcagggctggggagatggccagaagagcagccagggctggagcgtgtctgccagtgacaactggggcgagaccagcaggaacaaccactggggcgaggccaacaagaagagcagcagcggcggcagtgacagcgacagatctgtgtctggctggaatgagctgggcaagaccagcagcttcacctggggcaacaacatcaaccccaacaacagcagcggctgggatgagagcagcaagcccacccccagccagggctggggagacccccccaagagcaaccagagcctgggctggggagacagcagcaagcctgtgagcagcccagactggaacaagcagcaggacatcgtgggctcctggggcatccccccagccaccgggaagcccccaggcaccggctggctgggcggccccatcccagccccagccaaggaggaggagcccaccggctgggaggagcccagccctgagagcatccggaggaagatggagattgatgatggcaccagcgcctggggagaccccagcaagtacaactacaagaatgtgaacatgtggaacaagaatgtgcccaacggcaacagcagaagtgaccagcaggcccaggtgcaccagctgctgaccccagccagcgccatcagcaacaaggaggccagcagcggcagcggctggggcgagccctggggcgagcccagcaccccagccaccaccgtggacaatggcaccagcgcctggggcaagcccattgattctggccccagctggggcgagcccatcgctgctgccagcagcaccagcacctggggcagcagctctgtgggcccccaggccctgagcaagagcggccccaagtccatgcaggacggctggtgtggagatgacatgcccctgcccggcaaccggcccaccggctgggaggaggaggaggatgtggagatcggcatgtggaacagcaacagcagccaggagctgaacagcagcctgaactggccaccctacaccaagaagatgagcagcaagggcctgagcggcaagaagagaagaagagagcggggcatgatgaagggcggcaacaagcaggaggaggcctggatcaacccctttgtgaagcagttcagcaacatctccttcagccgggacagccctgaggagaatgtgcagagcaacaagatggacctgagcggcggcatgctgcaggacaagaggatggagattgacaagcacagcctgaacatcggggactacaacagaacagtgggcaaaggacctggcagccggccccagatcagcaaggagagctccatggagaggaacccctactttgacaaggatggcatcgtggctgatgagagccagaacatgcagttcatgagcagccagagcatgaagctgccccccagcaacagcgccctgcccaaccaggccctgggcagcattgctggcctgggcatgcagaacctgaacagcgtgcggcagaatggaaaccccagcatgtttggagtgggcaacacagctgcccagccccggggcatgcagcagcccccagcccagcccctgagcagcagccagcccaacctgcgggcccaggtgcccccacccctgctgagcccccaggtgcctgtgtccctgctgaagtatgcccccaacaacggcggcctgaaccccctgtttggcccccagcaggtggccatgctgaaccagctgagccagctgaaccagctgagccagatcagccagctgcagaggctgctggcccagcagcagagggcccagagccagaggtctgtgcccagcggcaaccggccccagcaggaccagcagggccggcccctgtctgtgcagcagcagatgatgcagcagagccggcagctggaccccaacctgctggtgaagcagcagaccccacccagccagcagcagcccctgcaccagcctgccatgaagagcttcctggacaacgtgatgccccacaccaccccagagctgcagaagggccccagccccatcaatgccttcagcaacttccccatcggcctgaacagcaacctgaatgtgaacatggacatgaacagcatcaaggagccccagagccggctgaggaagtggaccaccgtggacagcatctctgtgaacaccagcctggaccagaacagcagcaagcatggagccatcagcagcggcttccggctggaggagagcccctttgtgccctatgacttcatgaacagcagcaccagccctgccagccccccaggcagcattggagatggctggccccgggccaagagccccaacggcagcagctctgtgaactggcccccagagttccggcctggagagccctggaagggctaccccaacatcgaccctgagacagacccctacgtgaccccaggcagcgtcatcaacaacctgagcatcaacacagtgcgggaggtggaccacctgcgggacagaaattctggcagcagcagcagcctgaacaccaccctgcccagcaccagcgcctggagcagcatccgggccagcaactacaacgtgcccctgagcagcacagcccagagcaccagcgccaggaacagcgacagcaagctgacctggagccctggctctgtgaccaacaccagcctggcccacgagctgtggaaggtgcccctgccccccaagaacatcacagcccccagcaggcctcctcctggcctgaccggccagaagccacccctgagcacctgggacaacagccccctgcgcatcggcggcggctggggcaacagtgatgcccgctacaccccaggcagctcctggggcgagagcagcagcggccgcatcaccaactggctggtgctgaagaacctgaccccccagattgatggcagcaccctgcggaccctgtgcatgcagcacggccccctcatcaccttccacctgaacctgccccacggcaatgccctggtgcgctacagcagcaaggaggaggtggtgaaggcccagaagagcctgcacatgtgtgtgctgggcaacaccaccatcctggccgagtttgccagcgaggaggagatcagccgcttctttgcccagagccagagcctgacccccagccctggctggcagagcctgggcagcagccagagccggctgggcagcctggactgcagccacagcttcagcagcaggacagacctgaaccactggaatggagctggcctgagcggcaccaactgtggggacctgcacggcaccagcctgtggggcaccccccactacagcaccagcctgtggggcccccccagcagcagtgacccccggggcatcagcagccccagccccatcaatgccttcctgtctgtggaccacctgggcggcggcggggagagcatgtag

SEQ ID NO: 174155 - DNA, 1323 bp, Artificial Sequence
  Description of Artificial Sequence: Synthetic coding sequence
atggacatgaacagcatcaaggagccccagagccggctgaggaagtggaccaccgtggacagcatctctgtgaacaccagcctggaccagaacagcagcaagcatggagccatcagcagcggcttccggctggaggagagcccctttgtgccctatgacttcatgaacagcagcaccagccctgccagccccccaggcagcattggagatggctggccccgggccaagagccccaacggcagcagctctgtgaactggcccccagagttccggcctggagagccctggaagggctaccccaacatcgaccctgagacagacccctacgtgaccccaggcagcgtcatcaacaacctgagcatcaacacagtgcgggaggtggaccacctgcgggacagaaattctggcagcagcagcagcctgaacaccaccctgcccagcaccagcgcctggagcagcatccgggccagcaactacaacgtgcccctgagcagcacagcccagagcaccagcgccaggaacagcgacagcaagctgacctggagccctggctctgtgaccaacaccagcctggcccacgagctgtggaaggtgcccctgccccccaagaacatcacagcccccagcaggcctcctcctggcctgaccggccagaagccacccctgagcacctgggacaacagccccctgcgcatcggcggcggctggggcaacagtgatgcccgctacaccccaggcagctcctggggcgagagcagcagcggccgcatcaccaactggctggtgctgaagaacctgaccccccagattgatggcagcaccctgcggaccctgtgcatgcagcacggccccctcatcaccttccacctgaacctgccccacggcaatgccctggtgcgctacagcagcaaggaggaggtggtgaaggcccagaagagcctgcacatgtgtgtgctgggcaacaccaccatcctggccgagtttgccagcgaggaggagatcagccgcttctttgcccagagccagagcctgacccccagccctggctggcagagcctgggcagcagccagagccggctgggcagcctggactgcagccacagcttcagcagcaggacagacctgaaccactggaatggagctggcctgagcggcaccaactgtggggacctgcacggcaccagcctgtggggcaccccccactacagcaccagcctgtggggcccccccagcagcagtgacccccggggcatcagcagccccagccccatcaatgccttcctgtctgtggaccacctgggcggcggcggggagagcatgtag

SEQ ID NO: 174156 - DNA, 5073 bp, Artificial Sequence
  Description of Artificial Sequence: Synthetic coding sequence
atggccactggaagtgcccagggcaacttcaccggccacaccaagaagaccaacggcaacaacggcaccaacggggccctggtgcagagccccagcaaccagagcgccctgggcgccggcggggccaacagcaatggatctgctgcccgggtgtggggcgtggccaccggcagcagcagcggcctggcccactgcagcgtgtctggaggagatggcaagatggacaccatgattggagatggccgcagccagaactgctggggcgccagcaacagcaatgccggcatcaacctgaacctgaaccccaatgccaacccagctgcctggcctgtgctgggccacgagggcaccgtggccaccggcaaccccagcagcatctgcagccctgtgtctgccatcggccagaacatgggcaaccagaatggaaaccccaccggcaccctgggcgcctggggcaacctgctgccccaggagagcacagagccccagaccagcaccagccagaatgtgtccttcagcgcccagccccagaacctgaacacagatggccccaacaacaccaaccccatgaacagcagccccaaccccatcaatgccatgcagaccaacggcctgcccaactggggcatggctgtgggcatgggcgccatcatccccccccacctgcagggcctgcccggggccaacggcagctctgtgtcccaggtgtctgggggcagcgctgagggcatcagcaacagcgtgtggggcctgagccctggcaacccagccaccggcaacagcaacagcggcttcagccagggcaatggagacacagtgaacagcgccctgagcgccaagcagaatggcagcagcagcgctgtgcagaaggagggcagcggcggcaatgcctgggacagcggccccccagctggccctggcatcctggcctggggccggggcagcggcaacaacggggtgggcaacatccacagcggggcctggggccaccccagccgcagcaccagcaatggagtgaatggagagtggggcaagccacccaaccagcacagcaacagcgacatcaacgggaagggcagcacaggctgggagagccccagcgtgaccagccagaaccccaccgtgcagcctggaggagagcacatgaacagctgggccaaggccgccagcagcggcaccacagccagcgagggcagcagtgatggcagcggcaaccacaatgaaggcagcacaggccgggagggcaccggggagggcagaagaagagacaagggcatcatcgaccagggccacatccagctgcccagaaatgacctggacccccgggtgctgagcaacacaggctggggccagacccctgtgaagcagaacacagcctgggagtttgaggagagccccaggtctgagaggaagaatgacaatggaacagaggcctggggctgtgccgccacccaggccagcaacagcggcggcaagaatgatggcagcatcatgaacagcaccaacaccagctctgtgtctggctgggtgaatgcccctcctgctgctgtgcctgccaacacaggctggggagacagcaacaacaaggcccccagcggccctggggtgtggggagacagcatcagcagcacagctgtgtccacagctgctgctgccaagagcggccacgcctggagcggggccgccaaccaggaggacaagagccccacctggggcgagccccccaagcccaagagccagcactggggagatggccagaggagcaacccagcctggagcgctgggggcggggactgggccgacagcagctctgtgctgggccacctgggagatggcaagaagaatggaagtggctgggatgctgacagcaacagaagtggcagcggctggaatgacaccaccaggagcggcaacagcggctggggcaacagcaccaacaccaaggccaaccctggcaccaactggggcgagaccctgaagccaggcccccagcagaactgggccagcaagccccaggacaacaacgtgagcaactggggcggggccgcctctgtgaagcagacaggcaccggctggattggaggccctgtgcctgtgaagcagaaggacagcagcgaggccaccggctgggaggagcccagccccccatccatccggaggaagatggagattgatgatggcaccagcgcctggggagaccccagcaactacaacaacaagacagtgaacatgtgggacaggaacaaccctgtgatccagagcagcaccaccaccaacaccaccaccaccaccaccaccaccaccagcaacaccacccaccgggtggagaccccaccaccccaccaggccggcacccagctgaacagaagccccctgctgggccctggcaggaaggtgagcagcggctggggcgagatgcccaacgtgcacagcaagacagagaacagctggggcgagcccagcagccccagcaccctggtggacaatggaacagctgcctggggcaagccacccagcagcggcagcggctggggagaccaccctgctgagccccctgtggccttcggccgggccggggcccctgtggccgccagcgccctgtgcaagccagccagcaagtccatgcaggagggctggggcagcggaggagatgagatgaacctgagcaccagccagtgggaggatgaggagggagatgtgtggaacaatgctgccagccaggagagcaccagcagctgcagctcctggggcaatgcccccaagaagggcctgcagaagggcatgaagaccagcggcaagcaggatgaggcctggatcatgagccgcctcatcaagcagctgacagacatgggcttcccccgggagcctgctgaggaggccctgaagagcaacaacatgaacctggaccaggccatgtctgccctgctggagaagaaggtggatgtggacaagaggggcctgggcgtgacagaccacaacggcatggccgccaagcccctgggctgccggccccccatcagcaaggagagctctgtggaccggcccaccttcctggacaaggatggcggcctggtggaggagcccacccccagccccttcctgcccagccccagcctgaagctgcccctgagccacagcgccctgcccagccaggccctgggcggcatcgccagcggcctgggcatgcagaacctgaacagcagccggcagatccccagcggcaacctgggcatgtttggaaacagcggggccgcccaggcccggaccatgcagcagcccccccagccccctgtgcagcccctgaacagcagccagcccagcctgcgggcccaggtgccccagttcctgagcccccaggtgcaggcccagctgctgcagtttgctgccaagaacatcggcctgaacccagccctgctgaccagccccatcaacccccagcacatgaccatgctgaaccagctgtaccagctgcagctggcctaccagaggctgcagatccagcagcagatgctgcaggcccagagaaatgtgtctggctccatgaggcagcaggagcagcaggtggcccggaccatcaccaacctgcagcagcagatccagcagcaccagaggcagctggcccaggccctgctggtgaagcagcccccacctcctcctcctccaccccacctgagcctgcaccccagcgctgggaagagcgccatggacagcttccccagccacccccagaccccaggcctgcctgacctgcagaccaaggagcagcagagcagccccaacacctttgccccctaccccctggccggcctgaaccccaacatgaatgtgaacagcatggacatgactggaggcctgtctgtgaaggaccccagccagagccagagccggctgccccagtggacccaccccaacagcatggacaacctgcccagcgctgccagccccctggagcagaaccccagcaagcatggagccatccctgggggcctgagcatcggccccccaggcaagagcagcattgatgacagctatggccgctatgacctgatccagaacagcgagagccctgccagcccccctgtggccgtgccccacagctggagccgggccaagagtgacagcgacaagatcagcaatggcagcagcatcaactggcccccagagttccaccctggggtgccctggaagggcctgcagaacattgatcctgaaaatgaccctgatgtgaccccaggctctgtgcccaccggccccaccatcaacaccaccatccaggatgtgaaccgctacctgctgaagagcggcggcaagctgagtgacatcaagagcacctggagcagcggccccaccagccacacccaggccagcctgagccatgagctgtggaaggtgcccaggaacagcacagcccccacccggcccccacctggcctgaccaaccccaagcccagcagcacctggggcgccagccccctgggctggaccagcagctacagcagcggcagcgcctggagcacagacaccagcggccgcaccagctcctggctggtgctgaggaacctgaccccccagattgatggcagcaccctgcggaccctgtgcctgcagcacggccccctcatcaccttccacctgaacctgacccagggcaatgctgtggtgcgctacagcagcaaggaggaggccgccaaggcccagaagagcctgcacatgtgtgtgctgggcaacaccaccatcctggccgagtttgctggggaggaggaggtgaaccgcttcctggcccagggccaggccctgccccccaccagctcctggcagagcagcagcgccagcagccagccccggctgtctgctgctggcagcagccacggcctggtgcggagtgatgctggccactggaatgccccctgcctgggcggcaagggcagcagcgagctgctgtggggcggcgtgccccagtacagcagcagcctgtggggccccccatctgcagatgacagcagggtcatcggcagccccacccccctgaccaccctgctgcccggggacctgctgagcggggagagcctgtag

SEQ ID NO: 174157 - DNA, 5181 bp, Artificial Sequence
  Description of Artificial Sequence: Synthetic coding sequence
atggccactggaagtgcccagggcaacttcaccggccacaccaagaagaccaacggcaacaacggcaccaacggggccctggtgcagagccccagcaaccagagcgccctgggcgccggcggggccaacagcaatggatctgctgcccgggtgtggggcgtggccaccggcagcagcagcggcctggcccactgcagcgtgtctggaggagatggcaagatggacaccatgattggagatggccgcagccagaactgctggggcgccagcaacagcaatgccggcatcaacctgaacctgaaccccaatgccaacccagctgcctggcctgtgctgggccacgagggcaccgtggccaccggcaaccccagcagcatctgcagccctgtgtctgccatcggccagaacatgggcaaccagaatggaaaccccaccggcaccctgggcgcctggggcaacctgctgccccaggagagcacagagccccagaccagcaccagccagaatgtgtccttcagcgcccagccccagaacctgaacacagatggccccaacaacaccaaccccatgaacagcagccccaaccccatcaatgccatgcagaccaacggcctgcccaactggggcatggctgtgggcatgggcgccatcatccccccccacctgcagggcctgcccggggccaacggcagctctgtgtcccaggtgtctgggggcagcgctgagggcatcagcaacagcgtgtggggcctgagccctggcaacccagccaccggcaacagcaacagcggcttcagccagggcaatggagacacagtgaacagcgccctgagcgccaagcagaatggcagcagcagcgctgtgcagaaggagggcagcggcggcaatgcctgggacagcggccccccagctggccctggcatcctggcctggggccggggcagcggcaacaacggggtgggcaacatccacagcggggcctggggccaccccagccgcagcaccagcaatggagtgaatggagagtggggcaagccacccaaccagcacagcaacagcgacatcaacgggaagggcagcacaggctgggagagccccagcgtgaccagccagaaccccaccgtgcagcctggaggagagcacatgaacagctgggccaaggccgccagcagcggcaccacagccagcgagggcagcagtgatggcagcggcaaccacaatgaaggcagcacaggccgggagggcaccggggagggcagaagaagagacaagggcatcatcgaccagggccacatccagctgcccagaaatgacctggacccccgggtgctgagcaacacaggctggggccagacccctgtgaagcagaacacagcctgggagtttgaggagagccccaggtctgagaggaagaatgacaatggaacagaggcctggggctgtgccgccacccaggccagcaacagcggcggcaagaatgatggcagcatcatgaacagcaccaacaccagctctgtgtctggctgggtgaatgcccctcctgctgctgtgcctgccaacacaggctggggagacagcaacaacaaggcccccagcggccctggggtgtggggagacagcatcagcagcacagctgtgtccacagctgctgctgccaagagcggccacgcctggagcggggccgccaaccaggaggacaagagccccacctggggcgagccccccaagcccaagagccagcactggggagatggccagaggagcaacccagcctggagcgctgggggcggggactgggccgacagcagctctgtgctgggccacctgggagatggcaagaagaatggaagtggctgggatgctgacagcaacagaagtggcagcggctggaatgacaccaccaggagcggcaacagcggctggggcaacagcaccaacaccaaggccaaccctggcaccaactggggcgagaccctgaagccaggcccccagcagaactgggccagcaagccccaggacaacaacgtgagcaactggggcggggccgcctctgtgaagcagacaggcaccggctggattggaggccctgtgcctgtgaagcagaaggacagcagcgaggccaccggctgggaggagcccagccccccatccatccggaggaagatggagattgatgatggcaccagcgcctggggagaccccagcaactacaacaacaagacagtgaacatgtgggacaggaacaaccctgtgatccagagcagcaccaccaccaacaccaccaccaccaccaccaccaccaccagcaacaccacccaccgggtggagaccccaccaccccaccaggccggcacccagctgaacagaagccccctgctgggccctgtgagcagcggctggggcgagatgcccaacgtgcacagcaagacagaaaattcctggggcgagcccagcagccccagcaccctggtggacaatggaacagctgcctggggcaagccacccagcagcggcagcggctggggagaccaccctgctgagccccctgtggccttcggccgggccggggcccctgtggccgccagcgccctgtgcaagccagccagcaagtccatgcaggagggctggggcagcggaggagatgagatgaacctgagcaccagccagtgggaggatgaggagggagatgtgtggaacaatgctgccagccaggagagcaccagcagctgcagctcctggggcaatgcccccaagaagggcctgcagaagggcatgaagaccagcggcaagcaggatgaggcctggatcatgagccgcctcatcaagcagctgacagacatgggcttcccccgggagcctgctgaggaggccctgaagagcaacaacatgaacctggaccaggccatgtctgccctgctggagaagaaggtggatgtggacaagaggggcctgggcgtgacagaccacaacggcatggccgccaagcccctgggctgcaggcctcccatcagcaaggagagctctgtggaccggcccaccttcctggacaaggatggcggcctggtggaggagcccacccccagccccttcctgcccagccccagcctgaagctgcccctgagccacagcgccctgcccagccaggccctgggcggcatcgccagcggcctgggcatgcagaacctgaacagcagccggcagatccccagcggcaacctgggcatgtttggaaattctggagctgcccaggcccggaccatgcagcagcccccccagccccctgtgcagcccctgaacagcagccagcccagcctgcgggcccaggtgccccagttcctgagcccccaggtgcaggcccagctgctgcagtttgctgccaagaacatcggcctgaacccagccctgctgaccagccccatcaacccccagcacatgaccatgctgaaccagctgtaccagctgcagctggcctaccagaggctgcagatccagcagcagatgctgcaggcccagagaaatgtgtctggctccatgaggcagcaggagcagcaggtggcccggaccatcaccaacctgcagcagcagatccagcagcaccagaggcagctggcccaggccctgctggtgaagcagcccccacctcctcctcctccaccccacctgagcctgcaccccagcgctgggaagagcgccatggacagcttccccagccacccccagaccccaggcctgcctgacctgcagaccaaggagcagcagagcagccccaacacctttgccccctaccccctggccggcctgaaccccaacatgaatgtgaacagcatggacatgactggaggcctgtctgtgaaggaccccagccagagccagagccggctgccccagtggacccaccccaacagcatggacaacctgcccagcgctgccagccccctggagcagaaccccagcaagcacggggccatccctgggggcctgagcatcggccccccaggcaagagcagcattgatgacagctatggccgctatgacctgatccagaacagcgagagccctgccagcccccctgtggccgtgccccacagctggagccgggccaagagtgacagcgacaagatcagcaatggcagcagcatcaactggcccccagagttccaccctggggtgccctggaagggcctgcagaacatcgaccctgaaaatgaccctgatgtgaccccaggctctgtgcccaccggccccaccatcaacaccaccatccaggatgtgaaccgctacctgctgaagagcggcggcagcagcccccccagcagccagaatgccaccctgcccagcagcagcgcctggcccctgagcgccagcggctacagcagcagcttcagcagcatcgccagcgcccccagcgtggccggcaagctgagtgacatcaagagcacctggagcagcggccccaccagccacacccaggccagcctgagccatgagctgtggaaggtgcccaggaacagcacagcccccacccggcccccacctggcctgaccaaccccaagcccagcagcacctggggcgccagccccctgggctggaccagcagctacagcagcggcagcgcctggagcacagacaccagcggccgcaccagctcctggctggtgctgaggaacctgaccccccagattgatggcagcaccctgcggaccctgtgcctgcagcacggccccctcatcaccttccacctgaacctgacccagggcaatgctgtggtgcgctacagcagcaaggaggaggccgccaaggcccagaagagcctgcacatgtgtgtgctgggcaacaccaccatcctggccgagtttgctggggaggaggaggtgaaccgcttcctggcccagggccaggccctgccccccaccagctcctggcagagcagcagcgccagcagccagccccggctgtctgctgctggcagcagccacggcctggtgcggagtgatgctggccactggaatgccccctgcctgggcggcaagggcagcagcgagctgctgtggggcggcgtgccccagtacagcagcagcctgtggggccccccatctgcagatgacagcagggtcatcggcagccccacccccctgaccaccctgctgcccggggacctgctgagcggggagagcctgtag

SEQ ID NO: 174158 - DNA, 5181 bp, Artificial Sequence; identical to SEQ ID NO: 174157
  Description of Artificial Sequence: Synthetic coding sequence

SEQ ID NO: 174159 - DNA, 5073 bp, Artificial Sequence; identical to SEQ ID NO: 174156
  Description of Artificial Sequence: Synthetic coding sequence

SEQ ID NO: 174160 - DNA, 5073 bp, Artificial Sequence; identical to SEQ ID NO: 174156
  Description of Artificial Sequence: Synthetic coding sequence

SEQ ID NO: 174161 - DNA, 5181 bp, Artificial Sequence; identical to SEQ ID NO: 174157
  Description of Artificial Sequence: Synthetic coding sequence

SEQ ID NO: 174162 - DNA, 1959 bp, Artificial Sequence
  Description of Artificial Sequence: Synthetic coding sequence
atgggcggctggaagggccctggccagaggcggggcaaggagggccctgaggcccggcggcgggctgctgagcggggcggcggcggcggcggcggcggcgtgcctgcccccaggagccctgcccgggagccccggcccaggagctgcctgctgctgcccccaccctggggcgccgccatgaccccagacctgctgaacttcaagaagggctggatgagcatcctggatgagcccggggagccccccagccccagcctgaccaccaccagcaccagccagtggaagaagcactggtttgtgctgacagacagcagcctgaagtactacagagacagcacagctgaggaggctgatgagctggatggagaaattgacctgcggagctgcacagatgtgacagaatatgctgtgcagagaaattatggcttccagatccacaccaaggatgctgtgtacaccctgagcgccatgaccagcggcatcagaagaaactggattgaggccctgaggaagacagtgcggcccaccagcgccccagatgtgaccaagctgagtgacagcaacaaggaaaatgccctgcacagctacagcacccagaagggccccctgaaggccggggagcagagagctggcagcgaggtgatcagccggggcggccccaggaaggcagatggccagaggcaggccctggactatgtggagctgagccccctgacccaggccagcccccagagggcccggaccccagcccggaccccagaccggctggccaagcaggaggagctggagcgggacctggcccagaggtctgaggagaggaggaagtggtttgaggccacagacagcaggaccccagaggtgcctgctggggagggcccccggcggggcctgggcgcccccctgacagaggaccagcagaaccggctgtctgaggagattgagaagaagtggcaggagctggagaagctgcccctgcgggagaacaagagggtgcccctgacagccctgctgaaccagagcagaggagagcggcggggccccccatctgatggccacgaggccctggagaaggaggtgcaggccctgcgggcccagctggaggcctggaggctgcagggcgaggccccccagagcgccctgcggagccaggaggatggccacatccccccaggctacatcagccaggaggcctgtgagaggagcctggccgagatggagagcagccaccagcaggtgatggaggagctgcagaggcaccacgagcgggagctgcagaggctgcagcaggagaaggagtggctgctggccgaggagacagctgccacagccagcgccatcgaggccatgaagaaggcctaccaggaggagctgagccgggagctgagcaagaccaggagcctgcagcagggcccagatggcctgaggaagcagcaccagagtgatgtggaggccctgaagcgggagctgcaggtgctgtctgagcagtacagccagaagtgcctggagattggagccctgatgaggcaggccgaggagcgggagcacaccctgcggcgctgccagcaggagggccaggagctgctgcggcacaaccaggagctgcacggccgcctgtctgaggagattgaccagctgcggggcttcatcgccagccagggcatgggaaatggctgcggccgcagcaatgaaagaagcagctgtgagctggaggtgctgctgcgggtgaaggaaaatgagctgcagtacctgaagaaggaggtgcagtgcctgagagatgagctgcagatgatgcagaaggacaagcgcttcaccagcggcaagtaccaggatgtgtatgtggagctgagccacatcaagaccaggtctgagcgggagattgagcagctgaaggagcacctgcggctggccatggccgccctgcaggagaaggagagcatgaggaacagcctggccgagtag
